United States Patent 12,569,549 (FLAVIVIRUS VACCINE) - sequence listing, part 38

SEQ ID NO: 14451 - RNA, 9876 nt, synthetic construct
  misc_feature 1..9876: note = derived and/or modified CDS sequence (opt3) from DENV-2__FJ882602__SS-prME
  source 1..9876: mol_type = other RNA
accgccggcatgatcattatgctgatacccacagctatggcattccacctcactacgagaaacggggagcctcatatgatcgtgagcaggcaggaaaagggaaagtcccttctgtttaagaccgaggacggtgtcaatatgtgcacattgatggccatggatttaggcgaactgtgtgaggacactattacctacaactgcccactactccggcaaaatgaaccggaggatatcgactgttggtgcaactctacatcaacctgggttacttatgggacatgtaccgcgacgggagagcaccgccgagaaaagcgtagtgtggctctggtgccccatgtgggcatgggtcttgagactagaaccgaaacatggatgagctccgagggggcctggaagcacgcacagaggattgagacttggatcctgcggcatcctggattcaccataatggccgctatcttggcatacacaattggcaccacgtattttcagcgcgtcctcatcttcattctgctgactgccgtggctccatctatgacaatgagatgcatcggcatatcgaatagggattttgttgaaggggtgtcaggaggtagctgggtcgacattgtgctcgagcacggcagttgtgtaaccactatggccaagaacaagcccacattagatttcgaactgatcaagaccgaggcgaaacagcctgcaacgcttcggaagtactgcattgaagccaaattgaccaatacaactaccgcttcccgctgtccaacacaaggggagccctctctgaacgaggaacaggacaagcgatttgtttgcaaacacagcatggtggatagaggatggggcaatggttgtgggctattcggaaagggcggcatcgtcacttgcgccatgtttacctgcaagaaaaacatggaggggaagatcgtgcagcctgaaaatctcgagtatacaattgtgataaccccacattccggagaagagaacgcagtcggtaatgacactggcaaacacgggaaggagatcaaagttacgccgcagtcaagtattacagaagctgagctgaccggatacggcactgtgaccatggaatgtagccccaggacaggtcttgatttcaacgagatggtactgttgcaaatggaaaataaggcctggctcgtgcatcggcagtggtttctggacttacctctgccatggctccccggggcggatacccagggctctaactggatccagaaagagactcttgtcacattcaagaaccctcacgccaagaaacaagacgtggttgtgctgggatcccaggagggcgcaatgcacacggctttgaccggggccactgaaatacagatgtcaagcggaaatctactgtttacaggtcatctcaagtgccgtctgcgcatggacaaacttcaactgaagggcatgagttattctatgtgtaccgggaaattcaaggtcgtgaaggagattgctgaaacacagcacggaactatcgtaatcagagttcagtacgagggcgatggttccccatgcaaaattcccttcgagatcatggacttggaaaagaggcatgtgctcgggcggctgattaccgtcaacccgatagtgacggagaaagatagccctgtcaatatcgaagccgagcccccatttggcgactcgtacattatcatcggagtggaacctggccagttaaagctgtcttggttcaaaaaggggtcctcaattggacaaatgtttgagaccacaatgcgaggtgcaaagcgcatggccatactaggcgatactgcttgggacttcgggagtctcggaggcgtttttaccagcatcggtaaagcgctgcaccaggtgttcggggcaatttatggcgccgctttttccggagtatcttggacaatgaagatccttattggcgtcgtgatcacttggatagggatgaacagcagatcaaccagtttgtccgttgccctggtgctcgtcggagtggtaacgctgtaccttggcgtgatggttcaggcagatagcggttgtgtcgtgtcttggaaaaataaggagctgaaatgcgggtcaggaatcttcattacagacaacgtgcatacctggactgaacagtataagtttcaacccgagagtccaagcaagttggcctccgctatccagaaagcccacgaagagggcatttgtggtatcaggtctgtcacacggctcgaaaatctgatgtggaagcagataacccccgagttaaaccacattctgtcggagaatgaagttaaactaactatcatgaccggcgatattaaggggatcatgcaggcaggaaaacgcagcctcagacctcaaccaacagagctgaagtactcctggaaaacgtggggcaaggcgaagatgctttcaaccgaaccgcataaccagactttcttgatagacgggcccgagacagctgaatgccctaataccaacagggcctggaatagtctggaggtggaggattatggatttggcgtgttcacaactaacatctggctcaaactgaaggaacgtcaggacgtattttgtgactctaaattaatgagcgcagccattaaggataatcgggctgtccacgccgacatgggttactggatcgagtccgcactgaacgatacctggaaaattgaaaaggcttcattcatcgaggtaaagagctgccattggccaaaatctcacacgctttggtccaacggggttttggagagtgaaatgataattcccaagaatttcgccggacctgtgagccagcacaactatcgaccaggctaccatacacaaaccgcgggtccctggcacctcggcaaactggagatggactttgatttctgtgaagggactaccgtcgtggttacagaggactgcggaaatagaggcccgtctctaaggactaccacagcctccgggaagctgatcacggaatggtgctgtcgctcatgcaccctccctccactgcggtacagaggagatgacggctgttggtatggtatggagatcaggccccttaaagagaaggaagagaacttggtgaatagtctggtaactgctgggtacggacagattgataactttagcttaggcgtcctcggtatggcactgttccttgaagagatgctgcgcacacgagtgggcaccaagcatgccgtgttgctcgtcgctgtttcgtttatgactctgatcacagggaatatgtccttccgggacctaggacgtgtggtagtgatggtcggcgccgcaatgaccgatgacattgggatgggagtgacgtatctggcgctcctggccgcttttaaagttagacctactttcgccgcaggccttttgctgaggaagttaacctctaaagaactcatgatgacaaccataggtatcgtgctgcttagccagtcaactattcccgagacaatcctggagctaaccgatgctctcgccctggggatgatgattttgaagatcgtccgcaacatggaaaaataccaactggcagtgacaataatggccatcttatgcgttccaaatgctgtgattctccagaacgcgtggaaggtcagttgtactatcctggccgtagtgtccgtttctcctcttctgttgaccagctcccagcagaaggcagactggattcccctcgctctgacgatcaaaggactaaatccaacagccatatttctgaccactctttcacggaccaacaagaaaagaagctggccgctcaatgaggccattatggctgtgggcatggtcagtatcctggcatcttccttgctgaagaacgacatccctatgacaggccccttagtggccgggggactcctgactgtatgctatgtgcttaccggtaggagcgcggatctggaattggagcgagctgccgacgtccgctgggaagatcaagcagagatttcgggctcatctccaatactcagtatcacgatttccgaggacgggagcatgtctatcaaaaatgaagaggaggaacagacactgaccattctaatccggactggactgcttgttataagcggcctcttccccgtgtccatccctattacagccgctgcatggtacctgtgggaggtgaagaaacagagagccggtgtcttgtgggatgtgccatcaccccctccggttgggaaggcggaattagaggacggagcttataggatcaagcagaaaggcattctgggctacagtcaaatcggggccggagtatacaaggaaggtacctttcacactatgtggcatgtgacacgtggcgcagtcctcatgcacaaagggaagcgcatagagccaagctgggccgatgtgcggaaagacctgatttcttatggaggcggttggaaacttgaaggggagtggaaggagggagaagaggttcaggtgctggctttggaacccggcaaaaaccctagagccgtccagaccaagccaggcctattcaaaacgaacactgggaccatcggagcagtgtccctggatttttcacccggtacaagtggcagccctatcgtagacaagaaagggaaggtcgtgggactctacggcaatggtgttgtgaccaggtccgggacatatgtctctgctattgcccagactgagaagtcgatcgaagataacccggagatagaggacgatattttccgaaaacggcgcctgaccatcatggaccttcaccccggagcgggcaagacgaaaagatacttaccagccattgtgagggaagcaatcaagcggggcctgcgaacactcatattggctcctactagagttgtggccgctgagatggaagaggcactgcgcgggctccccattaggtatcaaaccccagccatccgtgccgaacatacaggacgggagatcgtcgacctgatgtgtcacgctaccttcactatgagacttctgagccctgtgagggtacccaattacaacttgattatcatggatgaggcgcattttaccgacccagcatcaattgccgctcgcggttatatatccacacgagtggaaatgggcgaggccgcagggatcttcatgacggccactccgcctggaagtagagatccctttccacagtctaatgctcccattatggacgaggaacgggagatccctgaaaggagctggaactccggccacgagtgggttaccgatttcaaaggtaagacagtctggtttgtgccatcaatcaaggcggggaatgacattgccgcatgcctacgcaaaaacggaaagaaagtgatacagctgtctcgtaagaccttcgatagcgaatacatcaaaactagaacaaatgactgggattttgtcgtaaccacggacattagtgagatgggcgctaacttcaaggccgaacgggtgatcgatcccaggcgctgtatgaagcctgttattctcactgacggcgaggagcgagtgatcttagcagggccgatgccagtcacacattccagcgccgctcaaagacggggaaggataggtcgcaatcccaaaaacgaaaatgaccagtacatctatatgggcgagcctctggaaaacgatgaggactgcgcccactggaaggaagcgaaaatgcttctggataatattaacacccccgaggggatcattccatctatgtttgagcctgaaagagagaaggtggacgcaatcgatggagaatacaggctccggggcgaggcccgtaaaaccttcgttgacttgatgcgccgaggtgatctgcccgtgtggctcgcttatagagtcgccgctgaagggataaactacgcagacaggcggtggtgttttgatggcattaagaataaccagatcctggaggagaatgtggaagtagagatttggactaaagaaggagagcgcaagaaacttaaaccaagatggctagacgccaggatctattcagatcctctggctttgaaggagttcaaagagttcgccgcaggccggaagtccttaacactgaacctcataaccgagatggggcgactgccgacatttatgactcagaaagcgagaaatgcccttgacaacctggctgtgctccacacggccgaagcaggaggtcgcgcttacaatcatgccttgagtgagctgcccgaaaccctagagacactgctccttctgactttattggcaaccgttacaggcgggatcttcctgtttctcatgagcggaaagggcattggtaagatgaccctggggatgtgctgcatcattactgcctcgatccttctgtggtatgctcaaatacagccacactggattgcggcctctatcatcctcgagttctttttgattgtcctgttaatccctgaacccgagaaacagaggacgccacaggataaccaactaacctacgtggtgatagcaattctgacagtcgttgctgccactatggccaatgaaatgggcttcctcgagaagaccaaaaaggaccttggactgggctccatcgcaacacagcagcctgaaagcaacattttggacatcgatctgcggcccgcttcagcctggaccctctacgcggtggctactacatttataacgccgatgctgcgtcatagtatcgaaaattcttccgtaaacgtgagccttaccgccattgcaaatcaggccactgtcctcatggggctgggaaaaggttggccattgtcaaagatggacatcggcgtgcctctgttagctattgggtgttatagtcaagttaaccccatcacactaaccgcagccctgctccttctggtggcgcactacgctattatcggaccaggcttgcaggccaaggcaaccagagaggcccagaaaagggctgccgcaggtataatgaagaatcccacagtcgatgggattactgtaatcgacctggatcctatcccgtatgaccccaaattcgaaaagcagctcggccaagtgatgctgcttgttttatgcgtgacgcaggtcctgatgatgcgcaccacatgggctctctgtgaggccttgactctggcgaccggaccaattagcacactatgggaaggcaaccctgggcggttttggaataccactatagccgtgtccatggcaaacatcttccgaggatcttacctggctggcgccggtctcctttttagcattatgaaaaacacgacaaataccagaagggggactggaaacaccggcgagacactgggtgaaaagtggaagaatcgcttgaacgcactgggcaaatccgagttccagatctataagaaatcagggattcaagaggtcgatcggactctcgctaaggaaggaatcaaaagaggcgagaccgaccaccatgccgtgtctcgtgggagtgccaagctgaggtggtttgttgaacggaatttagtgacacccgagggaaaagtagtggatcttggctgcggtcgcgggggatggtcgtactattgtggcggtctgaagaacgtccgagaggttaagggcctcacgaaagggggacctggccacgaggaaccaatacccatgagcacctacgggtggaatctagtgagactgcagtccggagtcgacgtgttcttcactcctccagaaaagtgcgatacattgctgtgtgacatcggcgagtcttcacccaacccgaccgtagaagcgggtaggactctccgggtgcttaatctggttgagaactggttgaataacaatacacagttttgcattaaagtgctgaacccttacatgccaagcgtcatcgagaagatggaagctctccagcgcaaatatgggggagcattagtgagaaatcccctgtccaggaacagtacccatgagatgtactgggtctctaacgccagcggcaatattgtgtcatccgttaacatgatcagtcgaatgcttataaatcggttcacgatgcgtcacaagaaggctacctatgaacctgatgtagacctgggcagcgggacaagaaacattggaatcgagtctgaaactccaaatctagacatcattggtaaacgcatagagaagatcaaacaagagcatgaaacctcctggcactacgatcaggaccacccctataagacatgggcctaccatggctcatatgagactaaacagaccgggagcgcatcgtctatggtgaacggagtcgtgaggctcctgacaaagccgtgggatgttattcctatggtgacccagatggccatgactgacacgacaccctttggccaacagcgggtcttcaaggaaaaagtggataccagaactcaggagccaaaggaaggtaccaaaaagttgatgaaaatcacagctgagtggctgtggaaggagctcgggaagaaaaagacgcctcgcatgtgtaccagggaagagtttactcgaaaagtacggagtaatgcggcccttggagcaattttcacagacgaaaacaagtggaaatccgctagagaggccgtggaggatagcaggttttgggaactggttgacaaggagcgcaatttacacctggaaggcaaatgcgagacctgtgtctacaacatgatgggcaagcgtgaaaagaaattgggggagttcggaaaggcaaaaggttcacgggccatctggtacatgtggctcggcgctagatttctggagttcgaagccctagggtttcttaatgaggatcattggttctccagggaaaactctctgagcggagtggagggcgaaggtctccacaagctggggtatatattgcgcgacgtgagtaaaaaggagggaggcgcgatgtacgcagatgacactgccggctgggacacacgaatcaccctggaggatctcaagaatgaagagatggtcacaaaccacatggaaggggagcataagaaacttgctgaagccatttttaaactgacttatcagaataaagttgtgcgggtacaaagacccaccccaaggggaacggtgatggacatcatttcccgcagagatcagcggggtagcggccaggtcgggacctacggattaaacacattcactaacatgggcgcacaactgatcaggcagatggagggtgaggaagtgttcaaagggattcagcacttgaccgctacagaggaaatagccgttcagaattggctcgctcgtgtgggacgagagcgcctgtctagaatggccatctcaggcgacgattgcgtcgtgaagcccctagacgatcggtttgcaagtgcgcttactgccctgaacgacatgggcaaggtaaggaaagatattcaacagtgggagccttcccgcgggtggaatgactggacccaggttccattctgcagccatcactttcatgaactcatcatgaaggatggaagagtgctggtcgtgccgtgtcggaaccaggacgagttgatcggtagggctcgaatttctcaaggcgccgggtggtcgttacgtgaaacggcatgcctgggaaaatcatatgctcagatgtggagcctcatgtacttccacagacgcgatcttcggctggccgcaaatgccatatgttccgcggtgcccagtcactgggtccctacatctaggaccacttggagcatccatgctagacacgagtggatgacaaccgaagacatgctaactgtttggaaccgcgtgtggattcaggagaatccatggatggaggacaagacccccgtagaatcctgggaggaaatcccttatctgggcaaacgggaggatcagtggtgcggttcactcattgggttgacaagtagggccacgtgggcaaagaacatccaaaccgccataaatcaggtgcgatctctgatcggaaacgaagagtacactgactacatgccaagcatgaagagatttcggagggaggaagaggaagctggcgtcctttggtga

SEQ ID NO: 14452 - RNA, 9876 nt, synthetic construct
  misc_feature 1..9876: note = derived and/or modified CDS sequence (opt3) from DENV-2__GQ252676__SS-prME
  source 1..9876: mol_type = other RNA
accgccggagtgatcattatgctgatacccacagctatggcattccacctcactacgagaaacggggagcctcatatgatcgtcagcaagcaggaaaagggaaagtcccttctgtttaagaccgaggaaggtgttaatatgtgcacattgatggccatggacttaggcgagctgtgtgaagatactattacctacaactgcccactgctcaggcaaaatgagccggaggacatcgattgttggtgcaactctacatcaacctgggtgacttatgggacatgtaccgcgacgggagaacaccggcgcgagaagcgaagtgttgctctggtgccccatgtcggcatgggtcttgaaactcgtaccgagacatggatgagctccgagggggcctggaaacacgcacagcggattgaaacttggatcctgaggcatcctggattcaccataatggccgctatcttggcatacacaattggcaccacgtattttcagcgggtgctcatcttcattctgctgactgccgttgctccatctatgacaatgcgctgcatcggcatatcgaatagagactttgtggagggggtctcaggaggtagctgggtggatattgtgctcgaacacggcagttgtgttaccactatggccaagaacaagcccacattagacttcgagctgatcaaaaccgaagcgaagcagcctgcaacgcttaggaaatactgcattgaggccaagttgaccaatacaactaccgcttcccggtgtccaacacaaggggagccctctctgaacgaagaacaggataaacgctttgtgtgcaagcacagcatggtcgaccgaggatggggcaatggttgtgggctattcggaaagggcggcatcgtgacttgcgccatgtttacctgcaaaaagaacatggaagggaaaatcgtgcagcctgagaatctcgaatatacaattgtcgttaccccacattccggagaggagaacgcagtgggtaatgatactggcaagcacgggaaagaaataaaggtaacgccgcagtcaagtatcacagaggctgaactgaccggatacggcactgtgaccatggagtgtagccccagaacaggtcttgacttcaacgaaatggtcctgttgcaaatggagaataaagcctggctcgtgcataggcagtggtttctggatttacctctgccatggctccccggggcggacattcagggctctaactggatccagaaggagacccttgttactttcaagaaccctcacgccaaaaagcaagatgtggtcgtgctgggatcccaggaaggcgcaatgcacacagctttgacgggggccaccgagatacagatgtcaagcggaaatctactgtttactggtcatctcaaatgccggctgcgtatggacaaacttcaactgaaaggcatgagttattctatgtgtacagggaagttcaaggtagttaaagaaattgctgagacccagcacggaacaatcgtggtccgcgtgcagtacgagggcgacggttccccatgcaagatccccttcgaaattatggatttggagaaaagacatgtcctcgggaggctgatcactgtgaacccgattgttaccgaaaaggacagccctgtgaatatagaggccgaacccccatttggcgattcgtacatcattatcggagtagagcctggccagttaaaactgtcttggttcaagaaggggtcctcaatcggacaaatgtttgagacgaccatgcggggtgcaaaacgaatggccattctaggcgacacagcttgggatttcgggagtctcggaggcgtctttactagcataggtaaggcgctgcaccaggtgttcggggcaatctatggcgccgctttttccggagtttcttggaccatgaaaattcttatcggcgtggtcattacatggatcgggatgaacagccgctcaaccagcttgtccgtgagcctggtactcgtgggagttgtcacactgtaccttggcgtgatggtgcaggccgactctggttgtgtcgtttcatggaagaataaagaactgaagtgcgggagtggaatattcatcacggataacgtgcatacatggaccgagcagtataagtttcaacccgaaagcccatccaaattggcatctgccattcagaaggctcacgaggaaggcatctgtggtattagatcggtgactaggctcgagaatctgatgtggaaacagatcacacccgagttaaaccacatactgagcgaaaatgaggtaaagctatccattatgaccggcgacatcaaagggattatgcaggccggaaagcggtcactccgccctcaaccaactgaactgaaatacagttggaagacctggggcaaggcaaaaatgctttctacagagccgcataaccagacgttcttgatcgatgggcccgaaaccgcggagtgccctaatactaacagagcttggaatagcctggaggtcgaagactatggatttggcgtgttcacaaccaacatatggctcaagctgaaagagaggcaggatgtattttgtgactccaagttaatgtcagccgcaatcaaagacaatcgtgccgtgcacgctgatatgggttactggattgaaagcgccctgaacgacacatggaagatcgagaaggcatctttcattgaggtcaaatcctgccattggccaaagagtcacactctttggagcaacggggtgttggaatctgagatgatcatacccaaaaatttcgctggacctgtttcccagcacaactatcggccaggctaccatacccaaacggccggtccctggcacctcggcaagctggaaatggattttgacttctgtgaggggacaaccgtggtagtcactgaagattgcggaaatcgaggcccgtcactaagaaccacaactgcgagtgggaaactgattaccgagtggtgctgtaggagctgcacactccctccactgcgctaccggggagaggacggctgttggtatggtatggaaatcagaccccttaaggagaaggaagagaacttggtaaattcgctggtgacggccgggcatggacagatcgataacttttccttaggcgtcctcggtatggctctgttccttgaagagatgctgaggacccgcgttggcactaaacacgcagtgttgctcgtagccgtgtcttttatgacactgattaccgggaatatgagcttccgagacctaggacgggtcatggtgatggttggcgctgccatgactgatgacatcgggatgggagtgacatacctggcactcctggcggcctttaaggtccgtcctaccttcgctgccggccttttgctgagaaaattaacgtcaaaggagctcatgatgactaccattggtatagtgctgcttagtcagtccacaatccccgaaaccattctggagctaactgatgcactcgctctggggatgatgatcttgaaaattgttaggaacatggaaaagtatcaactggccgtgacaatcatggcaatattatgcgtcccaaatgccgtaatcctccagaacgcttggaaggtgtcttgtaccattctggcggccgttagcgtgtcccctcttctgttgacatcaagccagcagaaagcagactggatccccctcgctctgactattaagggactaaatccaaccgccatctttctgacgacacttagtcgcaccaacaaaaagcggtcttggccgctcaatgaggccataatggctgtcggcatggtgtccattctggcaagctcgttgctgaaaaacgatatccctatgactggccccttagtagccgggggactcctgaccgtgtgctacgtccttacaggtagatcagcggacctggaattggagagggctgccgacgttcgatgggaggatcaagcagaaatctctggcagttccccaattctcagcataactatctctgaggacgggagcatgtccattaagaatgaagaggaggaacagaccctgacgatcctaattcgcacaggactgcttgtgatctcaggcctcttccccgtgagtatacctatcaccgccgctgcatggtatctgtgggaggtcaaaaagcagcgggccggtgtgttgtgggatgttccaagtccccctccggtagggaaggcggaattagaggacggagcttacagaattaaacagaagggcatcctgggctattctcaaattggggccggagtgtacaaagaaggtacttttcatacaatgtggcacgtcaccaggggcgcagtgctcatgcacaaggggaaacgtatcgagccatcctgggccgatgttcgcaaggacctgatatcatacggaggcggttggaaacttgagggggaatggaaagagggagaagaggtgcaggtcctggctttggaacccggcaagaaccctcgggccgtgcagactaaaccaggcctattcaagacaaacaccgggacgattggagcagtaagtctggattttagccccggtacttccggctctcctatcgtcgacaaaaaggggaaggtggttggactctatggcaatggtgtggtcaccagatcggggacatacgtgagcgctatcgcccagaccgagaaatcaattgaggataacccggaaatcgaggacgatatattcaggaagaaacgactgacaattatggaccttcatcccggagcgggcaagactaaacggtatttaccagccatcgttcgcgaagcaattaagagaggcctgaggaccctcatcttggctcctacgcgggtggtcgccgctgagatggaagaggcactgcgagggctccccataagataccaaacaccagccattcgcgccgagcacactggaagggaaatcgtggatctgatgtgtcatgctaccttcacaatgcgtcttctgtcccctgtacgggtgcccaattataacttgatcattatggacgaggcgcactttaccgacccagcaagtatcgccgctagaggttacatttctactagggttgaaatgggcgaggccgcagggatattcatgaccgccacaccgcctggaagccgcgatccctttccacagtccaatgctcccatcatggacgaggaacgagagattcctgaaagatcatggaactctggccatgagtgggtcacggatttcaagggtaaaactgtgtggtttgtgccaagcatcaaggcggggaatgacatcgccgcatgcctacggaaaaacggaaagaaagtcattcagctgagtaggaagaccttcgattccgaatatataaagacacgcaccaatgactgggattttgtagtgactacagacatcagcgagatgggcgctaacttcaaagccgagcgtgttattgatcccagacggtgtatgaagcctgtgatcctcaccgacggcgaagagagggtcattttagcagggccgatgccagtgacgcactcttcagccgctcaacgccgaggaagaatcggtcggaatcccaaaaacgaaaatgatcagtacatatacatgggcgagcctctggaaaacgacgaggactgcgcccactggaaggaggcgaaaatgcttctggataatatcaacactcccgaagggattatcccatccatgtttgagcctgaaagggagaaggttgacgcaattgatggagaatatcgcctcagaggcgaggccaggaaaacattcgtggacttgatgcggcgtggtgatctgcccgtctggctcgcttaccgcgtggccgctgaggggatcaactatgcagaccgaagatggtgttttgatggcataaagaataaccagattctggaagagaatgtagaagtggagatctggaccaaggagggagaaaggaagaaacttaaaccacggtggctagacgcccgcatttacagtgatcctctggctttgaaagagttcaaagagttcgccgcaggcagaaagagcttaaccctgaacctcatcactgagatggggaggctgccgacatttatgacccagaaggcgcggaatgcccttgacaacctggctgttctccatacagccgaagcaggaggtcgagcttataatcacgccttgtcggagctgcccgagactctagaaacgctgctccttctgaccttattggcaacagtcactggcgggatattcctgtttctcatgtctggaaaaggcatcggtaagatgaccctggggatgtgctgcattatcacagcctccattcttctgtggtacgctcaaatccagccacattggatagcggccagcattatcctcgagttctttttgatcgtgctgttaattcctgaacccgagaaacagagaaccccacaggataaccaactaacttatgtggtcatcgcaatactgacggttgtggctgccaccatggccaatgaaatgggcttcctcgagaagactaagaaggactttggacttggctcaattgcaactcagcagcctgagagtaacatcctggatattgacttgcgccccgcttctgcctggaccctgtacgcggtagctacaaccttcatcactccgatgctcaggcactccatagaaaatagctcagtgaacgtcagtctgacagccatcgcaaatcaggccacggtgcttatggggctcggaaagggttggccactgagcaaaatggacattggcgttcctttgctggctatcgggtgttactcccaagtgaaccccattaccttaactgcagccctactgctccttgtcgcgcactatgctatcattggaccaggcctgcaggccaaggcaacacgggaggcccagaaacgtgctgccgcaggtatcatgaagaatcccaccgtagatgggataaccgtgattgacttggatcctatcccgtacgaccccaaatttgaaaagcagctgggccaagttatgctcctggtgctttgcgtcacacaggtgttaatgatgagaactacgtgggctctgtgtgaggccctcaccttggcgacaggaccaatctctactctgtgggaaggcaaccctgggaggttctggaataccacaattgccgtcagcatggcaaacatatttcgcggatcctatctagctggcgccggtctactcttctcaatcatgaagaacaccactaatacgcggcgagggacaggaaacaccggcgagactcttggtgagaaatggaagaatagactgaactctttgggcaaaagtgaatttcagatttacaagaggtcggggatccaagaggtggatcgcaccctggcaaaagaaggaattaagcggggcgagacagaccatcacgctgttagcagagggtccgccaaactccgttggttcgtggagaggaatctggtaactcccgaaggaaaggtggtcgatttaggctgcggtagagggggatggtcttattactgtggcggtcttaagaacgttcgcgaggtgaaaggcctgaccaaagggggacctggccatgaagaaccaatccccatgtcaacatatgggtggaatctcgtccgactacagagcggagtggacgtattctttacgcctccagaaaaatgcgataccctgttgtgtgacataggcgagtccagtcccaacccgactgtggaggccggtagaacactgagggttctcaatcttgtggaaaactggctgaataacaatacccagttctgcatcaaggtcttgaacccttacatgccatctgtgattgagaaaatggaaactctgcagcggaagtacgggggagcgctcgtccgcaatcccttaagcagaaactcaacacacgagatgtattgggtgtccaacgctagtggcaatatcgttagctctgtaaacatgatttccaggatgctgatcaatcgatttaccatgcggcataagaaagcaacgtacgaacctgatgtggaccttggctcagggacccgtaacataggaattgagagcgagacaccaaatctggatatcatcggtaagagaattgagaagataaagcaagagcacgaaacttcgtggcactatgaccaggaccatccctacaaaacctgggcctatcacggctcttacgagacaaagcagactgggagtgcttccagcatggtcaacggagtggttcgcctactcaccaagccgtgggatgtgatccctatggtcacacagatggccatgaccgacactacgcccttcggccaacagagggtgtttaaagaaaaggtagatacacggacccaggagccaaaagagggtactaagaaactgatgaagattaccgcagaatggttgtggaaggagctggggaaaaagaaaacacctagaatgtgtacgcgcgaagagttcgccaggaaggtgcgatcaaatgctgcgctcggagccatctttaccgacgagaacaaatggaagtccgcacgggaagctgttgaggattctagattctgggaacttgtcgacaaagagaggaatctgcatttagaaggcaagtgcgagacttgtgtgtataacatgatgggcaagcgcgagaaaaagattggggaatttggaaaagccaagggtagccgtgcaatctggtacatgtggctgggcgcccggttcttggagtttgaagctctcgggttcctgaatgaggatcactggtttagtagagaaaactccctaagcggagtggagggcgagggtcttcacaaactggggtacatactcagggaagtctctaagaaggagggaggcgccatgtatgcggacgatacagcaggctgggacacccgcatcactctggaagatttgaaaaatgaggaaatggttacaaaccatatggagggggagcacaagaaactggccgaagctattttcaagctcacctaccagaataaagtggtacgagtgcaacggcccacaccaagaggaactgtcatggacatcatttcaaggcgcgaccagagaggtagtggccaggtggggacctatggacttaacacgttcaccaacatgggcgcccaactgatccggcagatggagggtgaaggggtttttaagggcattcagcatttaacagcaactgaggaggtggctgtccaggattggctggccagggtgggccgtgaacgattgtcccgcatggctataagcggcgacgattgcgtagttaagcccctcgacgatagattcgcctctgcactgaccgcgctaaatgacatggggaaagtgcggaaggatatccaacagtgggagccttcgaggggatggaacgactggacacaggtcccattttgctcacaccatttccacgaacttattatgaaagatggtcgcgtgctggtggtcccgtgtagaaatcaggacgagctcatcggccgggccaggatcagccaaggggctggatggtccctgcgagaaactgcctgcttgggcaagagttacgcacagatgtggtctttaatgtattttcaccgtagagatctgcgcctcgctgccaacgcaatttgtagcgccgttccctcccattgggtgcctacctcacggacgacatggagtatacacgcgaggcatgagtggatgaccactgaggacatgcttacagtatggaatagagtgtggatccaggaaaacccatggatggaggataaaacccccgtcgaatcttgggaggaaattccttacctgggtaagcgcgaggaccagtggtgcgggagcctaatcggactgacttcccgggctacctgggccaagaatattcaaacagcaatcaaccaggtgaggtcactcataggcagcgaggaatatacggactacatgccatctatgaaacgattcagacgggaggaagaggaagccggcgttttgtggtga

SEQ ID NO: 14453 - RNA, 9876 nt, synthetic construct
  misc_feature 1..9876: note = derived and/or modified CDS sequence (opt3) from DENV-2__GQ252677__SS-prME
  source 1..9876: mol_type = other RNA
accgccggcgtgatcattatgctgatacccacagctatggcattccacctcactacgagaaacggggagcctcatatgatcgtcagcaagcaggaaaagggaaagtcccttctgtttaaaaccgaggaaggtgttaatatgtgcacattgatggccatggacttaggcgagctgtgtgaagatactattacctacaactgcccactgctcagacaaaatgagccggaggacatcgattgttggtgcaactctacatcaacctgggtgacttatgggacatgtaccgcgacgggagaacaccggcgcgagaagcgaagtgttgctctggtgccccatgtcggcatgggtcttgaaactcgtaccgagacatggatgagctccgagggggcctggaaacacgcacagcggattgaaacttggatcctgaggcatcctggattcaccataatggccgctatcttggcatacacaattggcaccacgtattttcagcgggtgctcatcttcattctgctgactgccgttgctccatctatgacaatgcgctgcatcggcatatcgaatagagactttgtggagggggtctcaggaggtagctgggtggatattgtgctcgaacacggcagttgtgttaccactatggccaagaacaagcccacattagacttcgagctgatcaaaaccgaagcgaagcagcctgcaacgcttaggaaatactgcattgaggccaagttgaccaatacaactaccgcttcccggtgtccaacacaaggggagccctctctgaacgaggaacaggataaacgctttgtgtgcaagcacagcatggtcgaccgaggatggggcaatggttgtgggctattcggaaagggcggcatcgtgacttgcgccatgtttacctgcaaaaagaacatggaagggaaaatcgtgcagcctgagaatctcgaatatacaattgtcgttaccccacattccggagaggagaacgcagtgggtaatgatactggcaagcacgggaaagaaataaaggtaacgccgcagtcaagtatcacagaggctgaactgaccggatacggcactgtgaccatggagtgtagccccagaacaggtcttgacttcaacgaaatggtcctgttgcaaatggagaataaagcctggctcgtgcataggcagtggtttctggatttacctctgccatggctccccggggcggacattcagggctctaactggatccagaaggagacccttgttactttcaagaaccctcacgccaaaaagcaagatgtggtcgtgctgggatcccaggaaggcgcaatgcacacagctttgacgggggccaccgagatacagatgtcaagcggaaatctactgtttactggtcatctcaaatgccggctgcgtatggacaaacttcaactgaaaggcatgagttattctatgtgtacagggaagttcaaggtagttaaagaaattgctgagacccagcacggaacaatcgtggtccgcgtgcagtacgagggcgacggttccccatgcaagatccccttcgaaattatggatttggagaaaagacatgtcctcgggaggctgatcactgtgaacccgattgttaccgaaaaggacagccctgtgaatatagaggccgaacccccatttggcgattcgtacatcattatcggagtagagcctggccagttaaaactgtcttggttcaagaaggggtcctcaatcggacaaatgtttgagacgaccatgcggggtgcaaaacgaatggccattctaggcgacacagcttgggatttcgggagtctcggaggcgtctttactagcataggtaaggcgctgcaccaggtgttcggggcaatctatggcgccgctttttccggagtttcttggaccatgaaaattcttatcggcgtggtcattacatggatcgggatgaacagccgctcaaccagcttgtccgtgagcctggtactcgtgggagttgtcacactgtaccttggcgtgatggtgcaggccgactctggttgtgtcgtttcatggaagaataaagaactgaagtgcgggagtggaatattcatcacggataacgtgcatacatggaccgagcagtataagtttcaacccgaaagcccatccaaattggcatctgccattcagaaggctcacgaggaaggcatctgtggtattagatcggtgactaggctcgagaatctgatgtggaaacagatcacacccgagttaaaccacatactgagcgaaaatgaggtaaagctatccattatgaccggcgacatcaaagggattatgcaggccggaaagcggtcactccgccctcaaccaactgaactgaaatacagttggaagacctggggcaaggcaaaaatgctttctacagagccgcataaccagacgttcttgatcgatgggcccgaaaccgcggagtgccctaatactaacagagcttggaatagcctggaggtcgaagactatggatttggcgtgttcacaaccaacatatggctcaagctgaaagagaggcaggatgtattttgtgactccaagttaatgtcagccgcaatcaaagacaatcgtgccgtgcacgctgatatgggttactggattgaaagcgccctgaacgacacatggaagatcgagaaggcatctttcattgaggtcaaatcctgccattggccaaagagtcacactctttggagcaacggggtgttggaatctgagatgatcatacccaaaaatttcgctggacctgtttcccagcacaactatcggccaggctaccatacccaaacggccggtccctggcacctcggcaagctggaaatggattttgacttctgtgaggggacaaccgtggtagtcactgaagattgcggaaatcgaggcccgtcactaagaaccacaactgcgagtgggaaactgattaccgagtggtgctgtaggagctgcacactccctccactgcgctaccggggagaggacggctgttggtatggtatggaaatcagaccccttaaggagaaggaagagaacttggtaaattcgctggtgacggccgggcatggacagatcgataacttttccttaggcgtcctcggtatggctctgttccttgaagagatgctgaggacccgcgttggcactaaacacgcagtgttgctcgtagccgtgtcttttatgacactgattaccgggaatatgagcttccgagacctaggacgggtcatggtgatggttggcgctgccatgactgatgacatcgggatgggagtgacatacctggcactcctggcggcctttaaggtccgtcctaccttcgctgccggccttttgctgagaaaattaacgtcaaaggagctcatgatgactaccattggtatagtgctgcttagtcagtccacaatccccgaaaccattctggagctaactgatgcactcgctctggggatgatgatcttgaaaattgttaggaacatggaaaagtatcaactggccgtgacaatcatggcaatattatgcgtcccaaatgccgtaatcctccagaacgcttggaaggtgtcttgtaccattctggcggccgttagcgtgtcccctcttctgttgacatcaagccagcagaaagcagactggatccccctcgctctgactattaagggactaaatccaaccgccatctttctgacgacacttagtcgcaccaacaaaaagcggtcttggccgctcaatgaggccataatggctgtcggcatggtgtccattctggcaagctcgttgctgaaaaacgatatccctatgactggccccttagtagccgggggactcctgaccgtgtgctacgtccttacaggtagatcagcggacctggaattggagagggctgccgacgttcgatgggaggatcaagcagaaatctctggcagttccccaattctcagcataactatctctgaggacgggagcatgtccattaagaatgaagaggaggaacagaccctgacgatcctaattcgcacaggactgcttgtgatctcaggcctcttccccgtgagtatacctatcaccgccgctgcatggtatctgtgggaggtcaaaaagcagcgggccggtgtgttgtgggatgttccaagtccccctccggtagggaaggcggaattagaggacggagcttacagaattaaacagaagggcatcctgggctattctcaaattggggccggagtgtacaaagaaggtacttttcatacaatgtggcacgtcaccaggggcgcagtgctcatgcacaaggggaaacgtatcgagccatcctgggccgatgttcgcaaggacctgatatcatacggaggcggttggaaacttgagggggaatggaaagagggagaagaggtgcaggtcctggctttggaacccggcaagaaccctcgggccgtgcagactaaaccaggcctattcaagacaaacaccgggacgattggagcagtaagtctggattttagccccggtacttccggctctcctatcgtcgacaaaaaggggaaggtggttggactctatggcaatggtgtggtcaccagatcggggacatacgtgagcgctatcgcccagaccgagaaatcaattgaggataacccggaaatcgaggacgatatattcaggaagaaacgactgacaattatggaccttcatcccggagcgggcaagactaaacggtatttaccagccatcgttcgcgaagcaattaagagaggcctgaggaccctcatcttggctcctacgcgggtggtcgccgctgagatggaagaggcactgcgagggctccccataagataccaaacaccagccattcgcgccgagcacactggaagggaaatcgtggatctgatgtgtcatgctaccttcacaatgcgtcttctgtcccctgtacgggtgcccaattataacttgatcattatggacgaggcgcactttaccgacccagcaagtatcgccgctagaggttacatttctactagggttgaaatgggcgaggccgcagggatattcatgaccgccacaccgcctggaagccgcgatccctttccacagtccaatgctcccatcatggacgaggaacgagagattcctgaaagatcatggaactctggccatgagtgggtcacggatttcaagggtaaaactgtgtggtttgtgccaagcatcaaggcggggaatgacatcgccgcatgcctacggaaaaacggaaagaaagtcattcagctgagtaggaagaccttcgattccgaatatataaagacacgcaccaatgactgggattttgtagtgactacagacatcagcgagatgggcgctaacttcaaagccgagcgtgttattgatcccagacggtgtatgaagcctgtgatcctcaccgacggcgaagagagggtcattttagcagggccgatgccagtgacgcactcttcagccgctcaacgccgaggaagaatcggtcggaatcccaaaaacgaaaatgatcagtacatatacatgggcgagcctctggaaaacgacgaggactgcgcccactggaaggaggcgaaaatgcttctggataatatcaacactcccgaagggattatcccatccatgtttgagcctgaaagggagaaggttgacgcaattgatggagaatatcgcctcagaggcgaggccaggaaaacattcgtggacttgatgcggcgtggtgatctgcccgtctggctcgcttaccgcgtggccgctgaggggatcaactatgcagaccgaagatggtgttttgatggcataaagaataaccagattctggaagagaatgtagaagtggagatctggaccaaggagggagaaaggaagaaacttaaaccacggtggctagacgcccgcatttacagtgatcctctggctttgaaagagttcaaagagttcgccgcaggcagaaagagcttaaccctgaacctcatcactgagatggggaggctgccgacatttatgacccagaaggcgcggaatgcccttgacaacctggctgttctccatacagccgaagcaggaggtcgagcttataatcacgccttgtcggagctgcccgagactctagaaacgctgctccttctgaccttattggcaacagtcactggcgggatattcctgtttctcatgtctggaaaaggcatcggtaagatgaccctggggatgtgctgcattatcacagcctccattcttctgtggtacgctcaaatccagccacattggatagcggccagcattatcctcgagttctttttgatcgtgctgttaattcctgaacccgagaaacagagaaccccacaggataaccaactaacttatgtggtcatcgcaatactgacggttgtggctgccaccatggccaatgaaatgggcttcctcgagaagactaagaaggactttggacttggctcaattgcaactcagcagcctgagagtaacatcctggatattgacttgcgccccgcttctgcctggaccctgtacgcggtagctacaaccttcatcactccgatgctcaggcactccatagaaaatagctcagtgaacgtcagtctgacagccatcgcaaatcaggccacggtgcttatggggctcggaaagggttggccactgagcaaaatggacattggcgttcctttgctggctatcgggtgttactcccaagtgaaccccattaccttaactgcagccctactgctccttgtcgcgcactatgctatcattggaccaggcctgcaggccaaggcaacacgggaggcccagaaacgtgctgccgcaggtatcatgaagaatcccaccgtagatgggataaccgtgattgacttggatcctatcccgtacgaccccaaatttgaaaagcagctgggccaagttatgctcctggtgctttgcgtcacacaggtgttaatgatgagaactacgtgggctctgtgtgaggccctcaccttggcgacaggaccaatctctactctgtgggaaggcaaccctgggaggttctggaataccacaattgccgtcagcatggcaaacatatttcgcggatcctatctagctggcgccggtctactcttctcaatcatgaagaacaccactaatacgcggcgagggacaggaaacaccggcgagactcttggtgagaaatggaagaatagactgaactctttgggcaaaagtgaatttcagatttacaagaggtcggggatccaagaggtggatcgcaccctggcaaaagaaggaattaagcggggcgagacagaccatcacgctgttagcagagggtccgccaaactccgttggttcgtggagaggaatctggtaactcccgaaggaaaggtggtcgatttaggctgcggtagagggggatggtcttattactgtggcggtcttaagaacgttcgcgaggtgaaaggcctgaccaaagggggacctggccatgaagaaccaatccccatgtcaacatatgggtggaatctcgtccgactacagagcggagtggacgtattctttacgcctccagaaaaatgcgataccctgttgtgtgacataggcgagtccagtcccaacccgactgtggaggccggtagaacactgagggttctcaatcttgtggaaaactggctgaataacaatacccagttctgcatcaaggtcttgaacccttacatgccatctgtgattgagaaaatggaaactctgcagcggaagtacgggggagcgctcgtccgcaatcccttaagcagaaactcaacacacgagatgtattgggtgtccaacgctagtggcaatatcgttagctctgtaaacatgatttccaggatgctgatcaatcgatttaccatgcggcataagaaagcaacgtacgaacctgatgtggaccttggctcagggacccgtaacataggaattgagagcgagacaccaaatctggatatcatcggtaagagaattgagaagataaagcaagagcacgaaacttcgtggcactatgaccaggaccatccctacaaaacctgggcctatcacggctcttacgagacaaagcagactgggagtgcttccagcatggtcaacggagtggttcgcctactcaccaagccgtgggatgtgatccctatggtcacacagatggccatgaccgacactacgcccttcggccaacagagggtgtttaaagaaaaggtagatacacggacccaggagccaaaagagggtactaagaaactgatgaagattaccgcagaatggttgtggaaggagctgaggaagaagaaaacacctcgcatgtgtacgagggaagagttcgcccgaaaggtgcggtcaaatgctgcgctcggggccatctttaccgacgagaacaaatggaagtccgcaagagaagctgttgaggattctaggttctgggaacttgtcgacaaagagcgcaatctgcatttagaaggaaagtgcgagacttgtgtgtataacatgatgggcaagcgtgagaaaaagattggcgaatttgggaaagccaagggaagccgggcaatctggtacatgtggctgggtgccagattcttggagtttgaagctctcggcttcctgaatgaggatcactggtttagtagggaaaactccctaagcggggtggagggagagggccttcacaaactgggttacatactccgcgaagtctctaagaaggaagggggagccatgtatgcggacgatacagcaggctgggacacccgaatcactctggaagatttgaaaaatgaggaaatggttacaaaccatatggagggcgagcacaagaaactggccgaagctattttcaagctcacctaccagaataaagtggtacgggtgcaaagacccacaccaagggggactgtcatggacatcatttcacgcagagaccagcggggaagtggtcaggtgggcacctatgggcttaacacgttcaccaacatgggagcccaactgatcaggcagatggagggcgaaggtgtttttaaggggattcagcatttaacagcaactgaggaggtggctgtccaggattggctggcccgtgtgggacgagaacgcttgtccagaatggctataagcggcgacgattgcgtagttaagcccctcgacgatcggttcgcctctgcactgaccgcgctaaatgacatgggcaaagtgaggaaggatatccaacagtgggagccttcgcgcgggtggaacgactggacacaggtcccattttgctcacaccatttccacgaacttattatgaaagatggaagagtgctggtggtcccgtgtcggaatcaggacgagctcatcggtagggcccgaatcagccaaggcgctgggtggtccctgcgtgaaactgcctgcttgggaaagagttacgcacagatgtggtctttaatgtattttcacagacgcgatctgcggctcgctgccaacgcaatttgtagcgccgttccctcccattgggtgcctacctcaaggacgacatggagtatacacgcgagacatgagtggatgaccactgaggacatgcttacagtatggaatcgcgtgtggatccaggaaaacccatggatggaggataaaacccccgtcgaatcttgggaggaaattccttacctgggcaagcgggaggaccagtggtgcggtagcctaatcgggctgacttccagggctacctgggccaagaatattcaaacagcaatcaaccaggtgcgatcactcataggaagcgaggaatatacggactacatgccatctatgaaaagattccggagggaggaagaggaagccggcgttttgtggtga

SEQ ID NO: 14454 - RNA, 9876 nt, synthetic construct
  misc_feature 1..9876: note = derived and/or modified CDS sequence (opt3) from DENV-2__FJ898438__SS-prME
  source 1..9876: mol_type = other RNA
accgtgggagtaatcgttatgctgattccaacagccatggctttccacctcactacgagaaacggggagcctcatatgatagtgggaaggcaggaaaagggtaaaagccttctgtttaagaccgaggacggcgtaaatatgtgcacattgatggcaatcgatttaggggaactgtgtgaggacactattacctacaaatgcccacttctccggcaaaacgaaccggaggatatcgactgttggtgcaattccacatctacctgggtgacttatggaacatgttcaaccacgggcgagcaccgccgagaaaagcgtagtgtcgccctggtgccccatgttggtatggggcttgagactagaaccgaaacatggatgagctccgagggagcgtggaaacacgtgcagaggattgagacttggatcctgcggcatcctggcttcaccataatggctgccatcttggcatacacaattggcaccacgcactttcagcgcgccctcatcttcattctgctgactgctgtcgcaccatctatgacaatgagatgcatcgggatatcgaacagggattttgtggaaggagtatcaggtggcagctgggttgacattgtgctcgagcacgggagttgtgtcaccactatggccaagaataagcccacattagatttcgaactgatcaaaaccgaggctaagcagcctgccacgcttcggaaatattgcattgaagcgaagttgaccaacacaactaccgagtcccgctgtccaacacaaggagagccctctctgaatgaagaacaggacaaacgatttatctgcaagcatagcatggtggatagaggctggggtaacgggtgtggactattcggcaagggcgggatcgtgacttgcgcaatgtttacctgcaaaaagaatatggaaggaaaagtcgttcagcctgagaacttcgaatacacaattgtgataaccccacactccggtgaggagcatgccgtaggcaatgacactgggaagcacggaaaagaaatcaagattacgccgcagtcaagtatcacagaggctgaactcaccggctatggtactgtgaccatggagtgtagccccaggacagggctggattttaacgaaatggtccttctgcaaatggaggacaaagcctggttggtgcaccggcagtggttcctcgatctgcctttaccatggctgcccggcgcagacacccagggatctaattggatacagaaggagactctcgttacatttaagaaccctcatgctaaaaagcaagacgtggtcgtgcttggctcccaggaaggggccatgcacacggcgctgaccggagccactgagattcagatgtcaagcggtaatttgctattcacaggccatctgaaatgccgtctccgcatggataagctgcaacttaaagggatgagttactctatgtgtaccggaaagttcaagatcgtaaaagaaatcgcagagacacagcacggcactattgttatcagagtgcagtatgagggtgacgggtccccatgcaagattccctttgaaataaccgatctggagaaaaggcatgtcttgggccggctcatcacggtgaacccgattgtcaccgaaaaggacagccctgtgaacatcgaggctgaacccccattcggagattcgtacatcattataggcgttgagcctgggcagctgaaattaaattggtttaagaagggatcttccatcggtcaaatgttcgagacaactatgcgaggcgccaaacgcatggctattctgggggacaccgcctgggattttggatcactaggcggtgtgttcacaagtatcgggaaggcactccaccaggtatttggcgccatttacggagctgcgttcagcggcgtctcctggactatgaaaatcctgataggggtgatcattacctggatcggaatgaactctagaagcacgtcacttagtgtttccttggtgctggtcggcgtggtaacactctatctgggtgcaatggtgcaggccgacagcgggtgtgttgtctcttggaagaataaagaacttaagtgcggatcaggcatttttatcaccgataacgtgcacacttggacagagcagtacaagttccaacccgaaagtccaagcaaactggcttccgccatacagaaggcacatgaggaaggtatttgtggcatcaggtctgtgacccggttggagaatctcatgtggaaacagattactcccgagctgaaccacatcttatcggaaaatgaggtcaagctgaccataatgacaggggacatcaaaggaattatgcaggccggcaagcgcagcctaagacctcaaccaacggaactcaaatattcctggaagacctgggggaaggctaaaatgctgtcaactgagagtcataaccagacatttcttatcgatggaccggaaaccgccgagtgccccaattctaacagggcatggaatagcttggaggttgaagactacggcttcggtgtgtttacaactaacatttggctgaagctccgtgagaaacaggacgtgttctgtgattccaagctgatgtcagcggctatcaaagacaatcgggccgtacacgcagatatggggtattggatagaaagcgccttaaacgacacctggaagatggagaaggcttctttcattgaggtcaaatcctgccactggcctaagagtcatacgctgtggagcaatggagtgcttgaatctgagatgatcatccccaagaactttgccggccccgtttcccagcacaactaccgacctggttatcatacacaaaccgcaggcccatggcacttggggaagctcgaaatggatttcgacttttgtgagggaactaccgtggtcgtgacagaagattgcggcaatagagggccctcactgaggactaccacagctagtggaaaactaattacggagtggtgctgtcgcagctgcaccctgccgcctctccggtacagaggcgaggacggttgttggtacgggatggaaatcaggccactgaaggagaaggaagagaaccttgttaattcgttggtgactgccggacatggccagattgataacttctccctgggtgtattaggcatggcgctctttctggaagagatgcttcgcacacgaatagggaccaaacacgccatcctgttggtcgctgcatctttcgtgactctcattacaggaaatatgagctttcgggacctgggccgtgtgatggtcatggttggggccaccatgacggatgacatcggaatgggcgtgacttatctagctctgctcgccgcattcaaggtaagacccacctttgcggccggtctgcttttgaggaaactgacatcaaaggagttaatgatggctaccattgggatcgccctcctgagtcagtccactatacctgaaacaatccttgagctgaccgatgcactagctctcggaatgatggtgctgaaaattgtccgcaacatggaaaagtaccaattggccgtgacaatcatggcaatttcttgcgttcccaatgccgtgatcctgcagaacgcttggaaggtcagctgtactatattagcggccgtgtccgtttcaccactcctgcttaccagcagtcagcagaaagcagactggattcctctggctttgacgatcaagggcctcaatcccacagccatcttcctgaccactctatctcggacctccaaaaagagaagctggccactgaacgaggccgtgatggctgtcggcatggtatcgattcttgcatcatctctcctgaaaaatgacataccgatgacagggcctttggtggccggaggtctgttaactgtttgctatgtgctcaccggcaggagtgcggatctggaacttgagcgagctgccgacgtcaagtgggaggatcaagcagaaatctccgggagctctcccattctgagcatcacgatttccgaggacggatcaatgagtatcaaaaacgaagaggaggaacagacattgaccatactcatccgcactggcctgctagtgattagcggtgtatttccagtgtctatccccattacagccgctgcatggtacctgtgggaggtcaagaagcagcgggccggggttctttgggatgtgccttccccaccccctgtgggaaaagcggaactcgaggacggcgcttatagaatcaagcagaggggcatactggggtactcacaaattggagccggtgtctataaagaaggcaccttccacactatgtggcatgtgacacgtggggcagttttgatgcaccgcggaaagcggatcgagccgagttgggccgatgtcaaaaaggacttaatcagctacggcggtgggtggaagctggagggagaatggaaagagggcgaagaggtgcaggtcctcgctctggaaccaggcaagaatcccagagccgtgcagaccaaacctgggatttttaagacgaacactggaaccatcggtgcagtttcccttgatttctctccaggcacatcggggagccccatagtggacaggaaaggaaaggtcgtgggcctgtacggtaatggggtagtcacccgatcaggagcttatgtgtccgccattgcgcagacagagaagagtatcgaggataaccctgaaattgaggacgatatcttccggaaaaagcgcttgactataatggacctacatccgggcgccggcaaaaccaagagatacctgcccgcaattgttagggaagctatcaaacgggggctccgaacgctgatccttgccccaacaagagtggtcgctgcagagatggaagaggccttacgcggactgcctattaggtatcaaactcccgccatcaagaccgagcacacaggtcgtgaaattgtggacctcatgtgtcatgctacctttactatgcggttgctgtctccagttagagtgcctaactacaatctcataatcatggatgaggcgcacttcaccgaccccgcaagcattgccgctaggggctatatctccacacgcgtcgaaatgggggaggccgcaggaatctttatgacggccactccaccgggctcacgagatcctttcccccagtctaacgctccaattatggacgaggaaagagagatacccgaacggagctggaatagtggtcacgagtgggtgaccgattttaaggggaaaacagtatggttcgtgccttccatcaaggcgggaaacgacattgccgcatgcctgaggaaaaatggcaagaaagttatccagcttagccgcaagacctttgattctgaatacgtcaagactcgtgctaacgactgggatttcgtggtgacaaccgacatttcagagatgggcgccaattttaaagcagagagagtcatcgatccacggaggtgtatgaagcccgtaatactgacggacggggaagaacgcgtgatcttggccggacctatgccggttactcattccagtgctgcccaacgaagaggtcggattggcaggaaccccaaaaatgaaaacgaccagtatatctacatgggggagcccctagaaaatgatgaggactgcgcgcactggaaggaggcaaaaatgctgctcgataacattaatacacctgaaggaatcatacccagcatgttcgagccagaacgcgagaaggtggacgccattgatggcgaatacagattaaggggtgaggctcggaaaacctttgtcgacctgatgcgtcgcggggatcttcctgtgtggctggcctataaggttgctgcagagggcatcaactacgccgaccgaaagtggtgtttcgatggaattaaaaataaccagatcctcgaagagaacatggaagtggagatatggaccaaggagggcgaaaggaaaaagttgaaacccaggtggctggacgctcggatctattcggatccactcgccctgaaggagttcaaggaatttgcagcggggcgcaaatctcttactctaaatctgattacagagatgggaagattgcctaccttcatgacacagaaggccaggaacgctttagacaatctggccgtcctccatactgcagaagctggtggccgggcctacaaccacgcactgtccgagcttccggagacgctggaaaccctcttgctgctaacactgctcgccactgtgaccgggggaatctttcttttcctgatgagcggcaaaggtattgggaagatgacattaggcatgtgctgcatcataaccgcttcaattttgctgtggtatgcgcaaatccagccccactggatcgccgcaagtattatcctcgagtttttcctgatagtacttctgattccagaacctgagaaacagcgaactccccaggataatcaactcacgtacgtggttatcgctattttgaccgtcgtggccgccacaatggcaaacgaaatgggatttctggagaagactaagaaagacttaggcctagggtctatcaccacacaggagtccgaaagcaatatactggacatcgatctcagaccagcttcagcctggaccctttatgcggtggctactacattcgtcacgcctatgctgcgccatagtattgagaacagctccgttaatgtgtctttgaccgccatcgcaaaccaggccactgtactgatgggactcggtaagggctggcccctgagcaaaatggacattggggtgccgcttctcgctatcggatgttactcccaggtcaatccaattacactgaccgcagccttgctgctattagtggcgcactacgctatcataggccctggtctgcaagccaaggcaaccagggaagcccagaaacgggctgccgcagggattatgaagaaccccacagttgatggcatcactgtgatcgacctcgagccaattccctatgatcctaagtttgaaaaacagcttggacaggtcatgctgttgatactgtgcgtaacgcaagtgctcatgatgcgtaccacatgggctctgtgtgaggcccttactttagcgaccggcccgatctcaacactgtgggaggggaatcccggaagattctggaacaccactattgccgtttctatggcaaatatctttaggggcagttacctcgctggtgccgggttgctgttctcgattatgaagaacacgacaaatacccgccggggaactggcaacatcggtgaaaccctaggcgagaaatggaaaagccgactgaacgcactcgggaaatccgaatttcagatatataagaaatctggaatccaggaggtggacagaacacttgctaaggagggcattaagagaggggaaactgatcatcacgccgtctcacgcggaagcgccaaactgcggtggttcgtggagagaaatatggtcaccccagaaggcaaggtggttgacttgggttgcgggcgtggaggctggtcctactattgtggtggcctgaaaaacgtgagggaggtaaaggggctcacaaaaggaggccctgggcatgaggaaccaatccctatgagtacgtacggatggaatctggtgcggttacaatctggcgtcgatgttttctttaccccacccgagaagtgcgacactcttctgtgtgatattggtgaaagctcacctaacccaacaatcgaggcggggcgcaccctccgagtgctaaatctggtcgaaaactggttgaataacaatactcagttctgcataaaggtgctgaacccctatatgccgtccgtaattgagaaaatggaaacactccagagaaagtacggaggcgctcttgtgaggaatcctctgagtcggaacagcacccacgagatgtactgggtttctaatgcaacgggcaacatcgtgtcctcagtcaatatgatcagccgcatgttgattaacagatttaccatgaaacacaagaaagccacatatgagccagacgtggatctggggtcgggaactaggaacataggtatcgaatctgagattcccaatctcgacatcattggcaagcgaatcgaaaagataaaacaggagcatgaaaccagttggcactacgaccaagatcatccttataagacatgggcttaccacgggtcctatgagactaaacagaccggaagcgcctcatccatggtcaacggcgtggttcggttactgacaaagccatgggacgtagtgcccatggtcacccagatggcaatgactgatacgacaccgttcggtcagcaacgtgtgtttaaagagaaggttgacaccagaactcaggaacctaaggaggggaccaaaaagctaatgaaaatcacagccgaatggctgtggaaggagctaggcaaaaagaaaacgccccgcatgtgtaccagggaggagttcactcggaaggtgagatctaatgctgcgctcggcgccatttttacagatgagaacaagtggaaaagcgcacgcgaagctgtcgaggacggcaggttctgggaactggtggatcgagagcggaatttgcacctggaggggaagtgcgaaacctgtgtatacaacatgatgggaaaaagagagaagaaactcggtgaatttggcaaggccaaggggagtagggcaatctggtatatgtggcttggagcccgcttcctggagtttgaggctttaggcttcctgaatgaggaccattggttttcccgtggtaacagcttgtctggggtggagggagaaggcctccaccggctgggctacattctaagagatgttgggaaaaaggagggaggtgccatgtacgcggacgatactgcaggctgggacacaaggatcacccttgaagacctgaaaaatgaggaaatggtcacaaaccatatgaagggggagcacaaaaagctcgccgaggctattttcaagctgacttatcagaataaagtggtgcgcgtccagcgaccaacccctcggggaacggttatggatataatctcaagaagggaccaacgcggcagtggtcaggtggggacctacggattgaacacattcactaatatggaagcccagctgattagacaaatggagggcgaaggcatctttaagtccatccagcatctcaccgcaacagaggagattgctgtacagaactggcttgcccgggtggggagggaacgtctgagccgaatggctatatctggagatgactgcgtcgtgaaacccatcgatgaccgcttcgcctcggcattaactgcgctgaatgatatgggtaaggttagaaaagacattcagcaatgggagccatcacggggctggaacgattggacccaggtgcccttttgcagccaccacttccatgaattggtcatgaaggacgggagggtgctcgtagttccttgtcgcaaccaggatgagctgatcggcagagcacggatttcccagggagctggttggagtctaaaggaaacggcctgccttgggaaatcttatgcacaaatgtggacactgatgtactttcacaggcgagacctccgtctggctgccaatgcaatctgtagcgccgtgccatcccattgggtcccgacctcaagaactacatggagtatacacgcgaagcacgagtggatgaccactgaggatatgttggctgtgtggaaccgcgtgtggatccaggaaaatccctggatggaggacaaaacccctgtcgaatcttgggaggaagttccatatttaggaaagcgggaggaccagtggtgcggcagcctgattggcctcacatccagggccacgtgggccaaaaacatccagaccgccattaatcaagtgagatcacttatcgggaacgaggaatacactgattatatgcccagcatgaagcgcttccggagggaggaagaggaagctggagtactgtggtga

SEQ ID NO: 14455 - RNA, 9876 nt, synthetic construct
  misc_feature 1..9876: note = derived and/or modified CDS sequence (opt3) from DENV-2__GQ199893__SS-prME
  source 1..9876: mol_type = other RNA
accgccggagtgatcgtcatgctgattcccacggctatggcattccacctcactacgcggaatggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagaaggctctcatcttcattctgctgacagcagtggccccatccatgaccatgcgctgcatcgggatatctaacagagattttgtcgaaggagtgtcgggtggctcatgggttgacattgttctcgagcacgggagctgtgtgactacaatggctaagaataaacccaccttagatttcgaactgatcaagacggaggccaaacagcctgcgacccttaggaagtattgcattgaagcaaaattgacaaacactaccacagagagtcggtgtccaactcaaggagagccctccctgaatgaggaacaggacaagcgctttatctgcaagcattctatggtcgatcgaggctggggtaacgggtgtggactattcggcaaaggcgggatcgtgacctgcgccatgtttacatgcaagaaaaatatggaaggaaaggtggtccagcctgagaacctcgaatacaccattgttataactccacacagcggtgaggagcatgctgtgggcaatgacacggggaaacacggaaaggaaatcaaaattacaccgcagtcctcaatcaccgaggccgaactgactggctatggtaccgtaacaatggagtgtagtcccagaaccgggcttgatttcaacgaaatggtgctgttgcaaatggaggacaaggcatggctcgtccacaggcagtggtttctggatttacctctgccatggctccccggcgctgacactcagggaagcaattggatacagaaggagacacttgtgacgttcaaaaaccctcatgccaagaaacaagacgttgtggtcctgggctctcaggaaggggcgatgcacaccgccttgactggagcaacagagattcagatgtcctcaggtaatctactgtttaccggccatctcaagtgccggctgcgtatggataaacttcaactgaaggggatgagctacagtatgtgtacaggaaagttcaaaatcgtgaaggaaatcgctgagactcagcacggcaccattgtaatccgcgttcagtatgagggtgacgggtctccatgcaaaattcccttcgaaataacggatttggagaagagacatgtgctcggcaggctgatcaccgtcaacccgattgtgacagaaaaagactcccctgtcaacatcgaggccgaacccccatttggagatagctacatcattataggcgtggagcctgggcagttaaagctgaattggttcaagaaaggatcgtctatcggtcaaatgtttgagactaccatgcggggcgctaagcgaatggccattctaggggacacagcatgggatttcggatccctcggcggtgtttttacttcaatcgggaaagccctgcaccaggtgttcggcgctatttacggagcggcatttagtggcgtaagctggaccatgaagatccttataggggtcatcattacgtggatcggaatgaactcccgctctactagcttgtcagtgagtctggttctcgtgggcgtcgtgaccctgtatcttggtgccatggtacaggctgactccgggtgtgtggttagctggaaaaataaggaactgaagtgcggatctggcattttcatcactgataacgtccacacatggaccgagcagtacaaatttcaacccgaatcaccaagtaagttggccagcgcaatacagaaagcccatgaggaaggtatttgtggcatcagatccgtgactaggctcgagaatctgatgtggaagcagattacccccgagttaaaccacatcctgtctgaaaatgaggtgaaactaacaataatgacgggggacatcaagggaattatgcaggctggcaaacggtcgctccgccctcaaccaaccgaactgaagtatagctggaagacttgggggaaagccaagatgctttccacagagtcacataaccagaccttcttgatcgatggaccggaaacagcagagtgccccaatactaacagagcgtggaatagtctggaggtcgaagactacggctttggtgttttcaccacgaacatttggctcaaactgagggagaagcaggacgtgttttgtgattctaaattaatgagcgctgccatcaaggacaatcgtgcagtgcacgccgatatggggtattggatagaatccgctctgaacgacacatggaagatggagaaagcctcattcattgaggtaaagagctgccactggcctaaatctcataccctttggtccaatggagtcttggaaagtgagatgatcatcccaaagaacttcgcaggccccgtgagccagcacaactaccggcctggttatcatactcaaaccgctggcccatggcacctcgggaaactggaaatggattttgacctatgtgagggaacaactgttgtggtcaccgaagattgcggcaatcgagggccctctctgagaacaacgaccgcctccggaaagctcattactgagtggtgctgtaggtcatgcacactgccgcctcttcgctaccggggcgaggacggttgttggtacgggatggaaatcagaccattgaaggagaaagaagagaacctggtgaatagtttagttaccgcgggacatggccagattgataacttcagcctcggtgtgctgggcatggccctttttctggaagagatgttgaggactcgcatagggacaaagcacgctatcctcctggtagcagtctcgttcgtgaccctaattacgggaaatatgtcctttcgagacctgggccgggtgatggtcatggttggggccactatgaccgatgacatcggaatgggcgtgacatatctcgctctgcttgccgcattcaaagtacgtcccacctttgcggccggtttgctgttaagaaagctcacttctaaagagctgatgatggctacaattgggatcgcccttctgagccagtcaaccatacctgaaacaatcctagagctcactgatgcactggctttgggaatgatggtgctgaagattgtcaggaacatggaaaagtaccaattagccgtgaccatcatggcaattagttgcgttcccaatgccgtgatcctccagaacgcttggaaagtctcctgtacgatactggcggccgtgtctgttagcccacttctgttgacatcctcacagcagaaggcagactggattcctctcgctctgaccatcaaaggcctaaatcccactgccatcttcctgaccacacttagccgcacaagtaagaaacggtcttggccactcaacgaggccattatggctgtgggcatggtctccatactggcaagctcgttgctgaagaatgacatcccgatgaccgggcctttagtagccggaggtctcctgacggtgtgctatgttcttacaggcagatcagcggatctggaattggagagggctgccgacgtgaaatgggaggatcaagcagaaatttctgggagttcccccatcctcagcattaccatctctgaggacggaagcatgtccataaagaacgaagaggaggaacagactctgacaatcctaattcgaaccggcctgcttgtcatctcaggtgtgtttccagtaagtattcccatcactgccgctgcatggtacctctgggaggtgaagaaacagcgcgccggggtcctgtgggatgttcctagcccaccccctgtggaaaaggcggagttggaagacggagcttatcggataaaacagagaggcattttaggctactctcaaatcggggccggagtgtataaggagggtacattccacaccatgtggcatgtcacgaggggcgcagtgctgatgcaccgtgggaaacgcatcgagccgtcctgggccgatgttaagaaggacctcatttcatacggaggcggttggaaactggaaggggagtggaaggaaggagaggaagtacaggtgcttgctctggagccaggcaaaaatccccgggccgtccagactaagcctggcatctttaaaaccaacacagggaccataggagcagtgagtttggatttcagcccaggtacatccggctctcccattgttgacagaaaggggaaggtggtcggactatacggcaatggtgtggtaactaggtcgggggcttatgtcagcgccatcgcgcagaccgagaaatcaattgaagataaccctgagatcgaagacgatatatttcgaaagaaacggctgacgattatggacctccatccgggagccggcaagacaaaacgctacctgcccgcaatcgtgagagaggctatcaagaggggccttcggactttaattctggccccaacccgagttgtggctgcagaaatggaggaggccctcagagggttgcctatccgctatcaaacacccgccattaagaccgaacacactggaagggagatagtcgacctgatgtgtcatgctaccttcacaatgcgtctcctgtccccagtgcgggttcctaactacaatcttatcattatggatgaagcgcacttcacggaccccgcaagtatcgccgctagaggttatatctctactagggtggagatgggcgaggccgcagggatttttatgaccgccacaccaccgggaagccgcgatcctttcccccagtccaacgctccaataatggacgaagaacgagaaatccccgagagatcatggaactctggccacgaatgggtcaccgattttaaaggtaagactgtgtggttcgtacctagcattaaagcggggaacgacatcgccgcatgcctgcggaagaatggcaagaaggtgattcagttgagtaggaagacatttgattccgagtacgttaaaacccgcgctaacgactgggatttcgtcgtgacgactgacatcagcgagatgggcgccaattttaaggcagaacgtgtgatagatccaagacggtgtatgaaacccgtcatcctaacagacggcgaggaaagggtaattctggccgggcctatgccggtgacccattcttcagctgcccaacgccgaggaagaatcggtcggaacccaaagaatgagaacgaccagtatatttacatgggcgaacccctcgagaatgatgaggactgcgcgcactggaaagaagcaaagatgttactggataacatcaatacccctgaggggataattccctccatgttcgaaccagagagggaaaaagttgacgccatcgatggagagtaccgccttagaggcgaggctaggaagacttttgtggacctgatgcggcgtggtgatctccctgtctggttggcctataaggtggctgcagaagggattaactacgccgaccgcaaatggtgtttcgatggcatcaagaataaccagatactggaggaaaacatcgaggttgagatttggacaaaagaaggagagcgaaagaaactcaagcccagatggctggacgctaggatctatagtgatccacttgccctaaaggaatttaaagagttcgcagcgggcagaaagagcctgaccttgaatttaattacagaaatggggcgcctgcctactttcatgacgcagaaagccagaaacgctctcgacaatctggccgtgcttcataccgcagaggctggaggtagggcctacaaccacgcactgtcggagctcccggaaacattggagactctgctactgctcacccttctggccacagtcaccggcgggatctttttattcttgatgtctggaaagggcataggtaaaatgactctggggatgtgctgcattatcacggcttccatcctcctgtggtatgcgcaaattcagccccactggatcgccgcaagcataattcttgaatttttcctgatcgtgctcttgattccagagcctgaaaagcagcggacaccccaggataatcaactgacatacgtagtgatcgctatattaactgttgtcgccgccaccatggcaaacgagatgggctttctagagaagaccaaaaaggacctgggactcggctcaatcaccactcaggaaagtgagtctaatattcttgacatcgatctgcgaccagcttccgcctggacattgtatgcggtggctacgaccttcgtgactcctatgctgagacatagcattgaaaactcaagtgtcaatgttagcctcacagccatcgcaaaccaggccaccgtgctgatggggcttggaaaaggttggcccctctccaagatggacattggcgtaccgctgttggctatcgggtgttactctcaggtgaatccaataaccctgacagcagccttactactgctcgtcgcgcactacgctattatcggacctggccttcaagccaaagcaactcgcgaggcccagaagagggctgccgcaggtatcatgaagaaccccacggtggatgggattaccgttatagacctggaaccaatcccctatgatcctaaatttgagaagcagttgggccaggtgatgctgctcattctgtgcgtcacacaagtacttatgatgcggactacctgggctttatgtgaggccctgacactcgcgaccggaccgatcagcactttgtgggaaggcaatcccgggcgtttctggaacacgacaattgccgtgtccatggcaaatatctttagaggatcatacctggctggcgccggtctactgttctctataatgaaaaacaccactaataccaggcgcgggacaggaaacatcggcgagactctcggtgaaaagtggaaaagtcggcttaacgcactgggcaagtcggagtttcaggtttataaaaagagcgggattcaggaggtggaccgaaccttggctaaggaaggaatcaaaagaggcgagacagatcatcacgccgtctccagggggtctgccaagctgcgctggttcgtggaacggaatatggtcacgccagagggaaaagtggttgacctcggctgcggtagagggggatggtcatactattgtggcggtctgaagaacgtgcgtgaagtaaaaggcttaaccaaagggggacctggccatgaggagcccattcctatgagcacttacgggtggaatcttgtgaggctgcaatccggagtcgatgtatttttcacaccacccgaaaagtgcgacaccctcctatgtgatatcggcgagagttctcctaacccaactatagaagcgggtcggacactgcgcgtgttgaatctggtcgagaactggctcaataacaatacccagttctgcattaaagtgcttaacccctatatgccgagcgtaatcgaaaagatggaggctctgcagcgaaaatacgggggagcattggtgagaaatcctctgtcaaggaactccacgcacgagatgtactgggttagtaatgccaccggcaacatcgtgagctctgtcaatatgatttcccggatgctcataaaccgctttacaatgaagcacaaaaaggctacttatgaaccagacgtggatttaggctcagggaccagaaacatcggaattgagagcgaaatccccaatctggacattatcggtaagaggatagagaaaatcaagcaggaacatgagacatcgtggcactacgaccaagatcatccttataaaacttgggcctaccacggctcttatgagaccaagcagacagggagtgcatccagcatggtcaacggagtggttcgacttctgaccaaaccatgggacgtagtgcccatggtcactcagatggccatgacggatacaaccccgttcggccagcaacgggtgtttaaggaaaaggttgacactcgtacccaggagcctaaagaaggtacaaagaaactaatgaagattacggctgagtggctctggaaagagctggggaagaaaaagacccccagaatgtgtactcgcgaagagttcacaaggaaggtgcggtcaaatgcggccttgggagcaatctttaccgatgaaaacaaatggaagtccgctagagaggccgtcgaagacggccgcttctgggagctggtggatagggagcgaaatctccaccttgaaggcaaatgcgagacttgtgtatacaacatgatggggaagcgggagaaaaagctgggagagtttggtaaggcaaaaggctctagagccatttggtatatgtggttaggggctaggttcctggaatttgaggccttgggattcctcaatgaggaccattggtttagccgcggcaacagtctgtccggtgtggaaggggagggactacaccgtcttggctacatcctgcgggatgttggcaagaaagaagggggagcgatgtacgcagacgatacagccggttgggacaccagaattacactcgaggacctgaagaatgaagagatggtcactaaccatatgaaaggcgagcacaagaagttggctgaagccatattcaaactgacctatcagaataaggtggtgagggtccagcgcccaacgcctcgagggaccgttatggatatcattagccggagagaccaaaggggatctggccaggtgggtacatacgggctcaacacttttaccaatatggaggcacagcttatccgccaaatggaaggagagggcatcttcaaatcaattcagcatctgacagctactgaggaaatagccgtacagaactggttagctagagtgggccgggagaggctgagtcgtatggccatctccggggatgactgcgtcgtgaagcccattgatgaccgattcgcaagcgcgttgaccgccctcaatgatatgggaaaagttcgcaaggacatccagcaatgggaaccatctagaggttggaacgattggacacaggtgcccttttgctcgcaccacttccatgagctggtcatgaaggacggccgggtgctagtagttccttgtaggaaccaggatgaacttattgggcgcgctagaatctcacagggagccggctggagcctgaaagagacagcatgcctcggtaagtcctatgctcaaatgtggaccctgatgtactttcaccggagggacttgcgattagccgcaaatgccatatgtagtgcggtgccaccgcattgggtccccacttctcgtacaacctggagcatccacgctaaacacgagtggatgactaccgaagatatgctggccgtgtggaacagagtgtggattcaggagaatccttggatggaagacaagacaccagtcgagtcctgggaagaggttccctatctcgggaaacgcgaggaccagtggtgcggatcacttatcggcctgacgagtcgggcaacctgggccaagaacattcagactgctatcaatcaagtgaggtctctaataggcaacgaagagtacacagattatatgcctagcatgaagagattccgccgggaagaggaagaggccggggtactgtggtga

SEQ ID NO: 14456 - RNA, 9876 nt, synthetic construct
  misc_feature 1..9876: note = derived and/or modified CDS sequence (opt3) from DENV-2__GQ199894__SS-prME
  source 1..9876: mol_type = other RNA
accgccggagtgatcgtcatgctgattcccacagctatggcattccacctcactacgaggaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagacccggacagaaacttggatgagtagcgagggagcttggaaacacgttcagaggattgagacctggatcctgcggcatcctggcttcacaataatggccgcaatcttggcctacaccattggcacgactcactttcagaaggctctcatcttcattctgctgacagcagtggccccatccatgaccatgcgctgcatcgggatatctaacagagattttgtcgaaggagtgtcgggtggctcatgggtagacattgttctcgagcacgggagctgtgtgactacaatggctaagaataaacccaccttagatttcgaactgatcaagacggaggccaaacagcctgcgacccttaggaagtattgcattgaagcaaaattgacaaacactaccacagagagtcggtgtccaactcaaggagagccctccctgaatgaggaacaggacaagcgctttatctgcaagcattctatggtcgatcgaggctggggtaacgggtgtggactattcggcaaaggcgggatcgtgacctgcgccatgtttacatgcaagaaaaatatggaaggaaaggtggtccagcctgagaacctcgaatacaccattgttataactccacacagcggtgaggagcatgctgtgggcaatgacacggggaaacacggaaaggaaatcaaaattacaccgcagtcctcaatcaccgaggccgaactgactggctatggtaccgtaacaatggagtgtagtcccagaaccgggcttgatttcaacgaaatggtgctgttgcaaatggaggacaaggcatggctcgtccacaggcagtggtttctggatttacctctgccatggctccccggcgctgacactcagggaagcaattggatacagaaggagacacttgtgacgttcaaaaaccctcatgccaagaaacaagacgttgtggtcctgggctctcaggaaggggcgatgcacaccgccttgactggagcaacagagattcagatgtcctcaggtaatctactgtttaccggccatctcaagtgccggctgcgtatggataaacttcaactgaaggggatgagctacagtatgtgtacaggaaagttcaaaatcgtgaaggaaatcgctgagactcagcacggcaccattgtaatccgcgttcagtatgagggtgacgggtctccatgcaaaattcccttcgaaataacggatttggagaagagacatgtgctcggcaggctgatcaccgtcaacccgattgtgacagaaaaagactcccctgtcaacatcgaggccgaacccccatttggagatagctacatcattataggcgtggagcctgggcagttaaagctgaattggttcaagaaaggatcgtctatcggtcaaatgtttgagactaccatgcggggcgctaagcgaatggccattctaggggacacagcatgggatttcggatccctcggcggtgtttttacttcaatcgggaaagccctgcaccaggtgttcggcgctatttacggagcggcatttagtggcgtaagctggaccatgaagatccttataggggtcatcattacgtggatcggaatgaactcccgctctactagcttgtcagtgagtctggttctcgtgggcgtcgtgaccctgtatcttggtgccatggtacaggctgactccgggtgtgtggttagctggaaaaataaggaactgaagtgcggatctggcattttcatcactgataacgtccacacatggaccgagcagtacaaatttcaacccgaatcaccaagtaagttggccagcgcaatacagaaagcccatgaggaaggtatttgtggcatcagatccgtgactaggctcgagaatctgatgtggaagcagattacccccgagttaaaccacatcctgtctgaaaatgaggtgaaactaacaataatgacgggggacatcaagggaattatgcaggctggcaaacggtcgctccgccctcaaccaaccgaactgaagtatagctggaagacttgggggaaagccaagatgctttccacagagtcacataaccagaccttcttgatcgatggaccggaaacagcagagtgccccaatactaacagagcgtggaatagtctggaggtcgaagactacggctttggtgttttcaccacgaacatttggctcaaactgagggagaagcaggacgtgttttgtgattctaaattaatgagcgctgccatcaaggacaatcgtgcagtgcacgccgatatggggtattggatagaatccgctctgaacgacacatggaagatggagaaagcctcattcattgaggtaaagagctgccactggcctaaatctcataccctttggtccaatggagtcttggaaagtgagatgatcatcccaaagcacttcgcaggccccgtgagccagcataactaccggcctggttatcacactcaaaccgctggcccatggcatctcgggaaactggaaatggattttgacctatgtgagggaacaactgttgtggtcaccgaagattgcggcaaccgagggccctctctgagaacaacgaccgcctccggaaagctcattactgagtggtgctgtaggtcatgcacactgccgcctcttcgctaccggggcgaggacggttgttggtacgggatggaaatcagaccattgaaggagaaagaagagaatctggtgaacagtttagttaccgcgggacacggccagattgataatttcagcctcggtgtgctgggcatggccctttttctggaagagatgttgaggactcgcatagggacaaagcacgctatcctcctggtagcagcctcgttcgtcaccctaattacgggaaacatgtcctttcgagacctgggccgggtgatggtgatggtcggggctactatgaccgatgacatcggaatgggcgttacatatctcgccctgcttgcagcgttcaaagtgcgtcccacctttgccgctggtttgctgttaagaaagctcacttctaaagagctgatgatggccacaattgggatcgcacttctgagccagtcaaccatacctgaaacaatcctagagctcactgatgctctggccttgggaatgatggtactgaagattgtgaggaatatggaaaagtaccaattagcagtcaccatcatggccattagttgcgtgcccaacgctgttatcctccagaatgcgtggaaagtgtcctgtacgatactggccgcagtctctgtgagcccacttctgttgacatcctcacagcagaaggctgactggattcctctcgccctgaccatcaaaggcctaaaccccactgccatcttcctgaccacacttagccgcacaagtaagaaacggtcttggccactcaatgaggctattatggcagttggcatggtgtccatactggccagctcgttgctgaagaacgacatcccgatgaccgggcctttagtcgcgggaggtctcctgacggtatgctatgtgcttacaggcagatcagctgatctggaattggagagggccgcagacgttaaatgggaggatcaagccgaaatttctgggagttcccccatcctcagcattaccatctctgaggacggaagcatgtccataaagaatgaagaggaggaacagactctgacaatcctaattcgaaccggcctgcttgtgatctcaggtgtctttccagtgagtattcccatcactgctgcagcctggtacctctgggaggtaaagaaacagcgcgcgggggtgctgtgggatgtccctagcccaccccctgttgaaaaggctgagttggaagacggagcctatcggataaaacagagaggcattttaggctactctcaaatcggggcaggagtgtataaggagggtacattccataccatgtggcacgtgacgaggggcgccgtcctgatgcatcgtgggaaacgcatcgagccgtcctgggctgatgtgaagaaggacctcatttcatacggaggcggttggaaactggaaggggagtggaaggaaggagaggaagttcaggtacttgccctggagccaggcaaaaacccccgggcagtgcagactaagcctggcatctttaaaaccaatacagggaccataggagctgtcagtttggatttcagcccaggtacatccggctctcccattgtggacagaaaggggaaggttgtgggactatacggcaacggtgtcgtgactaggtcgggggcctatgtaagcgcgatcgcccagaccgagaaatcaattgaagataatcctgagatcgaagacgatatatttcgaaagaaacggctgacgattatggacctccacccgggagcaggcaagacaaaacgctacctgcccgctatcgtcagagaggccatcaagaggggccttcggactttaattctggctccaacccgagtggttgcagccgaaatggaggaggccctcagagggttgcctatccgctatcaaacacccgctattaagaccgaacatactggaagggagatagtggacctgatgtgtcacgcgaccttcacaatgcgtctcctgtccccagtccgggtgcctaactacaaccttatcattatggatgaagcacacttcacggaccccgccagtatcgctgccagaggttatatctctactagggttgagatgggcgaggcagccgggatttttatgaccgctacaccaccgggaagccgcgatcctttcccccagtccaatgcgccaataatggacgaagaacgagaaatccccgagagatcatggaactctggccatgaatgggtgaccgattttaaaggtaagactgtctggttcgtgcctagcattaaagccgggaatgacatcgcagcttgcctgcggaagaacggcaagaaggtaattcagttgagtaggaagacatttgattccgagtacgtgaaaacccgcgccaatgactgggatttcgttgtcacgactgacatcagcgagatgggcgcaaactttaaggccgaacgtgtgatagatccaagacggtgtatgaaacccgtgatcctaacagacggcgaggaaagggtcattctggctgggcctatgccggtaacccactcttcagccgcgcaacgccgaggaagaatcggtcggaatccaaagaacgagaatgaccagtatatttacatgggcgaacccctcgagaacgatgaggactgcgcacattggaaagaagccaagatgttactggataatatcaacacccctgaggggataattccctccatgttcgaaccagagagggaaaaagtggacgctatcgatggagagtaccgccttagaggcgaggccaggaagacttttgttgacctgatgcggcgtggtgatctccctgtgtggttggcttataaggtcgcagccgaagggattaattacgctgaccgcaaatggtgtttcgatggcatcaagaacaatcagatactggaggaaaacatcgaggtggagatttggacaaaagaaggagagcgaaagaaactcaagcccagatggctggacgccaggatctatagtgatccacttgcactaaaggaatttaaagagttcgcggccggcagaaagagcctgaccttgaacttaattacagaaatggggcgcctgcctactttcatgacgcagaaagctagaaatgccctcgacaacctggcagttcttcacaccgctgaggccggaggtagggcatacaatcacgccctgtcggagctcccggaaacattggagactctgctactgctcacccttctggctacagtgaccggcgggatctttttattcttgatgtctggaaagggcataggtaaaatgactctggggatgtgctgcattatcacggcgtccatcctcctgtggtatgcccaaattcagccccattggatcgcagctagcataattcttgaatttttcctgatcgtcctcttgattccagagcctgaaaagcagcggacaccccaggataaccaactgacatacgtggtaatcgccatattaactgtggttgccgcaaccatggctaatgagatgggctttctagagaagaccaaaaaggacctgggactcggctcaatcaccactcaggaaagtgagtctaacattcttgacatcgatctgcgaccagcctccgcgtggacattgtatgctgtcgccacgaccttcgtgactcctatgctgagacacagcattgaaaattcaagtgtgaacgtcagcctcacagcaatcgccaatcaggctaccgttctgatggggcttggaaaaggttggcccctctccaagatggacattggcgtgccgctgttggcaatcgggtgttactctcaggtaaacccaataaccctgacagccgcgttactactgctcgtggctcattacgccattatcggacctggccttcaagcaaaagccactcgcgaggctcagaagagggccgcagctggtatcatgaagaatcccacggtcgatgggattaccgtgatagacctggaaccaatcccctatgatcctaaatttgagaagcagttgggccaggttatgctgctcattctgtgcgtgacacaagtccttatgatgcggactacctgggccttatgtgaggcgctgacactcgccaccggaccgatcagcactttgtgggaaggcaaccccgggcgtttctggaatacgacaattgcagtatccatggctaacatctttagaggatcatacctggccggcgcaggtctactgttctctataatgaaaaataccactaacaccaggcgcgggacaggaaatatcggcgagactctcggtgaaaagtggaaaagtcggcttaacgctctgggcaagtcggagtttcaggtgtataaaaagagcgggattcaggaggttgaccgaaccttggccaaggaaggaatcaaaagaggcgagacagatcaccatgccgtgtccagggggtctgcgaagctgcgctggttcgtcgaacggaacatggtgacgccagagggaaaagtcgtggacctcggctgcggtagagggggatggtcatactattgtggcggtctgaagaatgttcgtgaagtgaaaggcttaaccaaagggggacctggccacgaggagcccattcctatgagcacttacgggtggaaccttgtaaggctgcaatccggagtggatgtctttttcacaccacccgaaaagtgcgacaccctcctatgtgatatcggcgagagttctcctaatccaactatagaagctggtcggacactgcgcgttttgaacctggtggagaattggctcaacaataacacccagttctgcattaaagtccttaatccctatatgccgagcgtgatcgaaaagatggaggcactgcagcgaaaatacgggggagccttggtaagaaaccctctgtcaagaaattccacgcacgagatgtactgggtgagtaacgctaccggcaatatcgttagctctgtgaacatgatttcccggatgctcataaatcgctttacaatgaagcataaaaaggccacttatgaaccagacgtcgatttaggctcagggaccagaaacatcggaattgagagcgaaatccccaacctggacattatcggtaagaggatagagaaaatcaagcaggaacacgagacatcgtggcattacgaccaagatcacccttataaaacttgggcataccacggctcttatgagaccaagcagacagggagtgcctccagcatggtgaatggagtcgtgcgacttctgaccaaaccatgggacgttgtacccatggtgactcagatggctatgacggatacaaccccgttcggccagcaacgggtctttaaggaaaaggtggacactcgtacccaggagcctaaagaaggtacaaagaaactaatgaagattacggcggagtggctctggaaagagctggggaagaaaaagacccccagaatgtgtactcgcgaagagttcacaaggaaggttcggtcaaacgccgcattgggagctatctttaccgatgaaaataaatggaagtccgccagagaggcagtggaagacggccgcttctgggagctggtcgatagggagcgaaacctccatcttgaaggcaaatgcgagacttgtgtgtacaatatgatggggaagcgggagaaaaagctgggagagtttggtaaggccaaaggctctagagctatttggtatatgtggttaggggccaggttcctggaatttgaggcgttgggattcctcaacgaggaccactggtttagccgcggcaatagtctgtccggtgtagaaggggagggactacatcgtcttggctacatcctgcgggatgtgggcaagaaagaagggggagcaatgtacgccgacgatacagctggttgggacaccagaattacactcgaggacctgaagaacgaagagatggttactaatcacatgaaaggcgagcataagaagttggccgaagcaatattcaaactgacctatcagaacaaggtcgtgagggtgcagcgcccaacgcctcgagggaccgtcatggatatcattagccggagagaccaaaggggatctggccaggttggtacatacgggctcaatacttttaccaacatggaggctcagcttatccgccaaatggaaggagagggcatcttcaaatcaattcagcacctgacagccactgaggaaatagctgtgcagaattggttagccagagtaggccgggagaggctgagtcgtatggcaatctccggggatgactgcgtggtcaagcccattgatgaccgattcgcgagcgccttgaccgctctcaacgatatgggaaaagtgcgcaaggacatccagcaatgggaaccatctagaggttggaatgattggacgcaggttcccttttgctcgcaccatttccacgagctggtgatgaaggacggccgggtcctagtggtaccttgtaggaaccaggatgaacttattgggcgcgccagaatctcacagggagcaggctggagcctgaaagagacagcttgcctcggtaagtcctatgcccaaatgtggaccctgatgtactttcatcggagggacttgcgattagcagccaacgcgatatgtagtgctgttccaccgcactgggtgcccacttctcgtacaacctggagcatccacgccaaacatgagtggatgactaccgaagatatgctggcagtctggaatagagtgtggattcaggagaacccttggatggaagacaagacaccagtggagtcctgggaagaggtcccctatctcgggaaacgcgaggaccagtggtgcggatcacttatcggcctgacgagtcgggccacctgggctaagaatattcagactgccatcaaccaagttaggtctctaataggcaatgaagagtacacagattatatgcctagcatgaagagattccgccgggaagaggaagaggcaggggtgctgtggtga

SEQ ID NO: 14457 - RNA, 9876 nt, synthetic construct
  misc_feature 1..9876: note = derived and/or modified CDS sequence (opt3) from DENV-2__FJ898439__SS-prME
  source 1..9876: mol_type = other RNA
accgccggcgtgatcgtaatgctgattcccacagctatggcattccacctcactacgagaaacggggaacctcatatgatagttggaagacaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgttcaaccacgggcgagcaccgccgagaaaagcgtagtgtggcgctggtcccccatgtgggtatggggcttgagactagaaccgaaacatggatgagctccgagggagcttggaaacacgttcagaggattgagacttggatcctgcggcatcctggcttcaccattatggccgcaatcttggcctacacaattggcaccacgcactttcagcgcgctctcatcttcattctgctgactgcagtggccccatctatgacaatgagatgcatcgggatatcgaacagggattttgtcgaaggagtgtcaggtggcagctgggtagacattgttctcgagcacgggagttgtgtgaccactatggctaagaataagcccacattagatttcgaactgatcaaaaccgaggccaagcagcctgcgacgcttcggaaatattgcattgaagcaaagttgaccaacacaactaccgagtcccgctgtccaacacaaggagagccctctctgaatgaagaacaggacaaacgatttatctgcaagcatagcatggtcgatagaggctggggtaacgggtgtggactattcggcaagggcgggatcgtgacttgcgccatgtttacctgcaaaaagaatatggaaggaaaagtggtccagcctgagaacctcgaatacacaattgttataaccccacactccggtgaggagcatgctgtgggcaatgacactgggaagcacggaaaagaaatcaagattacgccgcagtcaagtatcacagaggccgaactgaccggctatggtactgtaaccatggagtgtagccccaggacagggcttgatttcaacgaaatggtgctgttgcaaatggaggacaaagcatggctcgtccaccggcagtggtttctggatttacctctgccatggctccccggcgctgacacccagggatctaattggatacagaaggagactcttgtgacattcaagaaccctcatgccaaaaagcaagacgttgtggtcctgggctcccaggaaggggcgatgcacacggccttgaccggagcaactgagattcagatgtcaagcggtaatctactgtttacaggccatctcaaatgccgtctgcgcatggataaacttcaactgaaagggatgagttactctatgtgtaccggaaagttcaagatcgtgaaagaaatcgctgagacacagcacggcactattgtaatcagagttcagtatgagggtgacgggtccccatgcaagattcccttcgaaataaccgatttggagaaaaggcatgtgctcggccggctgatcacggtcaacccgattgtgaccggaaaggacagccctgtcaacatcgaagccgagcccccatttggcgattcgtacatcattataggggtggaacctggacagttaaaactgaattggttcaagaagggttcttccatcggccaaatgtttgagacaactatgcgaggggctaaacgcatggccattctaggagacaccgcatgggatttcggctcactcggtggggtttttacaagtatcggcaaggccctgcaccaggtgttcggagctatttacggcgcggcatttagcggggtatcctggactatgaaaatccttataggagtcatcattacctggatcggcatgaactctagaagcacgtcattgagtgtgtccctggttctcgtgggtgtcgtgacactgtatcttggggccatggtacaggctgacagcggatgtgtggtttcttggaagaataaagagctgaagtgcggctcaggtattttcatcaccgataacgtccacacttggacagaacagtacaagtttcaacccgagagtccaagcaaattggcctccgcaatacagaaggcccatgaagagggcatttgtgggatcaggtctgtgacccggctcgaaaatctgatgtggaaacagattactcccgagttaaaccacatcctgtcggagaatgaagtgaagctaaccataatgacaggagacatcaaaggcattatgcaggctgggaagcgcagcctcagacctcaaccaacggagctgaaatattcctggaagacctggggaaaggccaaaatgctttcaactgaaagtcataaccagacattcttgatcgatggcccggagaccgcagaatgccccaatacaaacagggcgtggaactctctggaggtcgaggactacggttttggggttttcactaccaacatttggctcaagctgcgtgaaaaacaggacgtgttttgtgatagcaagttaatgtccgctgccatcaaagacaatcgggcagtgcacgccgatatgggatattggatagagtcagctctgaacgacacgtggaagatggaaaaggccagcttcattgaggtaaaatcttgccactggcctaagtcccatacactttggagtaatggcgtcttggagagcgaaatgatcatccccaagaatttcgcaggtcccgtgtctcagcacaactaccgacctggctatcatacccaaactgctgggccatggcacctcggaaagctggagatggattttgacctatgtgaaggcaccacagttgtggtcactgaggattgcgggaatagaggaccctccctgaggaccacaacggcctcaggcaaactcattaccgaatggtgctgtcgcagttgcactctgccgcctcttcggtacagaggtgaggacgggtgttggtacggaatggagatcaggccattgaaggaaaaggaggaaaacctggtgaatagcttagttacagcgggccatggtcaggtggataacttctcgctcggcgtactggggatggccctttttctggaggaaatgttgcgcacccgaattggaactaaacacgctatactcctggtcgcagcctccttcgtgacactaatcaccggcaatatgtcttttcgggacctggggcgtgtgatggtcatggttggagctacgatgactgatgacattggcatgggtgtgacctatctcgccctgcttgcagcgttcaaggtaagacccacatttgccgctgggttgctgttaaggaaactcaccagcaaggagctgatgatggccactatcggaattgcacttctgtcacagagtacaatccctgagaccatactagaactcacagatgctctggccttgggcatgatggtgctgaaaatcgtccgcaacatggagaagtaccaattagcagtgactattatggccatctcctgcgttcccaatgctgtgattctccagaacgcgtggaaggtctcttgtaccatcctggccgcagtgagcgtttccccacttctgttgacgtcaagccagcagaaagctgactggatacctctcgccctgacaattaagggcctaaatcccaccgccatcttcctgactacccttagtcggacatctaaaaagagatcctggccactcaacgaagctgtgatggcagtcgggatggtaagcatcctggcctcgtcattgctgaaaaatgacattccgatgactggacctttagtggcgggtggcctcctgaccgtttgctatgtgcttacggggaggtctgctgatctggagttggaacgagccgcagacgtcaagtgggaggatcaagccgagataagtggatccagccccatcctctctattacaatcagcgaagacggctccatgtcaattaaaaacgaggaagaggagcagaccctgactatcctaatacgcacaggtctgcttgtgatcagtggggtatttccagtgagcattcccatcaccgctgcagcctggtacctctgggaagtcaagaagcagcgggcgggagttctgtgggatgtgccttctccaccccctgtggagaaagctgaattggaggacggcgcctatagaattaagcagaggggcatcttagggtactcccaaataggagccggtgtctataaagaaggcactttccacacaatgtggcatgtgacccgtggggcagttctgatgcaccgcggaaagcggattgagccgtcatgggctgatgtcaaaaaggacctcatcagttacggcggtgggtggaagctggagggagaatggaaagagggcgaagaggtgcaggtccttgccctggaaccaggcaagaatcccagagcagtgcagacgaaacctgggatctttaagactaacaccggaacaattggtgctgttagcttggatttctccccaggcacctctgggtcgcccatcgtggacaggaaaggaaaggtcgtgggcctatacggtaatggggtagtcacacgaagcggagcctatgtgtcagcgatagcccagactgagaagtccattgaggataaccctgaaatcgaggacgatatttttcggaaaaagcgcctgaccatcatggacctccatccgggcgcaggcaaaacgaagagatacctgcccgctatagttagggaagccattaaacgggggcttcgaacattaatcctggctccaactagagtggtcgcagccgagatggaagaggccctccgcggattgcctatcaggtatcaaacccccgctattaagacagagcacaccggtcgtgaaatcgtggacctgatgtgtcatgcgactttcaccatgcggctcctgagtccagttagagtgcctaactacaatcttattataatggatgaggcacacttcacagaccccgcctctatcgctgccaggggctatattagcacgcgcgtcgaaatgggggaggcagccggaatctttatgactgctaccccaccgggctcccgagatcctttcccccagtcaaacgcgccaatcatggacgaggaaagagagattcccgaacggtcttggaatagcggtcacgagtgggtgacagattttaaggggaaaaccgtatggttcgtgcctagtataaaggccggaaacgacatcgcagcttgcctgaggaaaaatggcaagaaagttattcagttgtcccgcaagacttttgatagcgaatacgtcaagacacgtgccaacgactgggatttcgtggtgaccacggacatctctgagatgggcgcaaattttaaagccgagagagtcattgatccacggaggtgtatgaagcccgtaatcctaactgacggggaagaacgcgtgatactggctggacctatgccggttacacattcatccgccgcgcaacgaagaggtcggatcggcaggaaccccaaaaatgaaaacgaccagtatatttacatgggggagcccctcgaaaatgatgaggactgcgcacactggaaggaggccaaaatgttactggataacatcaatacccctgaaggaattatccccagtatgttcgagccagaacgcgagaaggtggacgctatagatggcgaatacagacttaggggtgaggcccggaaaacctttgtcgacctgatgcgtcgcggggatctccctgtgtggttggcttataaggttgcagccgagggcattaactacgctgaccgaaagtggtgtttcgatggaatcaaaaataaccagattctggaagagaacatggaagtggagatctggactaaggagggcgaaaggaaaaagctcaaacccaggtggctggacgcccggatatatagcgatccacttgcactaaaggagtttaaggagttcgcggccgggcgcaaatcgctgacattgaatttaatcaccgagatgggaagactgcctacattcatgactcagaaggctaggaacgccctcgacaatctggcagtccttcatacggctgaaaccggtggcaaagcctacaaccacgcactgtctgagctcccggagacattggaaactctgctactgctcacccttctggccacagtgaccgggggaatatttttattcttgatgtccggcaagggtatcgggaaaatgactctgggcatgtgctgcattatcacggctagcatactcctgtggtatgcgcaaattcagccccactggatcgccgcatcaatcattcttgagtttttcctgatcgtactcttgataccagaacctgagaagcagcggacaccacaggataatcaactgacatacgtggttattgctatcttaactgtcgtggccgccaccatggcaaacgaaatgggatttctagagaagaccaaaaaggacctgggcttcgggagtattaccactcaggagtctgaatccaatatcctcgacatagatcttcgaccagctagcgcctggacactgtatgcggtggctacgacctttgtcactcctatgttgagacattcaatcgagaacagtagcgttaatgtgtccctgacagccattgcaaaccaggccaccgtactcatgggactgggtaaaggctggcccctttctaagatggacatcggggtgccgctcctggctattggatgttacagccaggtcaatccaatcaccttgacagcagccctgttactactggtggcgcactacgctattgttggccctggtctccaagccaaagcaactcgcgaagcccagaagagggctgccgcagggatcatgaagaaccccacggtggatggcataaccgtcattgaccttgagccaatcccctatgatcctaaattcgaaaagcagctgggacaggtaatgttgctgatcctctgcgtgacacaagttctgatgatgcggactacctgggctctttgtgaggccttaacactggcgaccggcccgatttccactctctgggaggggaatcccggacgtttttggaacacgacaatagccgtgtcaatggcaaatatcttcagaggctcttacttggctggtgccgggctgctatttagtattatgaaaaacaccactaataccaggcgcggaacaggcaacatcggtgaaactctgggcgagaagtggaaatcgcggctcaacgcacttggaaagagcgagttccagatttataaaaagtccggaatccaggaggtcgaccgaaccctggctaaggagggcataaaaagaggggaaacagatcatcacgccgtgtctaggggatcagccaagttgcgctggtttgtcgagcggaatatggtgacgccagaaggcaaagttgtggacctgggttgcgggagaggaggctggagctactattgtggtggcctcaagaacgtacgtgaggtgaaagggctgaccaagggaggccctgggcatgaagaaccaatccctatgtccacttacggatggaatttagtcaggcttcaaagtggcgttgatgtgttcttcacaccacccgagaagtgcgacaccctgctctgtgatattggtgaatctagccctaacccaactatcgaggcggggcggacactacgcgtcctgaatttggtggaaaactggctgaataacaatacccagttttgcattaaagtactcaacccctatatgccgtcagtgatcgagaagatggaaacgcttcagcgaaaatacggaggcgctctggttagaaatcctttgtccaggaacagtacccacgagatgtactgggtgagcaatgcaacaggcaacatagtctcttccgtgaatatgatttcacggatgctgatcaaccgcttcactatgaagcacaaaaaggccacctatgagccagacgtcgatctcgggagcggaacaagaaacatcggtattgaatcggagatacccaatttagacatcattggcaagaggatcgagaaaattaagcaggagcatgaaacttcttggcactacgaccaagatcatccttataaaacctgggcttaccacgggagttatgagacaaagcagaccggatccgccagctcaatggtgaacggcgttgtacgactgcttactaaaccatgggacgtggtccccatggtgacgcagatggcaatgacagataccactccgtttggtcagcaacgggttttcaaggagaaggtggacacccgtacacaggaacctaaagaggggacgaagaaactgatgaagatcaccgccgaatggctatggaaagagctcggaaagagaaaaactccccgcatgtgtacaagggaggaatttacccggaaggtcagatccaatgctgcgctgggcgccatattcactgatgagaacaagtggaaatctgcacgcgaagctgtggaggacggcaggttttgggaattggtagatcgagagcggaatctgcacctcgaggggaagtgcgaaacatgtgtgtacaacatgatgggaaaaagagagaagaaacttggtgagttcggcaaggccaaggggagcagggcaatctggtatatgtggctgggagcccgctttttagagttcgaagctctgggctttttgaatgaggaccattggttcagtcgtggtaactccctcagcggggttgagggagaaggcctgcaccggctaggctacattcttagagatgtcgggaaaaaggagggaggtgccatgtacgcggacgataccgcaggctgggacacaaggatcactctggaagacctcaaaaatgaggaaatggtgaccaaccatatgaagggggagcacaaaaagctggccgaggctatttttaagttgacgtatcagaataaagtggtccgcgttcagcgaccaacccctcggggaacagtgatggatatcatttctagaagggaccaacgcggctcaggtcaggtagggacttacggactgaacaccttcacaaatatggaagcccagctcataagacaaatggagggcgaaggcatcttcaagagtattcagcatcttactgcaaccgaggaggtggctgtccagaactggctggcccgggtggggagggaacgtttatcccgaatggctatcagcggagatgactgcgttgtgaaacccatcgatgaccgctttgcctctgcactgacggcgttgaatgatatgggtaaggtcagaaaagacattcagcaatgggagccatcgcggggctggaacgattggacacaggtgcccttctgctcacaccactttcatgaactcgtaatgaaggacgggagggttctggtggtcccttgtcgcaaccaggatgagctaatagggagagcacggatcagccagggcgctggttggtcccttaaggaaaccgcctgcctggggaaaagttatgcacaaatgtggactctcatgtacttccacaggcgagacctgcgtttggctgccaatgcaatttgttctgccgtgccaagccattgggtgccgacatccagaaccacttggtcaatccacgcgaagcacgagtggatgaccacagaggatatgttagctgtctggaaccgcgtttggattcaggaaaatccctggatggaggacaaaacgcctgtggaaagttgggaggaagtaccatatctgggaaagcgggaggaccagtggtgcggctctctcatcggccttaccagcagggccacttgggccaaaaacatacagacagccatcaatcaagtgagatccctgattgggaacgaggaatacaccgattatatgccctcaatgaagcgctttcggagggaggaagaggaagctggagtcctatggtga

SEQ ID NO: 14458 - RNA, 9876 nt, synthetic construct
  misc_feature 1..9876: note = derived and/or modified CDS sequence (opt3) from DENV-2__GQ868588__SS-prME
  source 1..9876: mol_type = other RNA
accgccggcatgatcattatgctgatacccacagtgatggctttccacctcactacgagaaatggggagcctcatatgatcgtctccaggcaggaaaagggaaaatcccttctgtttaagaccaaagacggtacaaatatgtgcactttgatggcattagatctgggcgagctatgtgaagacaccattacatacaagtgcccattcctcaaacaaaacgagccggaagatatcgactgttggtgcaattctacctcaacttgggttacatatgggacctgtacgactaccggagagcaccggcgcgagaagcgaagtgtggccctggtaccccatgtgggcatgggtcttgaaacacgtactgagacctggatgagctccgaaggggcgtggaagcacgctcagagaattgagacatggatcctgaggcatcctggatttaccataatggccgcaatcttggcctacacgattggcactacacacttccagcgggtcctcatctttattctgctgaccgctatcgcaccatctatggccatgcgctgcataggcatttcgaacagagatttcgtggagggggtttcaggaggtagctgggtggacatcgtcctcgaacacggcagttgtgtgactacaatggctaaaaataagcccaccttagattttgagctgattaaaacggaagccaagcagcctgcgacccttaggaaatattgcatcgaggcaaagttgacaaacactaccacagactcccggtgtccaactcaaggggaacccaccctgaatgaggagcaggataagcgcttcgtatgcaaacattctatggttgaccgaggatggggcaacggttgtgggctatttggaaagggcggcatcgtgacatgcgccatgttcacatgcaaaaagaatatggaagggaaaattgtccagcctgagaacctcgaatacactgtggtgataacgccacacagcggagaggaacatgctgtcggtaatgatacaggcaagcacgggaaagaggttaagatcaccccgcagtcctcaattactgaggccgaactgaccggatatggcacagtgaccatggagtgtagtcccagaactggtcttgactttaacgaaatggtactgttgcaaatggaggataaggcatggctcgtgcacaggcagtggttcctggacttacctctgccatggctccccggggctgacacacagggcagcaattggatccagaaagaaacgcttgtcacctttaagaaccctcatgccaaaaagcaagatgtggttgtgctgggatctcaggagggcgcgatgcacactgccttgacaggggcaaccgagatacagatgtcctcaggaaatctactgttcacaggtcatctcaaatgccggctgcgtatggacaaacttcaactgaagggcatgagctacagtatgtgtactgggaaattcaagattgtcaaagaaatcgctgagacccagcacggaacgatcgtgattcgcgtacagtatgaaggcgatggttctccatgcaagatcccctttgagattatggacttggagaaaagacatgttctcgggaggctgataaccgtgaacccgatcgtcacagaaaaggattcccctgtgaacattgaggccgaacccccattcggcgacagctacatcatcattggagtcgagcctggccagttaaagctggattggtttcggaaagggtcgtctataggacaaatgttcgaaactaccatgcgaggtgctaagcgcatggccatcctaggcgacacagcatgggattttgggtccctcggaggcgtgttcacttcaattggtaaagccctgcaccaggtttttggggctatctacggcgcggcattcagtggagtgagctggaccatgaagattcttatcggcgtaataatcacgtggattgggatgaactccagatctacatcattgtcagtcagtctggtgctcgttggaatcgtgaccctgtatcttggcgtcatggtgcaggccgactccggttgtgtagtgagctggaaaaacaaggagctgaagtgcgggtctggaatttttgttactgataatgtccacacatggaccgagcagtacaaattccaacccgaatcaccaagtaagttggctagcgccatccagaaagcacatgaggaaggcatatgtggtattaggtccgtgactcggctcgagaacctgatgtggaagcagatcacctctgaattaaatcacattctgtcggagaacgaggtgaaactaacaatcatgacgggcgacataaaggggatcatgcaggtcggaaaacgcagcctcagaccccaacctaccgaactgaggtattcctggaagacttggggcaaggccaaaatgctttcaacagagttgcataatcagacctttctgattgacgggccagaaacagctgagtgcccgaacactaatcgtgcctggaacagtctcgaagttgaggattacggattcggcgtgtttaccacgaatatctggctgcggttacgagagaagcaggacgtgttctgtgattctaaactgatgagcgcagcgattaaggacaacagagctgtacacgccgatatgggttattggatcgaatccgcacttaatgacacatggaaaatagagaaggcctcattcattgaagtcaagagctgccactggcccaaatctcataccttgtggtccaacggggtgctcgagagtgagatggttatccctaagaattttgctggaccagtgagccagcacaacaacaggcccggctaccatactcaaaccgccggtccttggcacctgggcaaactagaaatggatttcgacttttgtgaggggacaactgtcgtggttaccgaagagtgcggaaatcgcggcccatctctgcggacaacgaccgcatccgggaagctcatcactgaatggtgctgtagatcatgcacactgcccccgcttaggtatcgcggagaggatggctgttggtacggtatggagattcgacctttgaaagaaaaggaggaaaacctggtgagtagcttagtaaccgctgggcatggacagatcgacaatttctcgctcggcattctgggtatggccctttttctggaggaaatgttgcggactcgtgtcggcacaaagcacgcgatactcctggtggccgtgtccttcgtcaccctaatcacggggaacatgtcttttagagatctgggaagggttatggtgatggtaggcgctactatgaccgacgatattgggatgggagtgacatacctcgcactgcttgccgctttcaaagtccgcccaacctttgccgcaggcttgctgttacggaagctcactagcaaagagctgatgatgacaaccatcggtattgtgcttctgtcacagagttccatccccgagacaatactagaactcactgacgcgctggccttggggatgatggttctgaagatggtgagaaatatggagaaatatcaattagctgtcaccatcatggccattctctgcgtgcctaacgcagttatcctgcagaatgcttggaaggtgtcttgtacgattcttgccgtcgtaagcgtgagccccctgttgctcacatcaagccagcagaaggcagactggatcccactggccctaaccataaaaggactgaaccctactgctattttccttaccacactcagtaggacttctaagaaacgatcctggcccctgaatgaagcgatcatggccgttggcatggtgagcatcttggcatcgtcactgttaaagaacgatattccaatgaccggcccgctcgtcgctgggggactgcttacggtgtgctacgtactgacaggtcgctctgccgacttggagctcgaacgggccaccgatgtgaaatgggacgatcaagctgagataagtggctccagccctatcctgtctattactatcagcgaggacgggtccatgtcaattaagaatgaagaggaggaacagacactaaccatcctgataagaactggacttctcgtcatcagtggcctgtttcccgttagcattccaatcacagcagccgcgtggtatttgtgggaggtgaaaaagcagagggctggtgtgttatgggatattccctctcctccacccgtcgggaaggccgaactggaggacggagcataccgtatcaaacagaagggcatactcggctattcccaaattggggccggagtgtacaaagaaggtaccttccacacgatgtggcatgttactcgcggcgctgtactgatgcacaaggggaaacggatcgagccttcatgggcagatgtgaagaaggaccttatcagttatggaggcggttggaaactggaaggggagtggaaggagggagaagaggtccaggtgttggccctagaaccgggcaaaaacccaagagcggttcagaccaagcccggcctgtttaggacaaataccgggacaattggagctgtgagcctcgatttctcccctggtacttctggctcgccaatcgtcgacaaaaaggggaaggtggtaggactgtacggcaacggtgtcgtgacccgaagcggggcctacgtttcagcaatagcccagacggagaaatccattgaagataatcccgagatcgaggacgacattttccggaagcgcagacttacaatcatggatttacatcctggagctggcaaaactaagaaatatctgccggccatagtgagggaagcaattaagcggggcctccgaaccttgatcctggctcccacaagagtcgtggccgcggagatggaagaggccctccgcgggctgccaatcaggtaccaaacccctgcaattcgtgctgaacacactggacgggagatcgttgaccttatgtgtcatgccacctttacaatgagactgttgagtcccattagggtgccaaactataacctaataatcatggatgaggctcacttcacggaccctgcatctattgccgcccgcggttacatcagcactcgagtcgaaatgggcgaggctgcggggatctttatgaccgcaacacccccaggatccagagatccgttccctcagtcaaatgcccccattatggacgaggaacgggagataccagaaaggtcttggaacagcggccacgagtgggtgaccgattttaagggtaaaactgtatggttcgtgcccagtatcaagacagggaatgacattgctgcctgcctgcgcaaaaacggaaagcgtgttatccagctctccagaaaaacctttgatagcgaatatgtcaagacgcggactaatgactgggatttcgtggtgacaaccgacatttctgagatgggcgcaaactttaaggccgaaagggtcatcgaccctcgccgatgtatgaaaccagtaatattaaccgatggcgaggagagagtgatcctggctgggcccatgcctgttactcattcatccgcggcccaacggaggggacgcattggtagaaatccgaggaacgaaaatgaccagtacatctatatgggcgagccacttgaaaacgatgaggactgcgcacactggaaggaagctaaaatgctgctcgataatattaacacacccgaggggatcatacctagtatgttcgagcccgaacgggagaaggtggacgccattgatggagaataccgtttgcgcggcgaggcacgaaaaacctttgtcgacctgatgagaaggggtgatctcccagtgtggctggcctacaaggttgctagcgaagggatcaattatgccgaccggcgctggtgtttcgatggcacaagaaacaatcagattcttgaggagaacgtggaagtcgagatctggactaaagaaggagagaggaagaagctaaaacctcggtggctggacgcgcgaatatactcggatcccttggcattaaaggagttcaaagaatttgccgctggcagaaagtctctgacgctcaacctgatcaccgagatggggcgccttccaacattcatgactcagaaagccagggacgctctggacaatctcgcagtgttgcataccgccgaagctggaggtaaggcctataaccacgcactgtccgagctacctgaaacactggagaccctccttctgttaactttgctggcgacggtaaccggcgggatttttctcttcctgatgagcggacggggcatcggtaagatgacacttgggatgtgctgcattatcactgcctcaatactgctctggtacgctcaaattcagccgcactggatcgccgcaagtatcattttggagtttttcctgatcgtgttactaatacccgaaccagagaaacagcgtacccctcaggataatcaactgacatatgttattatcgctattctcaccgtcgtggccgcaactatggccaacgaaatgggctttcttgagaagaccaagaaggacctgggattgggccatatcgctacgcagcagcccgaatctaatatactggatatcgacctcagaccagcgtccgcctggaccctgtacgcagtggctactacattcattacccctatgcttaggcacagcatcgagaactcaagtgtcaatgttagcctcaccgccattgccaaccaggcaacagtgctgatggggttgggaaaaggttggcccctgtccaagatggatatcggcgtaccgttactagctattgggtgttattctcaagtgaatccaatcactctgacggccgcgctccttctgttggtcgctcattacgccataattggacctggcctgcaggcaaaggccacccgcgaggctcagaaacgggcagccgcgggtatcatgaagaaccccacagtggacgggatcactgttattgatctcgacccaataccctacgatcctaaatttgaaaagcagctgggccaagtgatgcttttagtcctgtgcgtaacccaggtgctcatgatgcgaacaacctgggctttgtgtgaggccctgactctagcaacgggaccggttagcacactgtgggaaggcaatcccgggagattctggaacaccactatcgccgtgtccatggctaatatttttaggggatcatatctcgccggcgcaggtcttctgttctctatcatgaaaaacaccacaagtactcgccgggggaccggaaatattggcgagacattgggtgaaaagtggaagtcgagactgaacgctctcggcaaaagcgagtttcagatctacaagaaatccgggatacaagaggtcgaccgtacgctggccaaggaaggaatcaaaaggggcgagaccgatcaccatgcggtgtctcgggggtcagccaagttacgctggttcgtcgaacgaaatcttgtgactccagagggaaaagttgtggacctgggctgcggtagagggggatggagctattactgtggcggtctcaagaacgtaagggaggtgaagggcctaacaaaagggggacctggccacgaggaacccattcctatgtccacctatgggtggaacctggtccggttgcagagtggagttgatgtgttctttgtcccacccgaaaagtgcgacactctgctctgtgacatcggcgagtctagccctaatccaacagtggaagcaggtcgcacccttagagtactgaacttggtggagaattggctgaacaataacacgcagttctgcgttaaagtgctcaatccctacatgccgtcagtcattgagaggatggaaaccttacagcgaaagtatgggggagctctggtgcggaaccctctttcccgtaatagtacacacgagatgtactgggtcagcaacgcctctggcaatatcgtgtcctcagttaacatgataagcagaatgctgattaatcgctttactatgaggcataaaaaggcaacctacgaaccagatgtagacctaggctcggggacacggaacatcggaatcgagtctgaaactcccaatctcgatattataggtaagagaatcgagaaaattaagcaagagcacgaagctagttggcattatgaccaggatcacccttacaaaacctgggcctatcacggctcctacgagacaaagcagaccgggagcgcctcatccatggtgaacggagtcgtgcgcctgttgactaaaccatgggacgttgtgcccatggtcacgcagatggcgatgacagataccactccgttcggccaacagagggtgtttaaggaaaaggtagacacccgaacacaggagcctaaagaaggtacgaagaaactgatgaagatcaccgctgagtggctctggaaagagcttgggaagaagaaaactccccggatgtgtacaagagaagagttcaccaagaaagtgaggtctaacgcagccctgggagctatttttactgatgaaaataagtggaaaagcgcccgcgaggcagttgaggacaaccgtttctgggaattagtcgataaggagcggaatctgcatttggaaggcaaatgcgagacatgtatctataacatgatgggcaagagagaaaagaaactcggggagtttggaaaggccaaaggtagtagggctatatggtacatgtggctgggcgcgcgcttcctagagtttgaagcccttgggttcctgaatgaggaccactggttttcccgagaaaacagcctctctggagtggagggcgaaggtctgcataagttggggtatatcctgcgggaggtgagcaagaaggagggaggcgcaatgtacgctgacgataccgccggctgggacacaagaattactatcgaagatctcaagaatgaggaaatgattaccaaccacatggcaggggagcataagaaacttgccgaagctatcttcaaactgacgtaccagaataaagtcgttagggtgcaacgcccaacccctagaggaacagtaatggacattataagtcggagggatcagcgtggttccggccaggtggggacttatggattaaacaccttcacaaatatggaggcccaactgatccgacagatggagggcgaaggtatttttaaaagcatccagcacttgactgcgtctgaggaaatcgcagtccaggactggctcgtgcgcgttgggagagagcggctgtcgaggatggccatttcaggagatgactgcgtggtcaagcccctagatgaccgcttcgctagagcccttaccgcactgaacgatatgggcaaggtgcggaaagacatacaacagtgggagccaagcaggggctggaatgattggacgcaggtacccttttgctcccaccatttccacgaactcatcatgaaggacgggcgtattctggttgtgccttgtagaaaccaggacgagttgatcggacgagctcgcattagtcaaggtgccggctggtctttacgggaaacagcttgcctggggaaaagctacgcccagatgtggtccctcatgtattttcataggagagatcttcgcctggcagcgaatgccatctgttcagctgtcccaagtcactgggtgccgacctctcggactacatggagcatacacgcctcccatgagtggatgaccactgaagacatgctaaccgtgtggaacagggtctggatcctggagaacccctggatggaggataagacacctgttgaatcatgggaggaaattccatacctcggaaaacgagaggaccagtggtgcggcagcttgatcggtctgacgtctagagcaacctgggctaagaatattcagactgccatcaaccaagtgcggtcccttatagggaatgaagagtatacagattacatgcccagtatgaagaggttccgccgtgaggaagaggaagcaggagtactgtggtga

SEQ ID NO: 14459 - RNA, 9876 nt, synthetic construct
  misc_feature 1..9876: note = derived and/or modified CDS sequence (opt3) from DENV-2__GQ868590__SS-prME
  source 1..9876: mol_type = other RNA
accgcaggaatgatcattatgctgatacccactgtgatggctttccacctcactacgagaaatggggagcctcatatgatcgtcagcaggcaggaaaagggaaaatcccttctgtttaagaccaaagacggtacaaatatgtgcactttgatggcaatggatttaggcgagctgtgtgaagacaccattacatacaagtgcccattcttaaaacagaatgagccggaagatatcgactgttggtgcaattctacctcaacttgggttacatatgggacctgtacgactaccggagagcaccggcgcgagaagcgaagtgtggcactcgtaccccatgtgggcatgggtctggaaacacgtactgagacctggatgagctccgaaggggcgtggaagcacgctcagagaattgagacatggatccttaggcatcctggatttaccataatggccgcaatcctggcctacacgattggcactacacacttccagcgggtcttgatctttattctcctgaccgctatcgcaccatctatgactatgcgctgcataggcatttcgaacagagatttcgtggagggggtttcaggaggtagctgggtggacatcgtcctggaacacggcagttgtgtgacaaccatggccaaaaataagcccacgctcgattttgagttaattaaaaccgaagctaagcagcctgccacactgaggaaatattgcatcgaggcgaaacttactaacaccacaactgactcccggtgtccaacccaaggggaacccacattgaatgaggagcaggataagcgcttcgtatgcaaacattctatggttgaccgaggatggggcaacggttgtgggctgtttggaaagggcggcatcgtgacctgcgcaatgttcacttgcaaaaagaatatggaagggaaaattgtccagcctgagaacctagaatacacggtggtgataacaccacacagcggagaggaacatgccgtcggtaatgataccggcaagcacgggaaagaggttaagatcactccgcagtcctcaattaccgaggctgaactcacaggatatggcaccgtgactatggagtgtagtcccagaacaggtctggactttaacgaaatggtacttctgcaaatggaggataaggcctggttggtgcacaggcagtggttcctcgacctgcctttaccatggctgcccggggcagacacgcagggcagcaattggatccagaaagaaaccctcgtcacttttaagaaccctcatgctaaaaagcaagatgtggttgtgcttggatctcaggagggcgccatgcacacagcgctgaccggggccacagagatacagatgtcctcaggaaatttgctattcactggtcatctgaaatgccggctccgtatggacaagctgcaacttaagggcatgagctacagtatgtgtaccgggaaattcaagattgtcaaagaaatcgcagagacgcagcacggaaccatcgtgattcgcgtacagtatgaaggcgatggttctccatgcaagatcccctttgagattatggacctggagaaaagacatgttttggggaggctcataacagtgaacccgatcgtcactgaaaaggattcccctgtgaacattgaggctgaacccccattcggcgacagctacatcatcattggagtcgagcctggccagctgaagttagattggtttaaaaaggggtcgtctataggacaaatgttcgaaaccacaatgcggggtgccaaacgaatggctatcctgggcgacactgcctgggattttgggtccctaggaggcatgttcacctcaattggtaaggcactccaccaggtgtttggggccatctacggcgctgcgttcagtggagttagctggacgatgaaaattctgatcggcgtgataatcacatggattgggatgaactcccgctctaccagcctttcagtaagtttggtcctggtgggaatcgttactctctatctgggcgtgatggtccaggcagactccggttgtgtggtaagctggaagaacaaggagcttaaatgcgggtctggaatttttgtgacagataatgttcacacctggactgagcagtacaagttccaacccgaatcaccaagtaaactggccagcgctatccagaaggcccatgaggaaggcatatgtggtattagatccgtcaccaggttggagaacctcatgtggaaacagatcacacccgaactgaatcacattttatctgagaacgaggtgaagctgacgatcatgaccggcgacactaaagggataatgcaagtgggaaagcggtcgctacgccctcaaccaacagaactcagatatagctggaagacctggggcaaagcaaagatgctgccgacagagcttcataatcagacatttttgatcgacgggcccgaaaccgccgagtgccctaacacgaatagggcttggaactccctggaagtcgaggattacggattcggcgtttttacaaccaatatttggctccgtctgcgggagaaacaggacgtgttctgtgattcaaagttaatgagtgccgcaatcaaagacaaccgagcggtgcacgctgatatgggttattggattgaatctgccctgaatgacacttggaagatcgagaaggccagcttcatagaagtaaaatcctgccactggccaaagtcacataccctttggagcaacggggtcttggagtctgagatggtgattcccaaaaatctcgccggacctgtttcccagcacaacaacagaccaggctaccatacacaaactgctggtccctggcacctgggcaagctagaaatggattttaatttctgtgaggggaccacagtggtcgtgacggaagagtgcggaaacaggggcccgagtctgcgcaccactacagccagcgggaaactcatcaccgaatggtgctgtcggtcttgcactctgcctccacttagatataggggagaggacggctgttggtacggtatggagatccgccccttgaaggaaaaggaggaaaatctggtttcctcattagtgacagcagggcatggacagattgataactttagtctcggcatcctgggtatggctcttttcctggaggaaatgttgcgaacccgggtaggcacgaaacacgccattctcctggtcgcggtgagctttgtgactctaataaccgggaatatgtcgttccgtgacctgggaagagtcatggttatggtgggcgccacaatgaccgatgacatcgggatgggagtaacttacctcgctctgcttgcagcctataaggtgaggcctacatttgctgccggcttgctgttacgcaaactcacctccaaggagctgatgatgacaactattggtatcgtccttctgtctcagagctcaattcccgagaccatcctagaactcacggatgcactggcgttggggatgatggtgctgaaaatggttcggaacatggagaagtaccaattagccgtgacaataatggctatcctctgcgtcccaaatgccgtgattctgcagaacgcatggaaggttagttgtaccatccttgctgtggtctccgtatctcctctgttgctcactagctcccagcagaaagccgactggattcccctggcactaaccatcaagggactgaatccaacagccatattccttactaccctctcaagaacgagcaaaaagaggagttggccgctgaacgaagctattatggcggtgggcatggtttctatcttggcctccagcctgctaaagaatgacatccctatgacaggccccctcgtggcagggggactgcttaccgtctgctatgtgctgactggtcgatcggctgatttggagctcgaaaaggccacagacgtaaaatgggatgaccaagccgagatttcaggctctagtccaatactgtccatcaccattagcgaggatgggtctatgagcatcaagaacgaagaggaggaacagactctaacaattctgatccgcaccggacttctcgtgatatccggcctgtttcccgtctcaatccctattacggctgcagcctggtacttgtgggaggttaagaaacagcgggcgggtgtgttatgggacgtgccaagtccccctccggtcgggaaggctgaactggaggatggagcctatagaatcaaacagaagggcattctcggctacagccaaatcggggcaggagtgtataaagaaggtactttccacaccatgtggcatgttacaaggggcgccgtactgatgcacaaggggaagcgtatagagccatcttgggctgacgtgaaaaaggatcttatttcctacggaggcggttggaaactggaaggggagtggaaggagggagaagaggtccaggtgttggcactagaacccggcaaaaatcctcgcgccgttcagaccaagccaggcctgtttcggacaaacactgggaccatcggagcggtgtcactcgacttcagtcccggtacgagcggctcccctatcgtcgataagaaagggaaggtggtaggactgtacggcaatggtgtcgtgacaagatctggggcttatgtttcggccattgcacagactgagaaaagcatcgaagacaacccggagatagaggatgacatttttaggaagcgacggcttaccatcatggacttacatcccggagccggcaaaacaaagaagtacctgccagctattgtgcgcgaagccatcaaaagaggcctcaggaccttgatactggcacctactcgggtcgtggctgccgagatggaagaggcgctccgagggctgcccattagatatcaaaccccagccatccgcgcagaacacacaggaagggagatcgttgatcttatgtgtcatgctacgttcactatgcgtctgttgtcacctattcgggtgcccaactacaatctaatcattatggacgaggcccacttcaccgatccagcttccatagcagccagaggttatatcagtacaagggtcgaaatgggcgaggccgctgggatttttatgaccgcgactccgcctggatctcgcgaccccttcccacagagcaacgcacccatcatggatgaggaacgagagatccctgaaagatcctggaactcaggccacgagtgggtgacagactttaagggtaaaaccgtatggttcgtgccatctattaagacggggaacgatatagccgcttgcctgcggaaaaatggaaagagggttatccagctcagccgcaagacttttgacagtgaatacgtcaaaacacgtaccaacgattgggacttcgtggtgaccactgatatttccgagatgggcgccaattttaaggcagaaagagtcatcgacccccggaggtgtatgaaacctgtaattttaacagacggcgaggagcgcgtgatcctggccgggccgatgccagttacccatagctctgctgcgcaacgaagaggacggataggtaggaacccccgcaatgaaaacgatcagtatatctacatgggcgagcctcttgaaaatgacgaggattgcgcccactggaaggaagcaaaaatgctgctcgacaacattaatacacccgaggggatcattccatcaatgttcggacctgagagagaaaaggtggatgctatcgacggcgagtacaggttgcggggtgaagcccgtaaaacttttgtcgagctgatgcgccgaggggatctccccgtgtggctggcatataaggttgcctccgaaggcataaactacgctgacagaaggtggtgtttcgatggaacgcggaataaccagattcttgaggagaacgtggaagtcgagatctggaccaaggaaggcgagcgcaaaaagctaaaaccaagatggctggacgccaggatttatagtgatcctttggcgttaaaggagtttaaagagttcgcagccgggcggaaaagcctgacactcaatctgatcactgagatgggacgacttccgaccttcatgacacagaaggctagagacgccctggataacctcgctgtgttgcataccgcagaagccggtggcaaggcttacaatcacgccctgtcggagctacccgaaactctggagacgctccttctgttaaccttgctggcaacagtaactgggggaatatttctcttcctgatgtctggccgcggtatcgggaagatgacccttggcatgtgctgcattatcacagcgtccattctgctctggtatgcccaaatccagccacactggatagctgccagcattatcttggagtttttcctgatcgtgttactaattcctgaacccgagaaacagaggaccccacaggacaaccaactgacttacgttatcatagcaattctcacagtcgtggctgccacgatggcaaatgaaatgggatttcttgagaagaccaaaaaggacctgggcttggggcatatcgccactcagcagcctgaatcaaacattctggatatcgacctccggcccgctagtgcgtggacactgtatgccgtggcaaccaccttcataacaccgatgcttcgtcactctatcgaaaattccagcgtcaacgtttcactcactgctattgccaatcaggccacggtgctgatgggattgggtaagggctggccactgagtaaaatggatatcggggtacctttactagcaattggatgttacagccaagtgaaccccatcaccctgacagctgccctccttctgttggtcgcgcattacgctattatcggcccaggtctgcaggccaaggcaactagagaggcccagaaaagggctgcagccgggataatgaagaatcccaccgtggacggcattacagttatcgatctcgaccctatcccgtatgatcccaaatttgaaaagcagctgggacaagtgatgcttttagtcctgtgcgtaacccaggtgctcatgatgcgcactacgtgggcgttgtgtgaggctctgacactagccaccggcccagtttccactctgtgggaagggaaccctggacggttctggaataccacaattgcagtgtctatggccaacatatttcgaggcagctacctcgctggtgccgggcttctgttctccatcatgaagaatactacctcaacaagaaggggaacgggcaacattggtgagaccttgggcgaaaaatggaagtctcgcctgaatgcactcgggaaaagtgagtttcagatctataagaaatcgggcattcaagaggtcgaccggactctggctaaggaaggaatcaaaagaggggagacagatcaccatgccgtgagccgtggatccgcgaagttaaggtggttcgtcgaacggaaccttgtgacccccgagggcaaggttgtggacctgggttgcgggcgcggaggctggtcttactattgtggtggcctcaaaaacgtacgagaggtgaaggggctaactaaaggaggccctgggcacgaggaaccaatacccatgtcaacatacggatggaatctggtcagattgcagagcggcgttgatgtgtttttcatccctccagaaaagtgcgacaccctgctctgtgatattggtgagtccagtcccaacccgacggtcgaagccgggaggacccttcgggtgctgaatttggtagagtcttggctgaacaataacacacagttctgcgtgaaagttctcaatccttatatgccaagcgtgatcgagcgcatggaaactttacagagaaagtacggaggcgcactggtcaggaaccccctttcacgaaattccacccacgagatgtactgggtgagtaacgctagcggcaatgtcgtgtcttccgttaacatgatttcacggatgctgatcaatcgttttacaatgagacataagaaagccacttatgaacctgacgtagacctagggagcggaacccgcaacataggtattgagtcggaaacaccaaatctcgatatcatcggcaagaggattgagaaaataaagcaagagcacgaagcatcttggcattacgaccaggatcacccctataaaacctgggcttaccacgggagttatgagactaagcagacgggatccgccagctcaatggtgaacggcgtcgtgcggctgttgacaaagccgtgggacgttgtgcctatggtcacccagatggccatgactgataccacacccttcggtcaacagagagtgtttaaagaaaaggtagacacgcgcacccaggagccaaaagaagggactaagaaactgatgaagatcacagcggagtggctctggaaggagcttggcaagaagaaaacccctaggatgtgtactcgagaagagttcacaaagaaagtgcggtccaacgctgcactgggcgccatttttaccgatgaaaataagtggaaatctgctagagaggccgttgaggacaacaggttctgggaattagtcgataaggagcgcaatctgcatttggaaggcaagtgcgagacatgtgtgtacaacatgatggggaaacgtgaaaagaaactcggagagtttggtaaggcaaaaggcagccgggccatctggtatatgtggctgggggctagattcctagagtttgaagcgcttggattcctgaatgaggaccactggtttagtagggaaaactccctcagcggcgtggagggtgaagggctgcataagttgggatacattctgcgcgaggtctctaagaaagagggcggcgccatgtacgcagatgacactgctgggtgggacacccgaatcacgatagaagatctcaagaatgaggaaatgatcaccaaccacatggccggagagcataagaaacttgcagaagccattttcaaactgacatatcagaataaagttgtgcgggtacaaagacccactccaatcggtaccgtgatggacattatctcaaggcgcgatcagagaggcagtgggcaggtcggaacatacggcttaaacacttttaccaatatggaggctcaactgattcggcagatggagggtgaagggatattcaagtccatccagcacttgacggccagcgaggaaattgcggtgcaggactggctcgttagggtgggacgtgagcgactgtctcgcatggcaatctcgggcgatgactgcgtcgtgaaacccctagatgacagattcgcccgggctcttacagccctgaacgatatgggcaaggtaaggaaagacatccaacagtgggagccttcacgcgggtggaatgattggacccaggttccattttgcagccaccatttccacgaactcattatgaaggacggaagaactctggtggtcccgtgtcggaaccaggatgagttgataggtagggcacgaatctcccaaggcgctgggtggagtttacgtgaaacagcctgcctgggaaaatcttatgctcagatgtggagcctcatgtactttcatagacgcgaccttcggctggccgcaaatgcgatttgttccgccgtgccctcacactgggtgcctaccagtaggactacctggtctatccacgctagccatgagtggatgacaacggaagacatgctaaccgtctggaacagagtttggattctggagaacccatggatggaggataagactcccgtggaatcctgggaggaaatcccttatctcggcaagcgcgaggaccagtggtgcggttcattgatagggctgacaagccgggccacctgggccaaaaatatccagactgctattaaccaagtaaggtctcttatcggaaatgaagagtacacagattatatgccatccatgaagcgattcagacgggaggaagaggaagccggcgtgctgtggtga

SEQ ID NO: 14460 - RNA, 9876 nt, synthetic construct
  misc_feature 1..9876: note = derived and/or modified CDS sequence (opt3) from DENV-2__GQ868497__SS-prME
  source 1..9876: mol_type = other RNA
accgcaagcgtgatcgtaatgctgattccaacagttatggctttccacctcactacgcgtaacggcgaacctcatatgatagtggggagacaggaaaagggaaaatcccttctgtttaagaccgaagacggtgtgaatatgtgcacattgatggcaatcgatttaggcgaactgtgtgaagacactattacctacaaatgcccactactccggcaaaacgaaccggaggatatcgactgttggtgcaattctacatcaacctgggtgacttatgggacatgtagtaccacgggagagcaccgccgagaaaagcgtagcgtcgccctggtgccacatgttggcatgggtcttgagactagaaccgaaacatggatgtcctctgagggggcgtggaaacacgtgcagaggattgagacttggatcctgcggcatcctggattcaccataatggctgccatcttggcatacacaattggcaccacgcactttcagcgcgccctcatcttcattctgctgactgctgtcgcaccatcgatgacaatgagatgcatcggcatatcaaacagggattttgtggaaggggtaagcggaggtagttgggttgacattgtgctcgagcacggctcctgtgtcaccactatggccaagaataagcccacattagatttcgaactgatcaaaaccgaggctaagcagcctgccacgcttcggaaatattgcattgaagcgaagttgaccaacacaactaccgagtctcgctgtccaacacaaggggagcccagcctgaatgaagaacaggacaaacgatttatctgcaagcattccatggtggatagaggatggggcaacggttgtgggctattcggaaagggcggcatcgtgacttgcgcaatgtttacctgcaaaaagaatatggaagggaaagtcatgcagcctgagaacctcgaatacacaattgttataaccccacactcaggagaggagcatgccgtgggtaatgacactggcaagcacgggaaagaaatcaagattacgccgcagagtagcatcacagaggctgaactgaccggatatggcactgtaaccatggagtgttctcccaggacaggtcttgatttcaacgaaatggtgctgttgcaaatggaggacaaagcctggctcgtccaccggcagtggtttctggatttacctctgccatggctccccggggcagacacccagggctccaattggatacagaaggagactcttgtgacattcaagaaccctcatgctaaaaagcaagacgttgtggtcctgggatcacaggaaggcgccatgcacacggcgttgaccggggccactgagattcagatgagcagtggaaatctactgtttacaggtcatctcaaatgccgtctgcgcatggataaacttcaactgaaaggcatgtcttactccatgtgtaccgggaagttcaagatcgtgaaagaaatcgcagagacacagcacggaactattgtaatcagagttcagtatgagggcgacggtagcccatgcaagattcccttcgaaataaccgatttggagaaaaggcatgtgctcgggcggctgatcacggtcaacccgattgtgaccgaaaaggactcgcctgtcaacatcgaggctgaacccccatttggcgattcttacatcattataggagtggagcctggccagttaaaactgaattggttcaagaaggggtcctcaatcggacaaatgtttgagacaactatgcgaggtgccaaacgcatggctattctaggcgacaccgcctgggatttcgggagtctcggaggcgtttttacaagcatcggtaaggcactgcaccaggtgttcggggccatttacggcgctgcgttttccggagtatcttggactatgaaaatccttataggcgtcatcattacctggatcgggatgaacagcagatcaacgagtttgtccgtgagcctggttctcgtgggagtcgtgacactgtatcttggcgcaatggtacaggccgactctggttgtgtggtttcatggaagaataaagaactgaagtgcgggagtggaattttcatcaccgataacgtccacacttggacagagcagtacaagtttcaacccgaaagcccatccaaattggcttctgccatacagaaggcacatgaggaaggcatttgtggtatcaggtcggtgacccggctcgagaatctgatgtggaaacagattactcccgagttaaaccacatcctgagcgaaaatgaggtgaagctaaccataatgacaggcgacatcaaagggattatgcaggccggaaagcgctccctcagacctcaaccaacggaactgaaatattcatggaagacctggggcaaggctaaaatgcttagtactgagtctcataaccagacattcttgatcgatgggccggaaaccgccgagtgccccaatacaaacagggcatggaatagcctggaggtcgaagactacggatttggcgttttcactaccaacatttggctcaagctgcgtgagaaacaggacgtgttttgtgattccaagttaatgtcagcggctatcaaagacaatcgggccgtgcacgcagatatgggttattggatagaaagcgccctgaacgacacgtggaagatggagaaggcttctttcattgaggtaaaatcctgccactggcctaagagtcatacactttggagcaatggggtcttggaatctgagatgatcatccccaagaacttcgccggacccgtgtcccagcacaactaccgacctggctatcatacccaaactgcaggtccatggcacctcggcaagctggaaatggattttgacttctgtgaggggaccacagttgtggtcactgaagattgcggaaatagaggcccctcactaaggaccacaacggctagtgggaaactgattaccgagtggtgctgtcgcagctgcactctcccgcctctgcggtacagaggagaggacggctgttggtacggtatggaaatcaggccacttaaggagaaggaagagaacttggtaaattcgctggttacagccgggcatggacagattgataacttttccttaggcgtgctcggtatggcgctgttccttgaagagatgctgcgcacccgaataggcactaaacacgccatcttgctcgtagctgcatcttttgtcacactgattaccgggaatatgagcttccgggacctaggacgtgtgatggtgatggtcggcgccacgatgactgatgacatcgggatgggagttacctatctggctctcctggccgcatttaaggtgagacccacattcgcggccggccttttgctgaggaaattaacctcaaaggagctcatgatggctactattggtatcgccctgcttagtcagtccacaatacctgaaaccatcctggagctaacagatgcactcgctctggggatgatggtattgaaaattgtgcgcaacatggaaaagtaccaactggccgtcactatcatggcaatttcttgcgtgcccaatgccgttatcttacagaacgcttggaaggtgagctgtaccatactcgcggccgtctccgtgtcaccactgcttctgacgagcagtcagcagaaagcagactggattcctttggctctcacaatcaagggactgaatcccaccgccatctttctaactaccctgtctcggacatccaaaaagagaagctggccacttaacgaggccgttatggctgtgggcatggtctcgattctcgcatcatctctgttgaaaaatgacataccgatgactggccctctggtagccgggggattactcaccgtgtgctatgttctgacgggtaggagtgcggatcttgaactggagcgagctgccgacgtgaagtgggaggatcaagcagaaatctccggcagctctcccattttgagcatcacaatttccgaggacgggtcaatgagtgtcaaaaacgaagaggaggaacagaccctcactatcctgatacgcacaggactactggtgatcagcggcgtattcccagtgtctattcccatcaccgccgctgcatggtacctttgggaggtcaagaagcagcgggccggtgttctctgggatgtgccttccccaccccctgtggaaaaagcggagctggaagacggggcttatagaattaagcagaggggaatcttgggctactcacaaataggcgccggggtctataaagagggaacttttcacacaatgtggcatgtgacccgtggtgcagttttaatgcaccgcggcaagcggattgagccgagttgggccgatgtcaagaaggacctgatcagctacgggggaggctggaagctcgaaggtgagtggaaagaaggggaggaagtgcaggtcctggctcttgagccaggaaagaatcccagagccgtgcagacgaaacctggcatcttcaagactaacaccggcacaattggggcagtttccctggatttttctccaggaacctcgggtagccccatcgtggacaggaaaggcaaggtcgtggggttgtacggaaatggcgtagtcacacgatcaggtgcttatgtgtccgccatagcgcagactgagaagagtattgaagataaccctgagatcgaagacgatattttccggaaaaagcgcctaaccatcatggacctgcatccgggggccggaaaaacgaagagatacctccccgcaatagttagggaggctattaaacggggcctgcgaacacttatcttagccccaactagagtggtcgctgcagaaatggaggaggccctgcgcggcctccctatcaggtatcaaacccccgccattaagacagaacacaccgggcgtgagatcgtggacttgatgtgtcatgctactttcaccatgcggctgctctctccagttagagtgcctaactacaatctgattataatggatgaagcgcactttacagaccccgcaagcatcgccgctaggggatatatttccacgcgcgtcgagatgggtgaggccgcaggcatcttcatgactgccaccccaccggggtcacgagatccttttccccagtctaacgctccaatcatggacgaagagagagaaattcccgagcggagctggaatagtggacacgaatgggtgacagatttcaagggcaaaaccgtatggtttgtgccttccataaaggcgggtaacgacatcgccgcatgccttaggaaaaatgggaagaaagttattcagctgagccgcaagactttcgattctgagtacgtcaagacacgtgctaacgactgggattttgtggtgaccacggacatctcagagatgggagccaatttcaaagcagaaagagtcattgatccacggaggtgtatgaagcccgtaatcttgactgacggcgaggaacgcgtgatactagccggccctatgccggttacacattccagtgctgcccaacgaagagggcggatcggaaggaaccccaaaaatgagaacgaccagtatatttacatgggtgaacccctggagaatgatgaggactgcgcgcactggaaggaagcaaaaatgctcttagataacatcaatacccctgagggcattatccccagcatgtttgaaccagagcgcgaaaaggtggacgccatagatggggagtacagactgaggggagaggctcggaaaaccttcgtcgaccttatgcgtcgcggcgatctgcctgtgtggctcgcctataaggttgctgcagaaggtattaactacgccgaccgaaagtggtgttttgatgggatcaaaaataaccagattttggaggaaaacatggaggtggagatctggactaaggaaggcgagaggaaaaagctgaaacccaggtggctcgacgctcggatatattcggatccactggcccttaaggagttcaaggagttcgcagcgggacgcaaatctctaacactgaatttgatcaccgaaatgggcagattacctacatttatgactcagaaggccaggaacgctctggacaatctcgccgtcctgcatacggcagaggctgggggacgggcctacaaccacgcactttccgagctgccggaaaccctcgagacattgctgctactgactctccttgccaccgtgacaggtggcattttcctgtttttaatgagcgggaaaggaatcggcaagatgaccttgggtatgtgctgcattatcactgcttcaatactgctctggtatgcgcaaattcagccccactggatcgccgcaagtatcattctggagttctttcttatcgtactgctcataccagagcctgaaaaacagcgaacgccccaggataatcaattgacctacgtggttattgctatcctgacagtcgtggccgccactatggcaaacgagatggggttcttagagaagaccaagaaagacctaggcctgggatctattacaacccaggaatccgagagcaatatcctcgacatagatcttagaccagcttcagcctggactctgtatgcggtggctacaacgtttgtcacccctatgttgcgccatagtatcgaaaacagctccgttaatgtgtctctgactgccattgcaaaccaggccacagtactcatgggcctggggaagggatggccccttagcaaaatggacatcggtgtgccgctcctggctattggctgttactcccaggtcaatccaatcaccttgaccgcagccctgttactactggtggcgcactacgctattatcgggcctggactccaagccaaggcaacaagggaggcccagaaacgggctgccgcaggcataatgaagaaccccactgttgatggtattacggtgatcgaccttgaaccaatcccctatgatcctaagttcgagaaacagctggggcaggtcatgttgctgattctctgcgtaacccaagtgctgatgatgcgtacaacttgggctctttgtgaggccttaaccctggcgacaggcccgatatcaaccctctgggaaggaaatcccggcagattttggaacactacgatcgccgtttctatggcaaatattttcagggggagttacttggctggagccggcctgctattttcgatcatgaagaacacaaccaatactcgccggggtaccgggaacattggagagacactgggcgaaaaatggaaaagccgactcaacgcacttggtaaatccgagttccagatctataagaaatctggcatacaggaggtggacagaactctggctaaggaagggatcaagaggggagagaccgatcatcacgccgtctcacgcggcagcgccaaattgcggtggtttgtggaaagaaatatggtcacaccagaggggaaggtggttgacctgggatgcggccgtggtgggtggtcctactattgtggaggcctcaaagatgtgagggaagtaaagggtctgacgaaaggcgggcctggacatgaggagcccattcctatgagtacctacggctggaacttagtgcggcttcaatctgggatcgacgtcttcttcactccacccgaaaagtgcgatacactgctctgtgacattggagagagctcacctaatccaaccatcgaagcgggccgcactctacgagttctgaacttggtggagaattggctgaacaataacacacagttttgcataaaggtcctcaatccctatatgccgtccgtgattgagaaaatggagacccttcagagaaagtacggtggggctctggtaaggaaccctttgagtcggaatagcacgcacgagatgtactgggtgtctaacgcaaccggaaatatcgtttcctcagtgaacatgatcagccgcatgctgattaatagattcacaatgaaacacaagaaagccacttatgaaccagatgtcgacctcggctcgggcaccaggaacatagggatcgagtctgaaattcccaacttagacatcattggaaagcgaatcgagaagataaaacgggaacatgagacaagttggcactacgatcaggaccatccttataagacttgggcttaccacggttcctatgagaccaaacaaacaggcagcgcctcatccatggtgaatggggtcgtgcgtctgcttaccaagccatgggatgttgtacccatggtgactcagatggcaatgacggacacaaccccgtttggacagcagagagtcttcaaagaaaaggtggatactcgcacccaagagcctaaggaaggcacgaaaaagctgatgaaaatcacagccgagtggctatggaaggagctcggtaaaaagaaaacccccaggatgtgtactcgggaagagtttacaagaaaggttcgctctaacgctgcgctgggggccattttcaccgacgaaaataagtggaaaagcgcaagggaggctgtggaagatggacgattttgggagttggtcgaccgggagagaaacctgcacctcgaaggcaagtgcgagacttgtgtgtacaatatgatgggcaaaagggaaaagaaacttggggagttcggaaaggccaagggtagtcgcgcaatctggtatatgtggctgggcgccagatttttagagttcgaggctctggggtttttgaacgaggatcattggttctcccggggaaatagcctctctggcgtagaaggtgaggggctgcacagactaggatacattcttagggacgtgggcaaaaaggaaggcggggccatgtacgcggatgacacagcaggatgggacacccgcatcacactggaggatctcaaaaacgaagagatggttactaatcatatgaagggtgagcacaaaaagctggccgaagctatttttaagttgacctatcagaacaaagtcgtgcgagtgcagcggccaacgcctagaggcaccgtcatggacataatctcaaggcgcgatcagagagggagtggacaagttggcacatacggtctgaatactttcaccaacatggaggcccagctcattcggcagatggaaggggagggaatcttcaagtccatccaacatcttacagcaactgaggaaattgctgtgcagaattggctggccagggtaggccgtgagcgattaagccgcatggctatatctggcgacgattgcgtggtcaaacccatcgacgatagatttgcctcggcactgaccgcgttgaacgacatggggaaggtgcggaaagatattcagcagtgggaaccatcaaggggatggaatgactggacgcaagttcccttctgcagccaccactttcatgagctcgtgatgaaggatggtcgcgtcctggtggtaccttgtagaaaccaggacgaactaatcggccgggccaggatttcccagggggctggatggagtcttaaggagacagcctgcctgggcaaatcttatgcacagatgtggaccctcatgtacttccaccgacgtgatctgagattggctgccaacgcaatctgtagcgccgttccatcccattgggtgccgacttcacgcacaacctggagtatacacgcgaagcacgagtggatgactaccgaagacatgttagctgtctggaatcgggtgtggatccaagagaacccctggatggaagacaaaacacctgtggagtcttgggaagaggtcccatatctgggtaagagggaggatcagtggtgcgggagcctcattggacttacgtccagagccacctgggccaaaaatatccagactgccattaaccaggttcgctcactgatcggcaatgaagagtacacagactatatgcccagcatgaagcggtttaggaaggaagaggaagaggctggcgtgctatggtga

SEQ ID NO: 14461 - RNA, 9876 nt, synthetic construct
  misc_feature 1..9876: note = derived and/or modified CDS sequence (opt3) from DENV-2__GU131959__SS-prME
  source 1..9876: mol_type = other RNA
accgcaggcgtgatcgtaatgctgattccaacagttatggctttccacctcactacgcggaacggggagcctcatatgatagtgggaaggcaggaaaagggtaaaagccttctgtttaagaccgaggacggcgtaaatatgtgcacattgatggcaatcgatttaggggaactgtgtgaggacactattacctacaaatgcccactactccggcaaaacgaaccggaggatatcgactgttggtgcaattccacatctacctgggtgacttatggaacatgttcaaccacgggcgagcaccgccgagaaaagcgtagtgtcgccctggtgccccatgttggtatggggcttgagactagaaccgaaacatggatgagctccgagggagcgtggaaacacgtgcagaggattgagacttggatcctgcggcatcctggcttcaccataatggctgccatcttggcatacacaattggcaccacgcactttcagcgcgccctcatcttcattctgctgactgctgtcgcaccatctatgacaatgagatgcatcgggatatcgaacagggattttgtggaaggagtatcaggtggcagctgggttgacattgtgctcgagcacgggagttgtgtcaccactatggccaagaataagcccacattagatttcgaactgatcaaaaccgaggctaagcagcctgccacgcttcggaaatattgcattgaagcgaagttgaccaacacaactaccgagtcccgctgtccaacacaaggagagccctctctgaatgaggaacaggacaaacgatttatctgcaagcatagcatggtggatagaggctggggtaacgggtgtggactattcggcaagggcgggatcgtgacttgcgcaatgtttacctgcaaaaagaatatggaaggaaaagtcgttcagcctgagaacctcgaatacacaattgtgataaccccacactccggtgaggagcatgccgtaggcaatgacactgggaagcacggaaaagaaatcaagattacgccgcagtcaagtatcacagaggctgaactgaccggctatggtactgtgaccatggagtgtagccccaggacagggcttgatttcaacgaaatggtcctgttgcaaatggaggacaaagcctggctcgtgcaccggcagtggtttctggatttacctctgccatggctccccggcgcagacacccagggatctaattggatacagaaggagactcttgttacattcaagaaccctcatgctaaaaagcaagacgtggtcgtgctgggctcccaggaaggggccatgcacacggcgttgaccggagccactgagattcagatgtcaagcggtaatctactgtttacaggccatctcaaatgccgtctgcgcatggataaacttcaactgaaagggatgagttactctatgtgtaccggaaagttcaagatcgtaaaagaaatcgcagagacacagcacggcactattgttatcagagtgcagtatgagggtgacgggtccccatgcaagattcccttcgaaataaccgatttggagaaaaggcatgtcctcggccggctgatcacggtgaacccgattgtcaccgaaaaggacagccctgtgaacatcgaggctgaacccccatttggagattcgtacatcattataggcgttgagcctgggcagttaaaactgaattggttcaagaagggatcttccatcggtcaaatgtttgagacaactatgcgaggcgccaaacgcatggctattctaggggacaccgcctgggatttcggatcactcggcggtgtgtttacaagtatcgggaaggcactgcaccaggtattcggcgccatttacggagctgcgtttagcggcgtctcctggactatgaaaatccttataggggtgatcattacctggatcggaatgaacacgagatctactagcttgtcagttagtctggtgctcgtcggcgtggtaaccctgtatcttggtgcaatggtgcaggccgactccgggtgtgttgtcagctggaagaataaagaactgaagtgcggatctggcattttcatcactgataacgtgcacacatggaccgagcagtacaagtttcaacccgaatcaccaagtaaattggctagcgccatacagaaggcacatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggccggcaagcgctcgctcagacctcaaccaaccgaactgaaatatagctggaagacttgggggaaggctaaaatgctttccacagagtcacataaccagaccttcttgatcgatggaccggaaacagccgagtgccccaatactaacagggcatggaatagtctggaggttgaagactacggctttggtgtgttcaccacgaacatttggctcaagctgcgtgagaaacaggacgtgttttgtgattctaagttaatgagcgcggctatcaaagacaatcgggccgtacacgcagatatggggtattggatagaatccgccctgaacgagacatggaagatggagaaggcttcattcattgaagtcaaaagctgctactggcctaagtctcacaccctttggtccaatggagtgttggagagtgaaatgatcatccccaagaatttcgccggccccgttagccagcataactatcgacctggttaccacactcaaaccgcaggcccatggcatctcgggaagctggagatggactttgatctatgtgaaggaacaactgtggtcgtgaccgaggactgcggcaatagagggccctctctgaggacaacgaccgcttccggaaaactcattactgagtggtgctgtcgctcatgcacactgccgcctcttcggtacagaggcgaagatggttgttggtatgggatggagatcaggccattgaaggaaaaggaggaaaacctggttaatagtttagtgaccgccggacacggccagattgacaacttcagcctcggtgtactgggcatggcgctttttctggaggagatgttgcgcactcgaatagggacaaaacatgccatcctcctggtcgctgcatcgttcgtgaccctaattacgggaaatatgtcctttcgggatctgggccgtgtgatggtcatggttggggccactatgaccgacgatatcggaatgggcgtgacatacctcgctctgcttgccgcattcaaggtaagacccacctttgcggccggtttgctgttaaggaaactcacttctaaggaactgatgatggctacaattgggatcgcccttctgagccagtcaaccatacctgagacaatcctagaactcactgacgcactggctttgggaatgatggtgctgaaaattgtccgcaacatggagaagtatcaattagccgtgaccatcatggcaattagttgcgttcccaatgccgtgatcctccagaacgcttggaaggtctcctgtacgatactggcggccgtgtctgttagcccacttctgttgacatcctcacagcagaaagcagattggattcctctcgctctgaccatcaagggcctaaatcccactgccatcttcctgaccacacttagccggacaagtaaaaagagatcttggccactcaacgaagccgtgatggctgtcggcatggtatccattctggcaagctcgttgctgaaaaatgacataccgatgaccgggcctttagtggccggaggtctcctgacggtttgctacgtgcttacaggcaggtcagcggacctggagttggagcgagctgccgatgtcaagtgggaagaccaagcagagatctctgggagttcccccattctcagcatcaccatttctgaagatggaagcatgtccatcaaaaacgaggaggaagaacagactctgacaatactaatccgcaccggcctgcttgtgatttcaggtgtatttccagtgagtatccccattactgccgctgcatggtatctctgggaagtcaagaagcagcgggccggggttctgtgggacgtgcctagcccaccccctgtggagaaagcggaattggaggatggagcttacagaatcaagcagaggggcatattaggctattctcaaattggggccggagtctacaaagagggtacattccacaccatgtggcacgtgacgcgtggcgcagttctgatgcatcgcgggaagcggatcgaaccgtcctgggccgacgtcaaaaaggatctcatctcatacggaggcggttggaagctggagggggaatggaaagagggagaagaggtgcaggtccttgctctggagccaggcaagaatcccagagccgtgcagactaaacctggcatttttaagaccaacacagggaccatcggagcagttagtttggacttcagcccaggtacatccggctctcccatagtggataggaaagggaaggtcgtgggactatatggcaatggtgtagtcactcgatcgggggcttacgtgagcgccattgcgcagaccgaaaagtcaatcgaggacaaccctgaaattgaggatgacatctttcggaaaaagcgcctgacgataatggatctccacccgggagccggcaaaacaaagagatatctgcccgcaattgttagggaagctatcaaacggggccttcgaactttaatcctggccccaaccagagtggtcgctgcagagatggaggaagccctccgcgggttgcctattaggtaccaaacacccgccatcaagaccgagcatactggacgtgaaattgtggacctgatgtgtcacgctaccttcacaatgcggctcctgtccccagttagagtgcctaactataatcttataatcatggacgaggcgcatttcacggatcccgcaagtattgccgctaggggttacatctctactcgcgtcgagatgggcgaagccgcagggatctttatgaccgccacaccaccgggaagccgagaccctttcccccagtccaacgctccaattatggatgaggaaagagagatacccgaacggtcatggaactctggccacgagtgggtgaccgactttaagggtaaaactgtatggttcgtgcctagcatcaaggcggggaacgatattgccgcatgcctgaggaaaaatggaaagaaagttatccagttgagtcgcaagacatttgactccgagtatgtcaagacccgtgctaacgattgggacttcgtggtgacgactgatattagcgaaatgggcgccaattttaaagcagagagagtcatcgacccacggaggtgtatgaagcccgtaatactaacagatggcgaggaacgcgtgatcctggccgggcctatgccggttacccactcttcagctgcccaacgaagaggacggattggtaggaaccccaaaaatgaaaacgaccagtacatctacatgggcgagcccctcgagaatgacgaagattgcgcgcattggaaggaggcaaaaatgttactggacaacattaatacccctgaagggatcataccctccatgttcgagccagaacgcgagaaggtggatgccattgacggagagtatagacttaggggcgaagctcggaaaacttttgtcgatctgatgcgtcgcggtgacctccctgtgtggttggcctacaaggttgctgcagaggggatcaactatgccgatcgaaagtggtgtttcgacggcattaaaaataaccagatcctggaagagaacatggaggtggaaatatggacaaaggagggagaaaggaaaaagctcaaacccagatggctggatgctcggatctacagtgacccacttgccctaaaggagtttaaggagttcgcagcgggccgcaaaagcctgaccttgaatttaattacagagatggggagactgcctactttcatgacgcagaaggccaggaacgctctcgataatctggccgtccttcacaccgcagaggctggaggtcgggcctataaccatgcactgtcggaactcccggagacattggaaactctgctactgctcacccttctggccacagtgaccggcgggatctttttattcttgatgtctggaaaaggcattggtaagatgactctggggatgtgctgcatcataacggcttccattctcctgtggtacgcgcaaatccagccccactggatcgccgcaagcattatccttgagtttttcctgatagtactcttgattccagaacctgagaaacagcgaaccccacaggacaatcaactgacatatgtggttatcgctattttaactgtcgtggccgccaccatggcaaacgagatgggctttctagaaaagacaaagaaagatctgggactcggctcaatcaccactcaggagagtgaatctaatatacttgacatcgacctgagaccagcttccgcctggacattgtacgcggtggctacgaccttcgtcactcctatgctgcgccacagcattgagaactcaagtgttaatgtgagcctcacagccatcgcaaaccaggccaccgtactgatggggcttggaaagggttggcccctctccaaaatggatattggcgtgccgctgttggctatcgggtgttactctcaggtcaatccaattaccctgacagcagccttactactgctcgtggcgcattatgctatcataggacctggccttcaagccaaggcaactagggaagcccagaaacgggctgccgcaggtattatgaagaaccccacggttgacgggatcaccgtgatcgatctggagccaattccctacgaccctaagtttgagaaacagttgggccaggtcatgctgctcatactgtgcgtaacacaagtgcttatgatgcgtactacctgggctttatgtgaagccctgacactcgcgaccggaccgatcagcactttgtgggagggcaatcccgggagattctggaacacgacaattgccgtttccatggcaaatatctttaggggatcatatctggctggcgccggtctactgttctctattatgaagaacaccactaatacccgccgggggacaggaaacatcggcgaaactctcggtgagaaatggaagagtcgacttaacgcactgggcaaatcggagtttcagatatacaagaaaagcgggatccaggaagtggatagaaccttggctaaggagggaattaagaggggcgaaacagaccaccatgccgtctcccgcgggtctgccaaactgcggtggttcgtggagagaaatatggtcacgccagaaggaaaggtggttgatctcggctgcggtcgtgggggatggtcatattactgtggcggtctgaaagacgtgagggaggtaaagggcttaaccaaagggggacctggccacgaggaacccatccctatgagcacttatgggtggaaccttgtgcggctgcaatccggaattgatgtctttttcacaccacccgagaagtgcgacaccctcctatgtgatatcggcgaaagttctcctaatccaactatagaggcgggtcgcacactgcgagttttgaacctggtggaaaattggctcaacaataacacccagttctgcattaaggtccttaatccctacatgccgagcgtgatcgagaaaatggagacgctgcagagaaagtacgggggagctttggtaaggaaccctctgtcaagaaattccacccatgaaatgtattgggtgagtaacgcaacaggcaatatcgttagctctgtgaacatgatttcccgcatgctcataaatagatttactatgaaacacaagaaagccacctacgagccagacgtcgatttaggctcagggacaaggaacatcggaattgaaagcgagatccccaacctggacattatcggtaagcgaatagaaaagatcaaacaggagcacgagacttcgtggcattatgaccaagatcacccttacaagacctgggcttatcatggctcttacgaaacaaaacagaccgggagtgcctccagcatggtgaatggagtcgtgcggcttctgactaagccatgggacgttgtacccatggtgacgcagatggcaatgacagataccactccgttcggccagcaacgtgtctttaaagagaaggtggacaccagaacacaggaacctaaggagggtacgaaaaagctaatgaaaattaccgccgagtggctctggaaggaactggggaaaaagaaaactccccgcatgtgtacaagggaggagttcacccggaaggttagatcaaacgctgcgttgggagccatctttactgatgagaataagtggaaatccgcacgcgaagctgtggaggacggcaggttctgggagctggtcgatcgagaacggaacctccaccttgagggcaagtgcgaaacatgtgtgtataatatgatggggaaaagagagaagaaactgggagaatttggtaaggccaagggctctagggcaatttggtacatgtggttaggggcccgcttcctggagtttgaggctttgggattcctcaacgaagaccactggtttagccgtggcaatagtctgtccggtgtagagggggaaggactacatcggcttggctacatcctgagagatgtgggcaaaaaggaagggggagccatgtatgcggacgataccgcaggttgggacacaaggattactctcgaagacctgaaaaacgaggagatggttaccaatcacatgaagggcgaacataaaaagttggccgaggctatattcaagctgacgtaccagaacaaagtcgtgcgcgtgcagcgaccaacccctcgggggacagtcatggatatcattagcagaagggaccaacgcggatctggccaggttggtacttatgggctcaatacctttacaaacatggaagcccagcttatcagacaaatggagggagagggcatcttcaagtcaattcagcacctgactgcaaccgaagagatagctgtgcagaattggttagcccgggtaggcagggaacgtctgagtcgaatggctatctccggggatgactgcgtggtcaaacccattgatgaccgcttcgccagcgcattgacggcgctcaacgatatgggaaaggtgagaaaagacatccagcaatgggagccatctcggggttggaatgattggacacaggttcccttttgctcgcatcacttccacgaactggtgatgaaggacggcagggtcctagtggtaccttgtcgcaaccaggatgagcttattgggagagcccggatctcacagggagctggctggagcctgaaggagaccgcctgcctcggtaaatcctacgcacaaatgtggactctgatgtattttcataggcgagacttgcgtttagctgccaacgcaatatgtagtgccgttccatctcactgggtgccgacaagcagaaccacttggtccatccatgcgaagcacgaatggatgaccacagaggatatgctggctgtctggaatcgcgtgtggattcaggaaaacccctggatggaggacaaaacgcctgtggaatcatgggaggaggtcccatacctcgggaagcgggaagaccagtggtgcggaagtcttatcggcctgacctctagggccacttgggccaaaaatattcagacagccatcaaccaagttagaagcctaataggcaatgaggaatataccgattacatgccctccatgaagcgcttccggaaggaggaagaggaggctggggtgctgtggtga

SEQ ID NO: 14462 - RNA, 9876 nt, synthetic construct
  misc_feature 1..9876: note = derived and/or modified CDS sequence (opt3) from DENV-2__GQ868515__SS-prME
  source 1..9876: mol_type = other RNA
accgccggcgtgatcgtcatgctgattcccacagttatggctttccacctcactacgagaaacggggagcctcatatgatagtgggaaggcaggaaaagggtaaaagccttctgtttaagaccgaggacggcgtaaatatgtgcacattgatggcaatcgatttaggggaactgtgtgaggacactattacctacaaatgcccactactccggcaaaacgaaccggaggatatcgactgttggtgcaattccacatctacctggattacttatggaacatgttcaaccacgggcgagcaccgccgagaaaagcgtagtgtggccctggtcccccatgtgggtatggggcttgagactagaaccgaaacatggatgagctccgagggagcgtggaaacacgttcagaggatcgagacttggatactgcggcatcctggcttcaccatcatggctgccattttggcatacacaatcggcaccacgcactttcagcgcgccctcattttcatcctgctgactgctgtggcaccatctatgacaatgagatgcatagggatttcgaacagggattttgtcgaaggagtgtcaggtggcagctgggtagacatcgttctcgagcacgggagttgtgtgaccactatggccaagaataagcccacattagatttcgaactgattaaaaccgaggctaagcagcctgccacgcttcggaaatattgcatcgaagcgaagttgaccaacacaactaccgagtcccgctgtccaacacaaggagagccctctctgaatgaagagcaggacaaacgatttatctgcaagcatagcatggtcgatagaggctggggtaacgggtgtggactattcggcaagggcgggattgtgacttgcgcaatgtttacctgcaaaaagaatatggaaggaaaagtggtccagcctgagaacctcgaatacacaatagttatcaccccacactccggtgaggagcatgccgtgggcaatgacactgggaagcacggaaaagaaattaagatcacgccgcagtcaagtataacagaggctgaactgaccggctatggtactgtaaccatggagtgtagccccaggacagggcttgatttcaacgaaatggtgctgttgcaaatggaggacaaagcctggctcgtccaccggcagtggtttctggatttacctctgccatggctccccggcgcagacacccagggatctaattggattcagaaggagactcttgtgacattcaagaaccctcatgctaaaaagcaagacgttgtggtcctgggctcccaggaaggggccatgcacacggcgttgaccggagccactgagatccagatgtcaagcggtaatctactgtttacaggccatctcaaatgccgtctgcgcatggataagcttcaactgaaagggatgagttactctatgtgtaccggaaagttcaagatcgtgaaagaaattgcagagacacagcacggcactatcgtaattagagttaggtatgagggtgacgggtccccatgcaagatacccttcgaaatcaccgatagcgagaaacggcatgtgttgggccgactcattacggtcaacccgatcgtgaccgaaaaggactcgcctgtcaacatcgaggctgaacccccatttggagattcttacattataatcggcgtggagcctgggcagctgaaattaaattggttcaagaagggatcctcaattggtcagatgtttgagacaactatgcgcggcgccaaaagaatggctatcctgggggacaccgcctgggatttcggaagtctaggcggtgtttttacaagcattgggaaggcactccaccaagtgttcggcgccatctacggagctgcgttttccggcgtatcttggactatgaaaatactgatcggggtcattatcacctggattggaatgaacagcaggtcaacgagtctttccgtgagcttggttctggtgggcgtcgtgatcctctatctgggtgcaatggtacaggccgactctgggtgtgtggtttcatggaagaataaagaacttaagtgcggaagtggcatattcattacagataacgtccacacctggactgagcagtacaagtttcagcccgaaagcccatccaaactggcttctgccatccaaaaggcacatgaggaaggtatttgtggcatccggtcggtgacacgcttggagaatctcatgtggaaacagataacccccgagctgaaccacatcttaagcgaaaatgaggtgaagctgactattatgaccggggacatcaaaggaattatgcaggccggcaagagatccctaaggcctcagccaacagaactcaaatattcatggaagacgtgggggaaggctaaaatgctgagtaccgagtctcataaccaaactttccttatcgatggaccggaaacagccgagtgccccaataccaaccgtgcatggaatagcttggaggtcgaagactacggctttggtgttttcacaactaacatatggctgaagctccgggagaaacaggacgtgttttgtgattccaagctgatgtcagcggctattaaagacaatcgagccgtgcacgcagatatggggtattggatcgaaagcgccttaaacgacacctggaagatggagaaggcttctttcatcgaggtaaaatcctgccactggcctaagagtcatacgctgtggagcaatggagtccttgaatctgagatgattatcccaaaaaacttcgccggccccgtgtcccagcacaactacagacctggttatcatacacagaccgcaggcccatggcacttggggaagctcgaaatggattttgacctgtgtgagggaactaccgttgtggtcacagaagattgcggcaatagggggccctcactacgcactaccacagctagtggaaaactgattacggagtggtgctgtcggagctgcaccctcccgcctctgagatacaggggcgaggacggttgttggtacgggatggaaatacgcccacttaaggagaaggaagagaacttggtgaattcgctggttactgccggacatggccaaatcgataacttctccttaggtgtgctcggcatggcgctgtttcttgaagagatgctgcgaacacggattgggaccaaacacgccatcttgctcgtagctgcatctttcgtcactctgattacaggaaatatgagctttcgtgacctaggcagagtgatggtgatggtcggggccaccatgacggatgacatcggaatgggcgttacttatctggctctcctggccgcattcaaggtgaggcccacctttgcggccggtcttttgctgcgcaaattaacatcaaaggagctcatgatggctaccatagggatcgccctgcttagtcagtccactattcctgaatctatcctggagctaacagatgcactcgctctgggaatgatggtattgaaaattgtgcggaacatggaaaagtaccagctggccgtcaccatcatggcaataagctgcgtgcccaatgccgttattttacaaaacgcttggaaggtgtcctgtacaatcctcgcggccgtctcagtgagcccactgcttctgactagttctcagcagaaagcagactggatccctttggctctcaccattaagggcctgaatcccacggccatattcctaacaaccctgtccagaactagcaaaaagaggtcgtggccacttaacgaggccgttatggctgtgggcatggtctcaatcctcgcatctagtctgttgaaaaatgacattccgatgaccgggcctctggtagccggaggtttactcacagtgtgctatgttctgactggccgatccgcggatcttgaactggagcgcgctgccgacgtgaagtgggaggatcaggcagaaatcagcgggtctagccccattttgtccatcaccatatcagaggacggaagtatgagcatcaaaaacgaagaggaggaacaaacgctcacaattctgatccggaccggcctactggtcatttctggtgtgtttccagtatccatccccataactgccgctgcatggtacctttgggaggtgaagaagcagagagccggggtcctctgggatgttccttcaccaccccctgtggaaaaagcggagctggaagacggagcttataggattaagcagcgtggcatcttgggctacagtcagatcggggccggagtgtataaagagggtacattccacaccatgtggcatgtcactcgcggcgcagtgttaatgcaccgggggaagagaattgagccgagctgggccgatgttaaaaaggacctgatctcctacggaggcggttggaagctcgaaggggagtggaaagaaggagaggaagtacaagtgctggctcttgagccaggcaagaatcccagggccgtccagacaaaacctggcatatttaagaccaacacggggactattggagcagtgtctctggatttctcgccaggtaccagcggctcacccatcgttgaccgaaaagggaaggtggtcggattgtacggcaatggtgtggtaacacggtccggggcttatgtcagtgccattgcgcagaccgagaagtctatcgaagataaccctgagatagaagacgatatttttcgcaaaaagagactaacaatcatggacctgcatccgggagccggcaaaactaagaggtacctccccgcaatcgtgcgggaggctattaaacgaggcctgagaacccttatcttagccccaacgcgcgttgtggctgcagaaatggaggaggccctgagggggctccctattcgttatcagacacccgccataaagactgaacacaccggacgggagatcgtcgacttgatgtgtcatgctacattcaccatgagactgctcagcccagtgagggttcctaactacaatctgattatcatggatgaagcgcacttcactgaccccgcatccatcgccgctcgcggttatatttcaacccgagtggagatgggcgaggccgcagggatatttatgacagccacgccaccgggatctagagatcctttcccccaaagcaacgctccaatcatggacgaagagcgggaaattcccgagaggagttggaattccggccacgaatgggtcactgattttaagggtaaaaccgtgtggttcgtacctagcatcaaggcggggaacgacattgccgcatgccttcgcaaaaatggaaagaaagtgatccagctgtctcgtaagacatttgattcagagtacgttaagaccagagctaacgactgggatttcgtcgtgactacagacatatccgagatgggcgccaattttaaagcagaacgggtgatcgatccaaggcgctgtatgaagcccgtcattttgaccgacggcgaggaacgagtaatcctagccgggcctatgccggtgacgcatagtagcgctgcccagagacggggaaggattggtcgcaacccaaaaaatgagaacgaccaatatatctacatgggcgaacccctggagaatgatgaggactgcgcgcactggaaggaagcaaaaatgctcttagataacataaatactcctgaggggattatcccctcgatgttcgaaccagagagagaaaaggttgacgccattgatggagagtacaggctgcggggcgaggctcgtaaaacatttgtggaccttatgcgccgaggtgatctgcctgtctggctcgcctataaggtggctgcagaagggatcaactacgccgacagaaagtggtgtttcgatggcataaaaaataaccagatcttggaggaaaacatggaggttgagatttggaccaaggaaggagagaggaaaaagctgaaaccccggtggctcgacgctcgcatctattctgatccactggcccttaaggaatttaaggagttcgcagcgggcagaaaatccctaaccctgaatttgattactgaaatggggaggttacctacattcatgacccagaaggcccggaacgctctggacaatctcgccgtgctgcatacagcagaggctggaggtcgagcctacaaccacgcacttagcgagctgccggaaactctcgagacgttgctgctactgaccctccttgccacagtcactggcgggatctttctgttcttaatgtcaggaaaaggcataggtaagatgaccttggggatgtgctgcattatcacagctagtatcctgctctggtatgcgcagattcaaccccactggatcgccgcatctataattctggaatttttccttatcgtgctgctcattccagagcctgaaaaacagagaaccccccaggataatcagttgacttacgtagtgatcgctatactgacggttgtcgccgccaccatggcaaacgagatgggctttttagagaagacaaagaaagacctaggactgggctccatcactacccaagaaagcgagtcaaatattctcgacatcgatcttcgcccagctagtgcctggacactgtatgcggtggctaccactttcgtgacacctatgttgaggcatagcattgaaaactcctctgtcaatgttagcctgacggccatcgcaaaccaggccaccgtgctcatggggctgggaaagggttggcccctttccaaaatggacattggcgtaccgctcctggctatcgggtgttactcacaggtgaatccaataactttgacagcagccctgttactactggtcgcgcactacgctattatcggacctggcctccaggccaaggcaacccgggaggcccaaaaacgtgctgccgcaggtatcatgaagaaccccaccgtggatgggattacagttatagaccttgaaccaatcccctatgatcctaagtttgagaaacagctgggccaggtgatgttgctgattctctgcgtcactcaggtactgatgatgagaacgacctgggctctttgtgaggccttaacactggcgactggaccgatctctaccctctgggaaggcaatcccgggaggttctggaacacaaccattgccgtgagtatggcaaatatctttcgcggatcgtacttggctggcgccggtctgctattcagcataatgaagaacactacgaatacacggcgagggaccggaaacatcggcgagactctgggtgaaaaatggaagtccagactcaacgcacttggcaaatctgagtttcaaatttataagaaatcagggatccaggaggttgacaggaccctggctaaggaaggaattaagcgcggcgagacagatcatcacgccgtgagccgggggtccgccaaattgagatggttcgtcgaacgtaatatggtgactccagagggaaaggtcgtggacctgggctgcggtagggggggatggagttactattgtggcggtctcaaagatgttcgggaagtgaagggcctgaccaaagggggacctggccatgaggagcccatccctatgtctacatacgggtggaacttagtacgccttcagagcggaatagacgtgtttttcacgccacccgaaaagtgcgataccctgctctgtgacattggcgagtcatcccctaatccaactatcgaagcgggtcgaacactaagagtcctgaacttggttgagaattggctgaacaataacacccaattctgcatcaaggtgctcaatccctatatgccgagtgtcattgaaaaaatggagactcttcagaggaagtacgggggagctctggtgcggaaccctttgagccgcaattctacacacgagatgtactgggtatccaacgcaaccggcaatatagtgtcaagcgttaacatgatctcgagaatgctgattaataggtttacgatgaaacacaagaaagccacctatgaaccagatgtggacctcggctctgggacacgaaacatcggaattgagagtgaaatccccaacttagacataatcggtaagcggattgagaagatcaaacaggaacatgagacttcctggcactacgatcaggaccatccttataagacctgggcttaccacggcagctatgagacaaaacaaactgggtcagcctcctctatggtcaatggagtggtccgtctgcttaccaagccatgggatgtggttcccatggtaacacagatggcaatgaccgacactacgccgttcggccagcagagagtgtttaaagaaaaggtcgatacacgcacccaagagcctaaggaaggtactaaaaagctgatgaaaattaccgccgagtggctatggaaggagctcgggaaaaagaaaacacccaggatgtgtacgcgggaagagttcaccagaaaggtgcgcagcaacgctgcgctgggagccatctttactgacgaaaataagtggaaaagtgcaagggaggctgttgaagatggccgattctgggagttggtggaccgggagagaaacctgcacctcgaaggcaagtgcgagacatgtgtctacaatatgatggggaaaagggaaaagaaacttggagagtttggtaaggccaagggctcccgcgcaatttggtatatgtggctgggggcccgtttcttagaatttgaggctctgggattcttgaacgaggatcattggtttagccggggcaattctctctcaggtgtggaaggggagggactgcacagactaggctacatacttagggacgtaggcaaaaaggaagggggagccatgtacgcggatgacaccgcaggttgggacactcgcatcacactggaggatctcaaaaacgaagagatggtgaccaatcatatgaagggcgagcacaaaaagctggccgaagctattttcaagttgacatatcagaacaaagttgtccgagtgcagcggccaactcctagagggaccgtgatggacatcatcagtaggcgcgatcagagaggatccggccaagtcggtacgtacgggctgaatacctttacaaacatggaggcccagctcattcggcagatggaaggagagggcatattcaagaatatccaacatcttactgcaaccgaggaaattgctgttcagaactggctggccagggtgggccgtgagcgattaagccgcatggctatctctggggacgattgcgtagtgaaacccattgacgatagattcgcctcggcactgacagcgttgaatgacatgggaaaggtccggaaagatatccagcagtgggaaccatcaaggggttggaacgactggactcaagtgcccttttgcagccaccacttccatgagctcgttatgaaggatggccgcgtgctggtcgtgccttgtagaaaccaggacgaactaatagggcgggccaggatctcccagggagctggctggagtcttaaggagaccgcctgcctgggtaaatcttatgcacagatgtggacgctcatgtactttcaccgacgtgatctgagattggctgccaatgcaatttgtagcgccgtaccatcccattgggttccgacatcacgcaccacttggagtatccacgcgaagcacgagtggatgacaaccgaagacatgttagctgtgtggaaccgggtctggattcaagagaatccctggatggaagacaaaactcctgtggagtcttgggaagaggtgccatatctggggaagagggaggatcagtggtgcggaagcctcatcggccttacctccagagccacatgggcaaaaaacatacagacggccattaatcaggtccgctcactgatcggcaacgaagagtacaccgactatatgcccagcatgaagcggttcaggaaggaagaggaagaggctggggttctatggtga

SEQ ID NO: 14463 - RNA, 9876 nt, synthetic construct
  misc_feature 1..9876: note = derived and/or modified CDS sequence (opt3) from DENV-2__GQ868516__SS-prME
  source 1..9876: mol_type = other RNA
accgccggcgtgatcgtcatgctgattcccacagttatggctttccacctcactacgagaaacggggagcctcatatgatagtgggaaggcaggaaaagggtaaaagccttctgtttaagaccgaggacggcgtaaatatgtgcacattgatggcaatcgatttaggggaactgtgtgaggacactattacctacaaatgcccactactccggcaaaacgaaccggaggatatcgactgttggtgcaattccacatctacctggattacttatggaacatgttcaaccacgggcgagcaccgccgagaaaagcgtagtgtggccctggtcccccatgtgggtatggggcttgagactagaaccgaaacatggatgagctccgagggagcgtggaaacacgttcagaggatcgagacttggatactgcggcatcctggcttcaccatcatggctgccattttggcatacacaatcggcaccacgcactttcagcgcgccctcattttcatcctgctgactgctgtggcaccatctatgacaatgagatgcatagggatttcgaacagggattttgtcgaaggagtgtcaggtggcagctgggtagacatcgttctcgagcacgggagttgtgtgaccactatggccaagaataagcccacattagatttcgaactgattaaaaccgaggctaagcagcctgccacgcttcggaaatattgcatcgaagcgaagttgaccaacacaactaccgagtcccgctgtccaacacaaggagagccctctctgaatgaagagcaggacaaacgatttatctgcaagcatagcatggtcgatagaggctggggtaacgggtgtggactattcggcaagggcgggattgtgacttgcgcaatgtttacctgcaaaaagaatatggaaggaaaagtggtccagcctgagaacctcgaatacacaatagttatcaccccacactccggtgaggagcatgccgtgggcaatgacactgggaagcacggaaaagaaattaagatcacgccgcagtcaagtataacagaggctgaactgaccggctatggtactgtaaccatggagtgtagccccaggacagggcttgatttcaacgaaatggtgctgttgcaaatggaggacaaagcctggctcgtccaccggcagtggtttctggatttacctctgccatggctccccggcgcagacacccagggatctaattggattcagaaggagactcttgtgacattcaagaaccctcatgctaaaaagcaagacgttgtggtcctgggctcccaggaaggggccatgcacacggcgttgaccggagccactgagatccagatgtcaagcggtaatctactgtttacaggccatctcaaatgccgtctgcgcatggataagcttcaactgaaagggatgagttactctatgtgtaccggaaagttcaagatcgtgaaagaaattgcagagacacagcacggcactatcgtaattagagttcagtatgagggtgacgggtccccatgcaagatacccttcgaaatcaccgatttggagaaaaggcatgtgctcggccggctgattacggtcaacccgatcgtgaccgaaaaggacagccctgtcaacatcgaggctgaacccccatttggagattcgtacattataatcggcgtggagcctgggcagttaaaactgaattggttcaagaagggatcttccattggtcaaatgtttgagacaactatgcgaggcgccaaacgcatggctatcctaggggacaccgcctgggatttcggatcactcggcggtgtttttacaagtattgggaaggcactgcaccaggtgttcggcgccatctacggagctgcgtttagcggcgtatcctggactatgaaaatacttatcggggtcattatcacctggattggaatgaactctagaagcacgtcattgagtgtgtccctggttctcgtgggcgtcgtgatcctgtatcttggtgcaatggtacaggccgacagcgggtgtgtggtttcttggaagaataaagaactgaagtgcggatcaggcatattcattacagataacgtccacacctggactgagcagtacaagtttcaacccgaaagtccaagcaaattggcttccgccatccagaaggcacatgaggaaggtatttgtggcatcaggtctgtgacacggctcgagaatctgatgtggaaacagataacccccgagttaaaccacatcctgtcggaaaatgaggtgaagctaactattatgaccggggacatcaaaggaattatgcaggccggcaagcgcagcctcagacctcaaccaacagaactgaaatattcctggaagacgtgggggaaggctaaaatgctttcaaccgagagtcataaccagactttcttgatcgatggaccggaaacagccgagtgccccaataccaacagggcatggaattctctggaggtcgaagactacggctttggtgttttcacaactaacatatggctcaagctgcgtgagaaacaggacgtgttttgtgatagcaagttaatgtccgcggctattaaagacaatcgggccgtgcacgcagatatggggtattggatcgaatcagccctgaacgacacctggaagatggagaaggctagcttcatcgaggtaaaatcttgccactggcctaagtcccatacgctttggagtaatggagtcttggaaagcgagatgattatcccaaaaaacttcgccggccccgtgtctcagcacaactaccgacctggttatcatacacaaaccgcaggcccatggcacctcgggaagctggaaatggattttgacctatgtgagggaactaccgttgtggtcacagaagattgcggcaatagagggccctccctgaggactaccacagcttcaggaaaactcattacggagtggtgctgtcgcagttgcaccctgccgcctcttcggtacagaggcgaggacggttgttggtacgggatggaaataaggccattgaaggagaaggaagagaacctggtgaatagcttagttactgccggacatggccagatcgataacttctcgctcggtgtgctgggcatggcgctttttctggaagagatgttgcgcacacgaattgggaccaaacacgccatcctcctggtagctgcatccttcgtcactctaattacaggaaatatgtcttttcgggacctgggccgtgtgatggtgatggtcggggccaccatgacggatgacatcggaatgggcgttacttatctcgctctgcttgccgcattcaaggtgagacccacctttgcggccggtttgctgttaaggaaactcacaagcaaggagctgatgatggctaccatagggatcgcccttctgtcacagagtactattcctgaatccatcctagagctcacagatgcactggctttgggaatgatggtactgaaaattgtgcgcaacatggaaaagtaccaattagccgtcaccatcatggcaatatcttgcgtgcccaatgccgttattctccagaacgcttggaaggtgagctgtacaatcctggcggccgtctccgtgtcaccacttctgttgactagcagtcagcagaaagcagactggatccctctcgctctgaccattaagggcctaaatcccacggccatattcctgacaaccctttctcggacttccaaaaagagaagctggccactcaacgaggccgttatggctgtgggcatggtctcgatcctggcatcatctttgctgaaaaatgacattccgatgaccgggcctttagtagccggaggtctcctgacagtgtgctatgttcttactggcaggagtgcggatctggaattggagcgagctgccgacgtgaagtgggaggatcaagcagaaatctccgggagctctcccattctcagcatcaccatatccgaggacggatcaatgagtatcaaaaacgaagaggaggaacagacgctgacaattctaatccgcaccggcctgcttgtcattagcggtgtgtttccagtatctatccccataactgccgctgcatggtacctctgggaggtgaagaagcagcgggccggggtcctgtgggatgttccttccccaccccctgtggaaaaagcggagttggaagacggagcttatagaattaagcagaggggcatcttaggctactcacaaatcggggccggagtgtataaagagggtacattccacaccatgtggcatgtcactcgtggcgcagtgctgatgcaccgcgggaagcggattgagccgagttgggccgatgttaaaaaggacctcatcagctacggaggcggttggaagctggaaggggagtggaaagaaggagaggaagtacaggtgcttgctctggagccaggcaagaatcccagagccgtccagacaaaacctggcatatttaagaccaacacggggactattggagcagtgtccttggatttctctccaggtacctcgggcagccccatcgttgacaggaaagggaaggtggtcggactatacggcaatggtgtggtaacacgatcaggggcttatgtctccgccattgcgcagaccgagaagagtatcgaagataaccctgagatagaagacgatatttttcggaaaaagcgcctgacaatcatggacctccatccgggagccggcaaaactaagagatacctgcccgcaatcgtgagggaggctattaaacggggccttcgaaccttaatcctggccccaacgagagttgtggctgcagaaatggaggaggccctccgcgggttgcctattaggtatcaaacacccgccataaagactgaacacaccggacgtgagatcgtcgacctgatgtgtcatgctacattcaccatgcggctcctgtctccagtgagagttcctaactacaatcttattatcatggatgaagcgcacttcactgaccccgcaagcatcgccgctaggggttatatttccacccgcgtggagatgggcgaggccgcagggatatttatgacagccacgccaccgggatcacgagatcctttcccccagtctaacgctccaatcatggacgaagagagagaaattcccgagcggagctggaatagtggccacgaatgggtcactgattttaagggtaaaaccgtgtggttcgtaccttccatcaaggcggggaacgacattgccgcatgcctgaggaaaaatggaaagaaagtgatccagttgagccgcaagacatttgattctgagtacgttaagacccgtgctaacgactgggatttcgtcgtgactacagacatatcagagatgggcgccaattttaaagcagaaagagtgatcgatccacggaggtgtatgaagcccgtcattctaaccgacggcgaggaacgcgtaatcctggccgggcctatgccggtgacgcattccagtgctgcccaacgaagaggacggattggtaggaacccaaaaaatgagaacgaccagtatatctacatgggcgaacccctcgagaatgatgaggactgcgcgcactggaaggaagcaaaaatgttactggataacataaatactcctgaggggattatccccagcatgttcgaaccagagcgcgaaaaggttgacgccattgatggagagtacagacttaggggcgaggctcggaaaacatttgtggacctgatgcgtcgcggtgatctccctgtctggttggcctataaggtggctgcagaagggatcaactacgccgaccgaaagtggtgtttcgatggcataaaaaataaccagatcctggaggaaaacatggaggttgagatttggaccaaggaaggagagagaaaaaagctcaaacccaggtggctggacgctcggatctattcggatccacttgccctaaaggaatttaaggagttcgcagcgggccgcaaatctctgaccttgaatttaattactgaaatggggagactgcctacattcatgacccagaaggccaggaacgctctcgacaatctggccgtgcttcatacagcagaggctggaggtcgggcctacaaccacgcactgtccgagctcccggaaactttggagacgctgctactgctcacccttctggccacagtcactggcgggatctttttattcttgatgagcggaaaaggcataggtaagatgaccctggggatgtgctgcattatcacagcttcaatcctcctgtggtatgcgcaaattcagccccactggatcgccgcaagtataattcttgaatttttcctgatcgtgctcttgattccagagcctgaaaaacagcgaaccccccaggataatcaactgacttacgtagtgatcgctatattaacggttgtcgccgccaccatggcaaacgagatgggctttctagagaagacaaagaaagacctgggactcggctctatcactacccaggaatccgagagcaatattcttgacatcgatctgagaccagcttcagcctggacattgtatgcggtggctaccactttcgtgacacctatgctgcgccatagtattgaaaacagctccgtcaatgtttctctcacggccatcgcaaaccaggccaccgtgctgatggggcttggaaagggttggcccctcagcaaaatggacattggcgtaccgctgttggctatcgggtgttactcccaggtgaatccaataactctgacagcagccttactactgctcgtcgcgcactacgctattatcggacctggccttcaagccaaggcaaccagggaggcccagaaacgggctgccgcaggtatcatgaagaaccccaccgtggatgggattacagttatagacctggaaccaatcccctatgatcctaagtttgagaaacagttgggccaggtgatgctgctcattctgtgcgtcactcaagtacttatgatgcgtacgacctgggctttatgtgaggccctgacactcgcgactggaccgatctcaaccttgtgggaaggcaatcccgggagattctggaacacaaccattgccgtgtctatggcaaatatctttaggggaagttacctggctggcgccggtctactgttctcgataatgaagaacactacgaatacacgccgggggaccggaaacatcggcgagactctcggtgaaaaatggaagagccgacttaacgcactgggcaaatccgagtttcagatttataagaaatctgggatccaggaggttgacagaaccttggctaaggaaggaattaagaggggcgagacagatcatcacgccgtgtcacgcgggagcgccaaactgcggtggttcgtcgaaagaaatatggtgactccagagggaaaggtcgtggacctcggctgcggtcgtgggggatggtcctactattgtggcggtctgaaagatgttagggaagtgaagggcttaaccaaagggggacctggccatgaggagcccatccctatgagtacatacgggtggaaccttgtacggctgcaatctggaatagacgtgtttttcacgccacccgaaaagtgcgataccctcctatgtgacattggcgagagctcacctaatccaactatcgaagcgggtcgcacactgcgagtcttgaacctggttgagaattggctcaacaataacacccagttctgcatcaaggtgcttaatccctatatgccgtccgtcattgaaaaaatggagactctgcagagaaagtacgggggagctttggtgaggaaccctctgagtcggaatagcacacacgagatgtactgggtatctaacgcaaccggcaatatagtgtcctcagttaacatgatcagccgcatgctcattaatagatttacgatgaaacacaagaaagccacctatgaaccagatgtggacttaggctcggggacaaggaacatcggaattgagtctgaaatccccaacctggacataatcggtaagcgaattgagaagatcaaacaggaacatgagactagttggcactacgatcaagaccatccttataagacctgggcttaccacggctcctatgagacaaaacagactgggagcgcctcatccatggtcaatggagtggtccggcttctgaccaagccatgggatgtggttcccatggtaacacagatggcaatgaccgacactacgccgttcggccagcaacgtgtgtttaaagaaaaggtcgatacaagaacccaggagcctaaggaaggtactaaaaagctaatgaaaattaccgccgagtggctctggaaggagctggggaaaaagaaaacaccccgcatgtgtacgagggaagagttcacccggaaggtgagatctaacgctgcgttgggagccatctttactgacgaaaataagtggaaaagcgcacgcgaggctgttgaagatggcaggttctgggagctggtggaccgagagcggaacctccaccttgaaggcaagtgcgagacatgtgtctacaatatgatggggaaaagagaaaagaaactgggagagtttggtaaggccaagggcagtagggcaatttggtatatgtggttaggggcccgcttcctggaatttgaggctttgggattcctcaacgaggatcattggttttcccgtggcaatagcctgtctggtgtggaaggggagggactacaccggcttggctacatactgagagacgtaggcaaaaaggaagggggagccatgtacgcggatgacaccgcaggttgggacactaggatcacactcgaggatctgaaaaacgaagagatggtgaccaatcatatgaagggcgagcacaaaaagttggccgaagctattttcaagctgacatatcagaacaaagttgtccgcgtgcagcgaccaactcctcgggggaccgtgatggacatcatctcaagaagggatcaacgcggaagtggccaggtcggtacgtacgggctcaatacctttacaaacatggaggcccagcttattagacaaatggaaggagagggcatattcaagaatatccagcatctgactgcaaccgaggaaattgctgttcagaactggttagcccgggtgggcagggagcgtctgtcccgaatggctatcagcggggacgattgcgtagtgaaacccattgacgatcgcttcgcctctgcattgacagcgctcaatgacatgggaaaggtcagaaaagatatccagcaatgggaaccatcgcggggttggaacgactggactcaggtgcccttttgctcacaccacttccatgagctggttatgaaggatggcagggtgctagtcgtgccttgtcgcaaccaggacgaacttatagggagagcccggatcagccagggagctggctggtccctgaaggagaccgcctgcctcggtaaaagttatgcacaaatgtggacgctgatgtactttcacaggcgagatttgcgtttagctgccaatgcaatttgttctgccgtaccaagccattgggttccgacatccagaaccacttggtcaatccacgcgaagcacgagtggatgacaaccgaagacatgctggctgtgtggaaccgcgtctggattcaggagaatccctggatggaagacaaaactcctgtggagagttgggaagaggtgccatatctcgggaagcgggaggatcagtggtgcggatctcttatcggcctgaccagcagggccacatgggcaaaaaacatacagacggccattaatcaagtcagatccctaatcggcaacgaagagtacaccgactatatgccctcaatgaagcgcttccggaaggaagaggaagaggctggggttctgtggtga

SEQ ID NO: 14464 - RNA, 9876 nt, synthetic construct
  misc_feature 1..9876: note = derived and/or modified CDS sequence (opt3) from DENV-2__GU131975__SS-prME
  source 1..9876: mol_type = other RNA
accgccggcgtgatcgtcatgctgattcccacagttatggctttccacctcactacgagaaacggggagcctcatatgatagtgggaaggcaggaaaagggtaaaagccttctgtttaagaccgaggacggcgtaaatatgtgcacattgatggcaatcgatttaggggaactgtgtgaggacactattacctacaaatgcccactactccggcaaaacgaaccggaggatatcgactgttggtgcaattccacatctacctggattacttatggaacatgttcaaccacgggcgagcaccgccgagaaaagcgtagtgtggccctggtcccccatgtgggtatggggcttgagactagaaccgaaacatggatgagctccgagggagcgtggaaacacgttcagaggatcgagacttggatactgcggcatcctggcttcaccatcatggctgccattttggcatacacaatcggcaccacgcactttcagcgcgccctcattttcatcctgctgactgctgtggcaccatctatgacaatgagatgcatagggatttcgaacagggattttgtcgaaggagtgtcaggtggcagctgggtagacatcgttctcgagcacgggagttgtgtgaccactatggccaagaataagcccacattagatttcgaactgattaaaaccgaggctaagcagcctgccacgcttcggaaatattgcatcgaagcgaagttgaccaacacaactaccgagtcccgctgtccaacacaaggagagccctctctgaatgaagagcaggacaaacgatttatctgcaagcatagcatggtcgatagaggctggggtaacgggtgtggactattcggcaagggcgggattgtgacttgcgcaatgtttacctgcaaaaagaatatggaaggaaaagtggtccagcctgagaacctcgaatacacaatagttatcaccccacactccggtgaggagcatgccgtgggcaatgacactgggaagcacggaaaagaaattaagatcacgccgcagtcaagtataacagaggctgaactgaccggctatggtactgtaaccatggagtgtagccccaggacagggcttgatttcaacgaaatggtgctgttgcaaatggaggacaaagcctggctcgtccaccggcagtggtttctggatttacctctgccatggctccccggcgcagacacccagggatctaattggattcagaaggagactcttgtgacattcaagaaccctcatgctaaaaagcaagacgttgtggtcctgggctcccaggaaggggccatgcacacggcgttgaccggagccactgagatccagatgtcaagcggtaatctactgtttacaggccatctcaaatgccgtctgcgcatggataagcttcaactgaaagggatgagttactctatgtgtaccggaaagttcaagatcgtgaaagaaattgcagagacacagcacggcactatcgtaattagagttcagtatgagggtgacgggtccccatgcaagatacccttcgaaatcaccgatttggagaaaaggcatgtgctcggccggctgattacggtcaacccgatcgtgaccgaaaaggacagccctgtcaacatcgaggctgaacccccatttggagattcgtacattataatcggcgtggagcctgggcagttaaaactgaattggttcaagaagggatcttccattggtcaaatgtttgagacaactatgcgaggcgccaaacgcatggctatcctaggggacaccgcctgggatttcggatcactcggcggtgtttttacaagtattgggaaggcactgcaccaggtgttcggcgccatctacggagctgcgtttagcggcgtatcctggactatgaaaatacttatcggggtcattatcacctggattggaatgaactctagaagcacgtcattgagtgtgtccctggttctcgtgggcgtcgtgatcctgtatcttggtgcaatggtacaggccgacagcgggtgtgtggtttcttggaagaataaagaactgaagtgcggatcaggcatattcattacagataacgtccacacctggactgagcagtacaagtttcaacccgaaagtccaagcaaattggcttccgccatccagaaggcacatgaggaaggtatttgtggcatcaggtctgtgacacggctcgagaatctgatgtggaaacagataacccccgagttaaaccacatcctgtcggaaaatgaggtgaagctaactattatgaccggggacatcaaaggaattatgcaggccggcaagcgcagcctcagacctcaaccaacagaactgaaatattcctggaagacgtgggggaaggctaaaatgctttcaaccgagagtcataaccagactttcttgatcgatggaccggaaacagccgagtgccccaataccaacagggcatggaattctctggaggtcgaagactacggctttggtgttttcacaactaacatatggctcaagctgcgtgagaaacaggacgtgttttgtgatagcaagttaatgtccgcggctattaaagacaatcgggccgtgcacgcagatatggggtattggatcgaatcagccctgaacgacacctggaagatggagaaggctagcttcatcgaggtaaaatcttgccactggcctaagtcccatacgctttggagtaatggagtcttggaaagcgagatgattatcccaaaaaacttcgccggccccgtgtctcagcacaactaccgacctggttatcatacacaaaccgcaggcccatggcacctcgggaagctggaaatggattttgacctatgtgagggaactaccgttgtggtcacagaagattgcggcaatagagggccctccctgaggactaccacagcttcaggaaaactcattacggagtggtgctgtcgcagttgcaccctgccgcctcttcggtacagaggcgaggacggttgttggtacgggatggaaataaggccattgaaggagaaggaagagaacctggtgaatagcttagttactgccggacatggccagatcgataacttctcgctcggtgtgctgggcatggcgctttttctggaagagatgttgcgcacacgaattgggaccaaacacgccatcctcctggtagctgcatccttcgtcactctaattacaggaaatatgtcttttcgggacctgggccgtgtgatggtgatggtcggggccaccatgacggatgacatcggaatgggcgttacttatctcgctctgcttgccgcattcaaggtgagacccacctttgcggccggtttgctgttaaggaaactcacaagcaaggagctgatgatggctaccatagggatcgcccttctgtcacagagtactattcctgaatccatcctagagctcacagatgcactggctttgggaatgatggtactgaaaattgtgcgcaacatggaaaagtaccaattagccgtcaccatcatggcaatatcttgcgtgcccaatgccgttattctccagaacgcttggaaggtgagctgtacaatcctggcggccgtctccgtgtcaccacttctgttgactagcagtcagcagaaagcagactggatccctctcgctctgaccattaagggcctaaatcccacggccatattcctgacaaccctttctcggacttccaaaaagagaagctggccactcaacgaggccgttatggctgtgggcatggtctcgatcctggcatcatctttgctgaaaaatgacattccgatgaccgggcctttagtagccggaggtctcctgacagtgtgctatgttcttactggcaggagtgcggatctggaattggagcgagctgccgacgtgaagtgggaggatcaagcagaaatctccgggagctctcccattctcagcatcaccatatccgaggacggatcaatgagtatcaaaaacgaagaggaggaacagacgctgacaattctaatccgcaccggcctgcttgtcattagcggtgtgtttccagtatctatccccataactgccgctgcatggtacctctgggaggtgaagaagcagcgggccggggtcctgtgggatgttccttccccaccccctgtggaaaaagcggagttggaagacggagcttatagaattaagcagaggggcatcttaggctactcacaaatcggggccggagtgtataaagagggtacattccacaccatgtggcatgtcactcgtggcgcagtgctgatgcaccgcgggaagcggattgagccgagttgggccgatgttaaaaaggacctcatcagctacggaggcggttggaagctggaaggggagtggaaagaaggagaggaagtacaggtgcttgctctggagccaggcaagaatcccagagccgtccagacaaaacctggcatatttaagaccaacacggggactattggagcagtgtccttggatttctctccaggtacctcgggcagccccatcgttgacaggaaagggaaggtggtcggactatacggcaatggtgtggtaacacgatcaggggcttatgtctccgccattgcgcagaccgagaagagtatcgaagataaccctgagatagaagacgatatttttcggaaaaagcgcctgacaatcatggacctccatccgggagccggcaaaactaagagatacctgcccgcaatcgtgagggaggctattaaacggggccttcgaaccttaatcctggccccaacgagagttgtggctgcagaaatggaggaggccctccgcgggttgcctattaggtatcaaacacccgccataaagactgaacacaccggacgtgagatcgtcgacctgatgtgtcatgctacattcaccatgcggctcctgtctccagtgagagttcctaactacaatcttattatcatggatgaagcgcacttcactgaccccgcaagcatcgccgctaggggttatatttccacccgcgtggagatgggcgaggccgcagggatatttatgacagccacgccaccgggatcacgagatcctttcccccagtctaacgctccaatcatggacgaagagagagaaattcccgagcggagctggaatagtggccacgaatgggtcactgattttaagggtaaaaccgtgtggttcgtaccttccatcaaggcggggaacgacattgccgcatgcctgaggaaaaatggaaagaaagtgatccagttgagccgcaagacatttgattctgagtacgttaagacccgtgctaacgactgggatttcgtcgtgactacagacatatcagagatgggcgccaattttaaagcagaaagagtgatcgatccacggaggtgtatgaagcccgtcattctaaccgacggcgaggaacgcgtaatcctggccgggcctatgccggtgacgcattccagtgctgcccaacgaagaggacggattggtaggaacccaaaaaatgagaacgaccagtatatctacatgggcgaacccctcgagaatgatgaggactgcgcgcactggaaggaagcaaaaatgttactggataacataaatactcctgaggggattatccccagcatgttcgaaccagagcgcgaaaaggttgacgccattgatggagagtacagacttaggggcgaggctcggaaaacatttgtggacctgatgcgtcgcggtgatctccctgtctggttggcctataaggtggctgcagaagggatcaactacgccgaccgaaagtggtgtttcgatggcataaaaaataaccagatcctggaggaaaacatggaggttgagatttggaccaaggaaggagagagaaaaaagctcaaacccaggtggctggacgctcggatctattcggatccacttgccctaaaggaatttaaggagttcgcagcgggccgcaaatctctgaccttgaatttaattactgaaatggggagactgcctacattcatgacccagaaggccaggaacgctctcgacaatctggccgtgcttcatacagcagaggctggaggtcgggcctacaaccacgcactgtccgagctcccggaaactttggagacgctgctactgctcacccttctggccacagtcactggcgggatctttttattcttgatgagcggaaaaggcataggtaagatgaccctggggatgtgctgcattatcacagcttcaatcctcctgtggtatgcgcaaattcagccccactggatcgccgcaagtataattcttgaatttttcctgatcgtgctcttgattccagagcctgaaaaacagcgaaccccccaggataatcaactgacttacgtagtgatcgctatattaacggttgtcgccgccaccatggcaaacgagatgggctttctagagaagacaaagaaagacctgggactcggctctatcactacccaggaatccgagagcaatattcttgacatcgatctgagaccagcttcagcctggacattgtatgcggtggctaccactttcgtgacacctatgctgcgccatagtattgaaaacagctccgtcaatgtttctctcacggccatcgcaaaccaggccaccgtgctgatggggcttggaaagggttggcccctcagcaaaatggacattggcgtaccgctgttggctatcgggtgttactcccaggtgaatccaataactctgacagcagccttactactgctcgtcgcgcactacgctattatcggacctggccttcaagccaaggcaaccagggaggcccagaaacgggctgccgcaggtatcatgaagaaccccaccgtggatgggattacagttatagacctggaaccaatcccctatgatcctaagtttgagaaacagttgggccaggtgatgctgctcattctgtgcgtcactcaagtacttatgatgcgtacgacctgggctttatgtgaggccctgacactcgcgactggaccgatctcaaccttgtgggaaggcaatcccgggagattctggaacacaaccattgccgtgtctatggcaaatatctttaggggaagttacctggctggcgccggtctactgttctcgataatgaagaacactacgaatacacgccgggggaccggaaacatcggcgagactctcggtgaaaaatggaagagccgacttaacgcactgggcaaatccgagtttcagatttataagaaatctgggatccaggaggttgacagaaccttggctaaggaaggaattaagaggggcgagacagatcatcacgccgtgtcacgcgggagcgccaaactgcggtggttcgtcgaaagaaatatggtgactccagagggaaaggtcgtggacctcggctgcggtcgtgggggatggtcctactattgtggcggtctgaaagatgttagggaagtgaagggcttaaccaaagggggacctggccatgaggagcccatccctatgagtacatacgggtggaaccttgtacggctgcaatctggaatagacgtgtttttcacgccacccgaaaagtgcgataccctcctatgtgacattggcgagagctcacctaatccaactatcgaagcgggtcgcacactgcgagtcttgaacctggttgagaattggctcaacaataacacccagttctgcatcaaggtgcttaatccctatatgccgtccgtcattgaaaaaatggagactctgcagagaaagtacgggggagctttggtgaggaaccctctgagtcggaatagcacacacgagatgtactgggtatctaacgcaaccggcaatatagtgtcctcagttaacatgatcagccgcatgctcattaatagatttacgatgaaacacaagaaagccacctatgaaccagatgtggacttaggctcggggacaaggaacatcggaattgagtctgaaatccccaacctggacataatcggtaagcgaattgagaagatcaaacaggaacatgagactagttggcactacgatcaagaccatccttataagacctgggcttaccacggctcctatgagacaaaacagactgggagcgcctcatccatggtcaatggagtggtccggcttctgaccaagccatgggatgtggttcccatggtaacacagatggcaatgaccgacactacgccgttcggccagcaacgtgtgtttaaagaaaaggtcgatacaagaacccaggagcctaaggaaggtactaaaaagctaatgaaaattaccgccgagtggctctggaaggagctggggaaaaagaaaacaccccgcatgtgtacgagggaagagttcacccggaaggtgagatctaacgctgcgttgggagccatctttactgacgaaaataagtggaaaagcgcacgcgaggctgttgaagatggcaggttctgggagctggtggaccgagagcggagtctccaccttgaaggcaagtgcgagacatgtgtctacaacatgatggggaaaagagaaaagaaactgggagagtttggtaaggccaagggctccagggcaatttggtatatgtggttaggggcccgcttcctggaatttgaggctttgggattcctcaatgaggatcattggtttagccgtggcaactctctgtcaggtgtggaaggggagggactacaccggcttggctacatactgagagacgtaggcaaaaaggaagggggagccatgtacgcggatgacaccgcaggttgggacactaggatcacactcgaggatctgaaaaatgaagagatggtgaccaaccatatgaagggcgagcacaaaaagttggccgaagctattttcaagctgacatatcagaataaagttgtccgcgtgcagcgaccaactcctcgggggaccgtgatggacatcatcagtagaagggatcaacgcggatccggccaggtcggtacgtacgggctcaacacctttacaaatatggaggcccagcttattagacaaatggaaggagagggcatattcaagaacatccagcatctgactgcaaccgaggaaattgctgttcagaattggttagcccgggtgggcagggagcgtctgagccgaatggctatctctggggacgattgcgtagtgaaacccattgacgatcgcttcgcctcggcattgacagcgctcaacgacatgggaaaggtcagaaaagatatccagcaatgggaaccatcacggggttggaatgactggactcaggtgcccttttgcagccaccacttccatgagctggttatgaaggatggcagggtgctagtcgtgccttgtcgcaaccaggacgaacttatagggagagcccggatctcccagggagctggctggagtctgaaggagaccgcctgcctcggtaaatcttatgcacaaatgtggacgctgatgtactttcacaggcgagatttgcgtttagctgccaacgcaatttgtagcgccgtaccatcccattgggttccgacatcaagaaccacttggagtatccacgcgaagcacgagtggatgacaaccgaagacatgctggctgtgtggaatcgcgtctggattcaggagaacccctggatggaagacaaaactcctgtggagtcttgggaagaggtgccatatctcgggaagcgggaggatcagtggtgcggaagccttatcggcctgacctccagggccacatgggcaaaaaatatacagacggccattaaccaagtcagatcactaatcggcaatgaagagtacaccgactatatgcccagcatgaagcgcttccggaaggaagaggaagaggctggggttctgtggtga

SEQ ID NO: 14465 - RNA, 9876 nt, synthetic construct
  misc_feature 1..9876: note = derived and/or modified CDS sequence (opt3) from DENV-2__JN819422__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagaaggctctcatcttcattctgctgacagcagtggccccatccatgaccatgcgctgcatcgggatatctaacagagattttgtcgaaggagtgtcgggtggctcatgggtagacattgttctcgagcacgggagctgtgtgactacaatggctaagaataaacccaccttagatttcgaactgatcaagacggaggccaaacagcctgcgacccttaggaagtattgcattgaagcaaaattgacaaacactaccacagagagtcggtgtccaactcaaggagagccctccctgaatgaagagcaggacaagcgctttatctgcaagcattctatggtcgatcgaggctggggtaacgggtgtggactattcggcaaaggcgggatcgtgacctgcgccatgtttacatgcaagaaaaatatggaaggaaaggtggtccagcctgagaacctcgaatacaccattgttataactccacacagcggtgaggagcatgctgtgggcaatgacacggggaaacacggaaaggaaatcaaaattacaccgcagtcctcaatcaccgaggccgaactgactggctatggtaccgtaacaatggagtgtagtcccagaaccgggcttgatttcaacgaaatggtgctgttgcaaatggaggacaaggcatggctcgtccacaggcagtggtttctggatttacctctgccatggctccccggcgctgacactcagggaagcaattggatacagaaggagacacttgtgacgttcaaaaaccctcatgccaagaaacaagacgttgtggtcctgggctctcaggaaggggcgatgcacaccgccttgactggagcaacagagattcagatgtcctcaggtaatctactgtttaccggccatctcaagtgccggctgcgtatggataaacttcaactgaaggggatgagctacagtatgtgtacaggaaagttcaaaatcgtgaaggaaatcgctgagactcagcacggcaccattgtaatccgcgttcagtatgagggtgacgggtctccatgcaaaattcccttcgaaataacggatttggagaagagacatgtgctcggcaggctgatcaccgtcaacccgattgtgacagaaaaagactcccctgtcaacatcgaggccgaacccccatttggagatagctacatcattataggcgtggagcctgggcagttaaagctgaattggttcaagaaaggatcgtctatcggtcaaatgtttgagactaccatgcggggcgctaagcgaatggccattctaggggacacagcatgggatttcggatccctcggcggtgtttttacttcaatcgggaaagccctgcaccaggtgttcggcgctatttacggagcggcatttagtggcgtaagctggaccatgaagatccttataggggtcatcattacgtggatcggaatgaactcccgctctacaagcttgtcagtgagtctggttctcgtgggcgtcgtgaccctgtatcttggtgccatggtacaggctgactccgggtgtgtggttagctggaaaaataaggaactgaagtgcggatctggcattttcatcactgataacgtccacacatggaccgagcagtacaaatttcaacccgaatcaccaagtaagttggccagcgcaatacagaaagcccatgaggaaggtatttgtggcatcagatccgtgactaggctcgagaatctgatgtggaagcagattacccccgagttaaaccacatcctgtctgaaaatgaggtgaaactaacaataatgacgggggacatcaagggaattatgcaggctggcaaacggtcgctccgccctcaaccaaccgaactgaagtatagctggaagacttgggggaaagccaagatgctttccacagagtcacataaccagaccttcttgatcgatggaccggaaacagcagagtgccccaatactaacagagcgtggaatagtctggaggtcgaagactacggctttggtgttttcaccacgaacatttggctcaaactgagggagaagcaggacgtgttttgtgattctaaattaatgagcgctgccatcaaggacaatcgtgcagtgcacgccgatatggggtattggatagaatccgctctgaacgacacatggaagatggagaaagcctcattcattgaggtaaagagctgccactggcctaaatctcataccctttggtccaatggagtcttggaaagtgagatgatcatcccaaagaacttcgcaggccccgtgagccagcacaactaccggcctggttatcatactcaaaccgctggcccatggcacctcgggaaactggaaatggattttgacctatgtgagggaacaactgttgtggtcaccgaagattgcggcaatcgagggccctctctgagaacaacgaccgcctccggaaagctcattactgagtggtgctgtaggtcatgcacactgccgcctcttcgctaccggggcgaggacggttgttggtacgggatggaaatcagaccattgaaggagaaagaagagaacctggtgaatagtttagttaccgcgggacatggccagattgataacttcagcctcggtgtgctgggcatggccctttttctggaagagatgttgaggactcgcatagggacaaagcacgctatcctcctggtagcagtctcgttcgtgaccctaattacgggaaatatgtcctttcgagacctgggccgggtgatggtcatggttggggccactatgaccgatgacatcggaatgggcgtgacatatctcgctctgcttgccgcattcaaagtacgtcccacctttgcggccggtttgctgttaagaaagctcacttctaaagagctgatgatggctacaattgggatcgcccttctgagccagtcaaccatacctgaaacaatcctagagctcactgatgcactggctttgggaatgatggtgctgaagattgtcaggaacatggaaaagtaccaattagccgtgaccatcatggcaattagttgcgttcccaatgccgtgatcctccagaacgcttggaaagtctcctgtacgatactggcggccgtgtctgttagcccacttctgttgacatcctcacagcagaaggcagactggattcctctcgctctgaccatcaaaggcctaaatcccactgccatcttcctgaccacacttagccgcactagtaagaaacggtcttggccactcaacgaggccattatggctgtgggcatggtctccatactggcaagctcgttgctgaagaatgacatcccgatgaccgggcctttagtagccggaggtctcctgacggtgtgctatgttcttacaggcagatcagcggatctggaattggagagggctgccgacgtgaaatgggaggatcaagcagaaatttctgggagttcccccatcctcagcattaccatctctgaggacggaagcatgtccataaagaacgaagaggaggaacagactctgacaatcctaattcgaaccggcctgcttgtcatctcaggtgtgtttccagtaagtattcccatcactgccgctgcatggtacctctgggaggtgaagaaacagcgcgccggggtcctgtgggatgttcctagcccaccccctgtggaaaaggcggagttggaagacggagcttatcggataaaacagagaggcattttaggctactctcaaatcggggccggagtgtataaggagggtacattccacaccatgtggcatgtcacgaggggcgcagtgctgatgcaccgtgggaaacgcatcgagccgtcctgggccgatgttaagaaggacctcatttcatacggaggcggttggaaactggaaggggagtggaaggaaggagaggaagtacaggtgcttgctctggagccaggcaaaaatccccgggccgtccagactaagcctggcatctttaaaaccaacacagggaccataggagcagtgagtttggatttcagcccaggtacatccggctctcccattgttgacagaaaggggaaggtggtcggactatacggcaatggtgtggtaactaggtcgggggcttatgtcagcgccatcgcgcagaccgagaaatcaattgaagataaccctgagatcgaagacgatatatttcgaaagaaacggctgacgattatggacctccatccgggagccggcaagacaaaacgctacctgcccgcaatcgtgagagaggctatcaagaggggccttcggactttaattctggccccaacccgagttgtggctgcagaaatggaggaggccctcagagggttgcctatccgctatcaaacacccgccattaagacccagcacactggaagggaaatagtcgacctgatgtgtcatgctaccttcacaatgcgtctcctgtccccagtgcgggttcctaactacaatcttatcattatggatgaggcgcacttcacggaccccgcaagtatcgccgctagaggttatatctctactagggtggaaatgggcgaggccgcagggatttttatgaccgccacaccaccgggaagccgcgatcctttcccccagtccaacgctccaataatggacgaggaacgagagatccccgaaagatcatggaattctggccacgagtgggtcaccgattttaaaggtaagactgtgtggttcgtacctagcattaaagcggggaacgacatcgccgcatgcctgcggaagaatggaaaaaaggtgattcaattgagtaggaagacatttgattccgaatacgttaaaacccgcgctaacgactgggatttcgtcgtgacgactgacatcagcgagatgggcgccaattttaaggcagagcgtgtgatagatccaagacggtgtatgaaacccgtcatcctaacagacggcgaagagagggtaattctggccgggcctatgccggtgacccattcttcagctgcccagcgccgaggaagaatcggtcggaacccaaagaatgaaaacgaccagtatatttacatgggcgagcccctcgaaaatgatgaggactgcgcgcactggaaagaggcaaagatgttactggataacatcaatacccctgaagggataattccctccatgttcgagccagaaagggagaaagttgacgccatcgatggagaataccgccttagaggcgaggctaggaagacttttgtggacctgatgcggcgtggtgatctccctgtctggttggcctataaggtggctgcagaggggattaactacgccgaccgcaaatggtgtttcgatggcatcaagaataaccagatactggaagagaacatcgaagttgagatttggacaaaagagggagaacgaaagaaactcaagcccagatggctggacgctaggatctatagtgatccacttgccctaaaggagtttaaagaattcgcagcgggccggaagagcctgaccttgaatttaattacagagatggggcgcctgcctactttcatgacgcaaaaagccagaaacgctctcgacaatctggccgtgcttcataccgcagaagctggaggtagggcctacaaccacgcactgtcggagctcccggagacattggaaactctgctactgctcacccttctggccacagtcaccggcgggatctttttattcttgatgtctggaaagggcgtgggtaaaatgactctggggatgtgctgcataattacggcttccatcctcctgtggtatgcgcagatccagccccactggattgccgcaagcatcatacttgagtttttcctgattgtactcttgatcccagaacctgagaagcagcggaccccccaagataatcagctgacatacgtggttattgctatcttaactgtcgtggccgccaccatggcaaacgaaatgggctttctagagaagacaaaaaaggacctgggactcggctcaataaccactcaggagagtgaatctaatatccttgacattgatctgcgaccagcttccgcctggacattgtatgcggtggctacgaccttcgtcactcctatgctgagacatagcatcgagaactcaagtgttaatgtgagcctcacagccattgcaaaccaggccaccgtactgatggggcttggaaaaggttggcccctctccaagatggacatcggcgtgccgctgttggctattgggtgttactctcaagtcaatccaatcaccctgacagcagccttactactgctcgtggcgcactacgctataattggacctggccttcaggccaaagcaactcgcgaagcccagaagagggctgccgcaggtatcatgaagaaccccacggttgatgggatcaccgtgattgacctggagccaataccctatgatcctaaatttgaaaagcagttgggccaagtcatgctgctcatcctgtgcgtaacacaggtgcttatgatgcggactacctgggctttatgtgaggccctgacactcgcgaccggaccgattagcactttgtgggagggcaatcccgggcgtttctggaacacgacaatcgccgtttccatggcaaatatttttagaggatcatacctggctggcgccggtctactgttctctatcatgaaaaacaccactaataccaggcgcgggacaggaaacataggcgaaactctcggtgagaagtggaaaagtcggcttaacgcactgggcaagtcggaatttcaggtgtataaaaagagcgggatccaagaggtcgaccgaaccttggctaaggagggaattaaaagaggcgaaacagatcatcacgccgtgtccagggggtctgccaagctgcgctggttcgtcgagcggaatatggtgacgccagaaggaaaagttgtggacctcggctgcggtagagggggatggtcatactattgtggcggtctgaagaacgtacgtgaggtgaaaggcttaaccaaggggggacctggccatgaagagcccatccctatgagcacttacgggtggaatcttgtcaggctgcagtccggagttgatgtgtttttcacaccacccgagaagtgcgacaccctcctatgtgatattggcgaaagttctcctaacccaactatcgaggcgggtcggacactgcgcgtcttgaatctggtggaaaactggctcaataacaatacccagttctgcataaaagtacttaacccctatatgccgagcgtgattgagaagatggaagctctgcagcgaaaatacgggggagcattggttagaaatcctctgtcaaggaactccacgcacgagatgtactgggtgagtaatgccaccggcaacatcgtcagctctgtgaatatgatctcccggatgctcattaaccgctttacaatgaagcacaaaaaggctacttatgagccagacgtcgatttaggctcagggaccagaaacataggaatcgaaagcgagattcccaatctggacatcattggtaagaggatcgaaaaaataaagcaagagcatgaaacatcgtggcactacgaccaggatcatccttataaaacttgggcctaccacggctcttatgagaccaagcagacagggagtgcatccagcatggtgaacggagttgtacgacttctgaccaaaccatgggacgtggtccccatggtgactcagatggccatgacggatacaaccccgttcggccaacagcgggtttttaaggagaaggtggacactcgtacccaggaacctaaagagggtacaaagaaactaatgaagatcacggctgaatggctctggaaagagctggggaagaaaaagacccccagaatgtgtactcgcgaggaattcacaaggaaggtccggtcaaatgcggccttgggagcaatttttaccgatgagaacaaatggaagtccgctagagaagccgtggaggacggccgcttctgggaactggtagatagggagcgaaatctccaccttgagggcaaatgcgaaacttgtgtgtacaacatgatggggaagcgggagaaaaagctgggagaatttggtaaggcaaaaggctctagagccatctggtatatgtggttaggggctaggttcctggagtttgaagccttgggattcctcaatgaggaccattggtttagccgcggcaacagtctgtccggtgttgagggggaaggactacaccgtcttggctacattctgcgggatgtcggcaagaaagaggggggagcgatgtacgcagacgatacagccggttgggacaccagaatcacactcgaagacctgaagaatgaggaaatggtgactaaccatatgaaaggcgagcacaagaagttggctgaggccattttcaaactgacctatcagaataaggtggtcagggttcaacgcccaacgcctcgagggaccgtgatggatataatcagccggagagaccagaggggatctggccaggtaggtacatacgggctcaacacttttaccaatatggaagcacaacttattcgccagatggagggagaaggcatcttcaaatcaatccagcatctgacagctactgaggagattgccgtgcagaactggttagctagagtcggccgggaaaggctgagtcgtatggccatatccggggatgactgcgtggttaagcccatcgatgaccgattcgcaagcgcgttgaccgccctcaatgatatgggaaaagtgcgcaaggacattcaacagtgggagccatctagaggttggaacgattggacgcaggtccccttttgctcgcaccacttccatgaactggtgatgaaggacggccgggtactagttgtgccttgtaggaaccaggatgagcttatcgggcgcgctagaatttcacaaggagccggctggagcctgaaagaaacagcatgcctcggtaagtcctatgctcagatgtggaccctgatgtactttcaccggagggacttgcgattagccgcaaatgccatctgtagtgcggtcccaccgcattgggtgcccacttctcgtacaacctggagcatacacgctaaacacgagtggatgactaccgaggatatgctggccgtgtggaacagagtctggatccaggaaaatccttggatggaggacaagacaccagttgaatcctgggaggaagtgccctatctcgggaaacgcgaggaccagtggtgcggatcacttattggcctgacgagtcgggcaacctgggccaagaacatccaaactgctattaatcaggtaaggtctctaatcggcaacgaggaatacacagattatatgcctagcatgaagagattccgccgggaggaagaggaagccggggtgctgtggtga

SEQ ID NO: 14466 - RNA, 9876 nt, synthetic construct
  misc_feature 1..9876: note = derived and/or modified CDS sequence (opt3) from DENV-2__GU131955__SS-prME
  source 1..9876: mol_type = other RNA
accgcaggcgtgatcgtaatgctgattccaacagttatggctttccacctcactacgagaaacggggagcctcatatgatagtgggaagacaggaaaagggtaaaagccttctgtttaagaccgaggacggcgtaaatatgtgcacattgatggcaatcgatttaggggaactgtgtgaggacactattacctacaaatgcccactactccggcaaaacgaaccggaggatatcgactgttggtgcaattccacatctacctgggtgacttatggaacatgttcaaccacgggcgagcaccgccgagaaaagcgtagtgtcgccctggtgccccatgttggtatggggcttgagactagaaccgaaacatggatgagctccgagggagcgtggaaacacgtgcagaggattgagacttggatcctgcggcatcctggcttcaccataatggctgccatcttggcatacacaattggcaccacgcactttcagcgcgccctcatcttcattctgctgactgctgtcgcaccatctatgacaatgagatgcatcgggatatcgaacagggattttgtggaaggagtatcaggtggcagctgggttgacattgtgctcgagcacgggagttgtgtcaccactatggccaagaataagcccacattagatttcgaactgatcaaaaccgaggctaagcagcctgccacgcttcggaaatattgcattgaagcgaagttgaccaacacaactaccgagtcccgctgtccaacacaaggagagccctctctgaatgaagaacaggacaaacgatttatctgcaagcatagcatggtggatagaggctggggtaacgggtgtggactattcggcaagggcgggatcgtgacttgcgcaatgtttacctgcaaaaagaatatggaaggaaaagtcgttcagcctgagaacctcgaatacacaattgtgataaccccacactccggtgaggagcatgccgtaggcaatgacactgggaagcacggaaaagaaatcaagattacgccgcagtcaagtatcacagaggctgaactgaccggctatggtactgtgaccatggagtgtagccccaggacagggcttgatttcaacgaaatggtcctgttgcaaatggaggacaaagcctggctcgtgcaccggcagtggtttctggatttacctctgccatggctccccggcgcagacacccagggatctaattggatacagaaggagactcttgttacattcaagaaccctcatgctaaaaagcaagacgtggtcgtgctgggctcccaggaaggggccatgcacacggcgttgaccggagccactgagattcagatgtcaagcggtaatctactgtttacaggccatctcaaatgccgtctgcgcatggataaacttcaactgaaagggatgagttactctatgtgtaccggaaagttcaagatcgtaaaagaaatcgcagagacacagcacggcactattgttatcagagtgcagtatgagggtgacgggtccccatgcaagattcccttcgaaataaccgatttggagaaaaggcatgtcctcggccggctgatcacggtgaacccgattgtcaccgaaaaggacagccctgtgaacatcgaggctgaacccccatttggagattcgtacatcattataggcgttgagcctgggcagttaaaactgaattggttcaagaagggatcttccatcggtcaaatgtttgagacaactatgcgaggcgccaaacgcatggctattctaggggacaccgcctgggatttcggatcactcggcggtgtgtttacaagtatcgggaaggcactgcaccaggtattcggcgccatttacggagctgcgtttagcggcgtctcctggactatgaaaatccttataggggtgatcattacctggatcggaatgaactctagaagcacgtcattgagtgtttccctggtgctcgtcggcgtggtaacactgtatcttggtgcaatggtgcaggccgacagcgggtgtgttgtctcttggaagaataaagaactgaagtgcggatcaggcattttcatcaccgataacgtgcacacttggacagagcagtacaagtttcaacccgaaagtccaagcaaattggcttccgccatacagaaggcacatgaggaaggtatttgtggcatcaggtctgtgacccggctcgagaatctgatgtggaaacagattactcccgagttaaaccacatcctgtcggaaaatgaggtcaagctaaccataatgacaggggacatcaaaggaattatgcaggccggcaagcgcagcctcagacctcaaccaacggaactgaaatattcctggaagacctgggggaaggctaaaatgctttcaactgagagtcataaccagacattcttgatcgatggaccggaaaccgccgagtgccccaatacaaacagggcatggaactctctggaggttgaagactacggctttggtgtgttcactaccaacatttggctcaagctgcgtgagaaacaggacgtgttttgtgatagcaagttaatgtccgcggctatcaaagacaatcgggccgtacacgcagatatggggtattggatagaatcagccctgaacgacacgtggaagatggagaaggctagcttcattgaggtcaaatcttgccactggcctaagtcccatacactttggagtaatggagtgttggaaagcgagatgatcatccccaagaatttcgccggccccgtttctcagcacaactaccgacctggttatcatacccaaactgcaggcccatggcacctcgggaagctggaaatggattttgacctatgtgagggaaccacagtggtcgtgactgaagattgcggcaatagagggccctccctgaggaccacaacggcttcaggaaaactcattaccgagtggtgctgtcgcagttgcactctgccgcctcttcggtacagaggcgaggacggttgttggtacgggatggaaatcaggccattgaaggagaaggaagagaacctggttaatagcttagtgacagccggacatggccagattgataacttctcgctcggtgtactgggcatggcgctttttctggaagagatgttgcgcacccgaatagggactaaacacgccatcctcctggtcgctgcatccttcgtgacactaattaccggaaatatgtcttttcgggacctgggccgtgtgatggtcatggttggggccacgatgactgatgacatcggaatgggcgtgacctatctcgctctgcttgccgcattcaaggtaagacccacatttgcggccggtttgctgttaaggaaactcaccagcaaggagctgatgatggctactattgggatcgcccttctgtcacagagtacaatacctgaaaccatcctagagctcacagatgcactggctttgggaatgatggtgctgaaaattgtccgcaacatggaaaagtaccaattagccgtgactatcatggcaatttcctgcgttcccaatgccgtgatcctccagaacgcttggaaggtctcttgtaccatactggcggccgtgagcgtttccccacttctgttgacgtcaagccagcagaaagcagactggattcctctcgctctgacaatcaagggcctaaatcccaccgccatcttcctgactacccttagtcggacatctaaaaagagatcctggccactcaacgaggccgtgatggctgtcggcatggtaagcattctggcatcgtcattgctgaaaaatgacataccgatgactgggcctttagtggccggaggtctcctgaccgtttgctatgtgcttacgggcaggtctgcggatctggaattggagcgagctgccgacgtcaagtgggaggatcaagcagaaatcagtgggtccagccccattctctctatcacaattagcgaggacggatccatgtcaatcaaaaacgaagaggaggaacagaccctgactatactaatccgcacaggcctgcttgtgattagtggtgtatttccagtgagcatccccattaccgccgctgcatggtacctctgggaggtcaagaagcagcgggccggggttctgtgggatgtgccttctccaccccctgtggaaaaagcggagttggaagacggagcttatagaatcaagcagaggggcatattaggctactcccaaattggggccggagtctataaagagggtactttccacacaatgtggcatgtgacccgtggcgcagttctgatgcaccgcgggaagcggatcgagccgtcatgggccgatgtcaaaaaggacctcatcagttacggaggcggttggaagctggaaggggagtggaaagaaggagaggaagtgcaggtccttgctctggagccaggcaagaatcccagagccgtgcagacgaaacctggcatttttaagactaacaccgggacaatcggagcagttagcttggatttctccccaggtacctctggctcgcccatagtggacaggaaagggaaggtcgtgggactatacggcaatggtgtagtcacacgaagcggggcttatgtgtcagccattgcgcagactgagaagtccatcgaagataaccctgagattgaagacgatatctttcggaaaaagcgcctgaccataatggacctccatccgggagccggcaaaacgaagagatacctgcccgcaattgttagggaggctatcaaacggggccttcgaacattaatcctggccccaactagagtggtcgctgcagaaatggaggaggccctccgcgggttgcctattaggtatcaaacccccgccatcaagacagaacacaccggacgtgagattgtggacctgatgtgtcatgctactttcaccatgcggctcctgagtccagttagagtgcctaactacaatcttataatcatggatgaagcgcacttcacagaccccgcatctattgccgctaggggttatatcagcacgcgcgtcgagatgggcgaggccgcagggatctttatgactgccaccccaccgggatcccgagatcctttcccccagtcaaacgctccaattatggacgaagagagagaaatacccgagcggtcttggaatagcggccacgaatgggtgacagattttaagggtaaaaccgtatggttcgtgcctagtatcaaggcggggaacgacattgccgcatgcctgaggaaaaatggaaagaaagttatccagttgtcccgcaagacttttgatagcgagtacgtcaagacacgtgctaacgactgggatttcgtggtgaccacggacatttctgagatgggcgccaattttaaagcagaaagagtcatcgatccacggaggtgtatgaagcccgtaatactaactgacggcgaggaacgcgtgatcctggccgggcctatgccggttacacattcatccgctgcccaacgaagaggacggattggtaggaaccccaaaaatgagaacgaccagtatatctacatgggcgaacccctcgagaatgatgaggactgcgcgcactggaaggaagcaaaaatgttactggataacattaatacccctgaggggatcatacccagtatgttcgaaccagagcgcgaaaaggtggacgccattgatggagagtacagacttaggggcgaggctcggaaaacctttgtcgacctgatgcgtcgcggtgatctccctgtgtggttggcctataaggttgctgcagaagggatcaactacgccgaccgaaagtggtgtttcgatggcattaaaaataaccagatcctggaggaaaacatggaggtggagatatggactaaggaaggagagaggaaaaagctcaaacccaggtggctggacgctcggatctatagcgatccacttgccctaaaggaatttaaggagttcgcagcgggccgcaaatcgctgacattgaatttaattaccgaaatggggagactgcctacattcatgactcagaaggccaggaacgctctcgacaatctggccgtccttcatacggcagaggctggaggtcgggcctacaaccacgcactgtctgagctcccggaaaccttggagacactgctactgctcactcttctggccaccgtgacaggcgggatctttttattcttgatgtccggaaaaggcattggtaagatgaccctggggatgtgctgcatcataactgctagcattctcctgtggtatgcgcaaatccagccccactggatcgccgcatcaattatccttgaatttttcctgatagtactcttgattccagagcctgaaaaacagcgaacgccccaggataatcaactgacctacgtggttatcgctattttaacagtcgtggccgccactatggcaaacgagatgggctttctagagaagaccaagaaagacctgggactcggcagtatcacaacccaggaatctgagtccaatatacttgacatcgatctgagaccagctagcgcctggactttgtatgcggtggctacaacgttcgtcacccctatgctgcgccattcaattgaaaacagtagcgttaatgtgtccctcactgccatcgcaaaccaggccacagtactgatggggcttggaaagggttggcccctctctaaaatggacattggcgtgccgctgttggctatcgggtgttacagccaggtcaatccaattaccctgaccgcagccttactactgctcgtggcgcactacgctatcataggacctggccttcaagccaaggcaacaagggaggcccagaaacgggctgccgcaggtattatgaagaaccccactgttgatgggatcacggtgatcgacctggaaccaattccctatgatcctaagtttgagaaacagttgggccaggtcatgctgctcatactgtgcgtaacccaagtgcttatgatgcgtacaacttgggctttatgtgaggccctgaccctcgcgacaggaccgatctccaccttgtgggaaggcaatcccgggagattctggaacactacgattgccgtttcaatggcaaatatctttaggggatcttacctggctggcgccggtctactgttcagtattatgaagaacacaaccaatactcgccgggggaccggaaacatcggcgagacactcggtgaaaaatggaagtcgcgacttaacgcactgggcaaaagcgagtttcagatatataagaaatccgggatccaggaggtggacagaactttggctaaggaaggaattaagaggggcgagaccgatcatcacgccgtctctcgcgggtcagccaaactgcggtggttcgtggaaagaaatatggtcacaccagagggaaaggtggttgacctcggctgcggtcgtgggggatggagctactattgtggcggtctgaaagatgtgagggaagtaaagggcttaacgaaagggggacctggccatgaggagcccatccctatgtccacctacgggtggaaccttgtgcggctgcaaagtggaattgacgtctttttcactccacccgaaaagtgcgatacactcctatgtgacatcggcgagtctagccctaatccaaccatagaagcgggtcgcactctgcgagttttgaacctggtggagaattggctcaacaataacacacagttctgcattaaggtccttaatccctatatgccgtcagtgatcgagaaaatggagaccctgcagagaaagtacgggggagctttggtaaggaaccctctgtcccggaatagtacgcacgagatgtactgggtgagcaacgcaaccggcaatatcgtttcttccgtgaacatgatttcacgcatgctcataaatagatttacaatgaaacacaagaaagccacttatgaaccagatgtcgacttaggcagcgggaccaggaacatcggaattgagtcggaaatccccaacctggacattatcggtaagcgaatagagaagatcaaacaggaacatgagacatcttggcactacgatcaagaccatccttataagacttgggcttaccacggcagttatgagaccaaacagacagggtccgccagctcaatggtgaatggagtcgtgcggcttctgaccaagccatgggatgttgtacccatggtgactcagatggcaatgacggacacaaccccgttcggccagcaacgtgtctttaaagaaaaggtggatactagaacccaggagcctaaggaaggtacgaaaaagctaatgaaaattacagccgagtggctctggaaggagctggggaaaaagaaaaccccacgcatgtgtactagggaagagttcacacggaaggttagatccaacgctgcgttgggagccatctttaccgacgaaaataagtggaaatctgcacgcgaggctgtggaagatggcaggttctgggagctggtcgaccgagagcggaacctccaccttgaaggcaagtgcgagacttgtgtgtacaatatgatggggaaaagagaaaagaaactgggagagtttggtaaggccaagggcagcagggcaatttggtatatgtggttaggggcccgcttcctggaatttgaggctttgggattcctcaacgaggatcattggtttagtcgtggcaattccctgagcggtgtagaaggggagggactacaccggcttggctacatcctgagagacgtgggcaaaaaggaagggggagccatgtacgcggatgacacagcaggttgggacaccaggattacactcgaggatctgaaaaacgaagagatggttactaatcatatgaagggcgagcacaaaaagttggccgaagctatattcaagctgacctatcagaacaaagtcgtgcgcgtgcagcgaccaacgcctcgggggaccgtcatggacatcatttctagaagggatcaacgcggatcaggccaggttggtacatacgggctcaatacttttaccaacatggaggcccagcttatcagacaaatggaaggagagggcatcttcaagagtattcagcatctgacagcaactgaggaaatagctgtgcagaattggttagcccgggtaggcagggagcgtctgtcccgaatggctatcagcggggacgattgcgtggtcaaacccattgacgatcgcttcgcctctgcattgaccgcgctcaacgacatgggaaaggtgagaaaagatatccagcaatgggaaccatcgcggggttggaatgactggacgcaggttcccttttgctcacaccacttccatgagctggtgatgaaggatggcagggtcctagtggtaccttgtcgcaaccaggacgaacttattgggagagcccggatcagccagggagctggctggtccctgaaggagacagcctgcctcggtaaaagttatgcacaaatgtggaccctgatgtactttcacaggcgagatttgcgtttagctgccaacgcaatatgttctgccgttccaagccattgggtgccgacttccagaacaacctggtcaatccacgcgaagcacgagtggatgactaccgaagacatgctggctgtctggaatcgcgtgtggattcaggagaacccctggatggaagacaaaacacctgtggagagttgggaagaggtcccatatctcgggaagcgggaggatcagtggtgcggatctcttatcggcctgacgagcagggccacctgggccaaaaatattcagactgccatcaaccaagttagatccctaataggcaatgaagagtacacagactatatgccctcaatgaagcgcttccggaaggaagaggaagaggctggggtgctgtggtga

SEQ ID NO: 14467 - RNA, 9876 nt, synthetic construct
  misc_feature 1..9876: note = derived and/or modified CDS sequence (opt3) from DENV-2__KJ189311__SS-prME
  source 1..9876: mol_type = other RNA
accgccggcgtgatcgtcatgctgattcccacagttatggctttccacctcactacgagaaacggggagcctcatatgatagtgggaaggcaggaaaagggtaaaagccttctgtttaagaccgaggacggcgtaaatatgtgcacattgatggcaatcgatttaggggaactgtgtgaggacactattacctacaaatgcccactactccggcaaaacgaaccggaggatatcgactgttggtgcaattccacatctacctggattacttatggaacatgttcaaccacgggcgagcaccgccgagaaaagcgtagtgtggccctggtcccccatgtgggtatggggcttgagactagaaccgaaacatggatgagctccgagggagcgtggaaacacgttcagaggatcgagacttggatactgcggcatcctggcttcaccatcatggctgccattttggcatacacaatcggcaccacgcactttcagcgcgccctcattttcatcctgctgactgctgtggcaccatctatgacaatgagatgcatagggatttcgaacagggattttgtcgaaggagtgtcaggtggcagctgggtagacatcgttctcgagcacgggagttgtgtgaccactatggccaagaataagcccacattagatttcgaactgattaaaaccgaggctaagcagcctgccacgcttcggaaatattgcatcgaagcgaagttgaccaacacaactaccgagtcccgctgtccaacacaaggagagccctctctgaatgaagagcaggacaaacgatttatctgcaagcatagcatggtcgatagaggctggggtaacgggtgtggactattcggcaagggcgggattgtgacttgcgcaatgtttacctgcaaaaagaatatggaaggaaaagtggtccagcctgagaacctcgaatacacaatagttatcaccccacactccggtgaggagcatgccgtgggcaatgacactgggaagcacggaaaagaaattaagatcacgccgcagtcaagtataacagaggctgaactgaccggctatggtactgtaaccatggagtgtagccccaggacagggcttgatttcaacgaaatggtgctgttgcaaatggaggacaaagcctggctcgtccaccggcagtggtttctggatttacctctgccatggctccccggcgcagacacccagggatctaattggattcagaaggagactcttgtgacattcaagaaccctcatgctaaaaagcaagacgttgtggtcctgggctcccaggaaggggccatgcacacggcgttgaccggagccactgagatccagatgtcaagcggtaatctactgtttacaggccatctcaaatgccgtctgcgcatggataagcttcaactgaaagggatgagttactctatgtgtaccggaaagttcaagatcgtgaaagaaattgcagagacacagcacggcactatcgtaattagagttcagtatgagggtgacgggtccccatgcaagatacccttcgaaatcaccgatttggagaaaaggcatgtgctcggccggctgattacggtcaacccgatcgtgaccgaaaaggacagccctgtcaacatcgaggctgaacccccatttggagattcgtacattataatcggcgtggagcctgggcagttaaaactgaattggttcaagaagggatcttccattggtcaaatgtttgagacaactatgcgaggcgccaaacgcatggctatcctaggggacaccgcctgggatttcggatcactcggcggtgtttttacaagtattgggaaggcactgcaccaggtgttcggcgccatctacggagctgcgtttagcggcgtatcctggactatgaaaatacttatcggggtcattatcacctggattggaatgaactctagaagcacgtcattgagtgtgtccctggttctcgtgggcgtcgtgatcctgtatcttggtgcaatggtacaggccgacagcgggtgtgtggtttcttggaagaataaagaactgaagtgcggatcaggcatattcattacagataacgtccacacctggactgagcagtacaagtttcaacccgaaagtccaagcaaattggcttccgccatccagaaggcacatgaggaaggtatttgtggcatcaggtctgtgacacggctcgagaatctgatgtggaaacagataacccccgagttaaaccacatcctgtcggaaaatgaggtgaagctaactattatgaccggggacatcaaaggaattatgcaggccggcaagcgcagcctcagacctcaaccaacagaactgaaatattcctggaagacgtgggggaaggctaaaatgctttcaaccgagagtcataaccagactttcttgatcgatggaccggaaacagccgagtgccccaataccaacagggcatggaattctctggaggtcgaagactacggctttggtgttttcacaactaacatatggctcaagctgcgtgagaaacaggacgtgttttgtgatagcaagttaatgtccgcggctattaaagacaatcgggccgtgcacgcagatatggggtattggatcgaatcagccctgaacgacacctggaagatggagaaggctagcttcatcgaggtaaaatcttgccactggcctaagtcccatacgctttggagtaatggagtcttggaaagcgagatgattatcccaaaaaacttcgccggccccgtgtctcagcacaactaccgacctggttatcatacacaaaccgcaggcccatggcacctcgggaagctggaaatggattttgacctatgtgagggaactaccgttgtggtcacagaagattgcggcaatagagggccctccctgaggactaccacagcttcaggaaaactcattacggagtggtgctgtcgcagttgcaccctgccgcctcttcggtacagaggcgaggacggttgttggtacgggatggaaataaggccattgaaggagaaggaagagaacctggtgaatagcttagttactgccggacatggccagatcgataacttctcgctcggtgtgctgggcatggcgctttttctggaagagatgttgcgcacacgaattgggaccaaacacgccatcctcctggtagctgcatccttcgtcactctaattacaggaaatatgtcttttcgggacctgggccgtgtgatggtgatggtcggggccaccatgacggatgacatcggaatgggcgttacttatctcgctctgcttgccgcattcaaggtgagacccacctttgcggccggtttgctgttaaggaaactcacaagcaaggagctgatgatggctaccatagggatcgcccttctgtcacagagtactattcctgaatccatcctagagctcacagatgcactggctttgggaatgatggtactgaaaattgtgcgcaacatggaaaagtaccaattagccgtcaccatcatggcaatatcttgcgtgcccaatgccgttattctccagaacgcttggaaggtgagctgtacaatcctggcggccgtctccgtgtcaccacttctgttgactagcagtcagcagaaagcagactggatccctctcgctctgaccattaagggcctaaatcccacggccatattcctgacaaccctttctcggacttccaaaaagagaagctggccactcaacgaggccgttatggctgtgggcatggtctcgatcctggcatcatctttgctgaaaaatgacattccgatgaccgggcctttagtagccggaggtctcctgacagtgtgctatgttcttactggcaggagtgcggatctggaattggagcgagctgccgacgtgaagtgggaggatcaagcagaaatctccgggagctctcccattctcagcatcaccatatccgaggacggatcaatgagtatcaaaaacgaagaggaggaacagacgctgacaattctaatccgcaccggcctgcttgtcattagcggtgtgtttccagtatctatccccataactgccgctgcatggtacctctgggaggtgaagaagcagcgggccggggtcctgtgggatgttccttccccaccccctgtggaaaaagcggagttggaagacggagcttatagaattaagcagaggggcatcttaggctactcacaaatcggggccggagtgtataaagagggtacattccacaccatgtggcatgtcactcgtggcgcagtgctgatgcaccgcgggaagcggattgagccgagttgggccgatgttaaaaaggacctcatcagctacggaggcggttggaagctggaaggggagtggaaagaaggagaggaagtacaggtgcttgctctggagccaggcaagaatcccagagccgtccagacaaaacctggcatatttaagaccaacacggggactattggagcagtgtccttggatttctctccaggtacctcgggcagccccatcgttgacaggaaagggaaggtggtcggactatacggcaatggtgtggtaacacgatcaggggcttatgtctccgccattgcgcagaccgagaagagtatcgaagataacctggagatagaagacgatatttttcggaaaaagcgcctcacaatcatggacctgcatcctggagccggcaaaactaagagataccttccggcaatcgtgagggaggctattaaacggggcttacgaaccctgatcctcgcccccacgagagttgtggctgcagaaatggaggaggccttgcgcgggctgccaattaggtatcaaacacctgccataaagactgaacacaccggacgtgagatcgtcgacctcatgtgtcatgctacattcaccatgcggctgctttctcccgtgagagttccaaactacaatctgattatcatggatgaagcgcacttcactgaccctgcaagcatcgccgctaggggttatatttccacccgcgtggagatgggcgaggccgcagggatatttatgacagccacgcccccaggatcacgagatccgttccctcagtctaacgctcccatcatggacgaagagagagaaattccagagcggagctggaatagtggccacgaatgggtcactgattttaagggtaaaaccgtgtggttcgtaccctccatcaaggcggggaacgacattgccgcatgcttgaggaaaaatggaaagaaagtgatccagctaagccgcaagacatttgattctgagtacgttaagacccgtgctaacgactgggatttcgtcgtgactacagacatatcagagatgggcgccaattttaaagcagaaagagtgatcgatcctcggaggtgtatgaagccagtcattctgaccgacggcgaggaacgcgtaatcctcgccgggcccatgcctgtgacgcattccagtgctgcccaacgaagaggacggattggtaggaacccgaaaaatgagaacgaccagtatatctacatgggcgaaccattagagaatgatgaggactgcgcgcactggaaggaagcaaaaatgctgcttgataacataaatactcccgaggggattatccctagcatgttcgaacccgagcgcgaaaaggttgacgccattgatggagagtacagactgaggggcgaggctcggaaaacatttgtggacctcatgcgtcgcggtgatttgccagtctggctggcctataaggtggctgcagaagggatcaactacgccgaccgaaagtggtgtttcgatggcataaaaaataaccagatcctcgaggaaaacatggaggttgagatttggaccaaggaaggagagagaaaaaagctgaaacctaggtggcttgacgctcggatctattcggatcccctagccctgaaggaatttaaggagttcgcagcgggccgcaaatctttgaccttaaatctgattactgaaatggggagactcccaacattcatgacccagaaggccaggaacgctctggacaatcttgccgtgctgcatacagcagaggctggaggtcgggcctacaaccacgcactctccgagttgcctgaaactctggagacgctactgctccttaccctgttagccacagtcactggcgggatctttttgttcctgatgagcggaaaaggcataggtaagatgaccctcgggatgtgctgcattatcacagcttcaatcctgctttggtatgcgcaaattcagccgcactggatcgccgcaagtataattctggaatttttcctcatcgtgttgctgattcccgagccagaaaaacagcgaacccctcaggataatcaattaacttacgtagtgatcgctatactaacggttgtcgccgccaccatggcaaacgagatgggctttctggagaagacaaagaaagacctcggacttggctctatcactacccaggaatccgagagcaatattctggacatcgatttgagacccgcttcagcctggacactgtatgcggtggctaccactttcgtgacaccaatgctccgccatagtattgaaaacagctccgtcaatgtttctctgacggccatcgcaaaccaggccaccgtgcttatggggctcggaaagggttggcctctgagcaaaatggacattggcgtacccttgctggctatcgggtgttactcccaggtgaatccgataactttaacagcagccctactgctccttgtcgcgcactacgctattatcggaccaggcctgcaagccaaggcaaccagggaggcccagaaacgggctgccgcaggtatcatgaagaaccctaccgtggatgggattacagttatagacttggaacccatcccatatgatcccaagtttgagaaacagctgggccaggtgatgctcctgattctttgcgtcactcaagtattaatgatgcgtacgacctgggctctgtgtgaggccctcacattggcgactggacctatctcaaccctgtgggaaggcaatccggggagattctggaacacaaccattgccgtgtctatggcaaatatctttaggggaagttacctagctggcgccggtctgctcttctcgataatgaagaacactacgaatacacgccgggggaccggaaacatcggcgagactcttggtgaaaaatggaagagccgactgaacgcattgggcaaatccgagtttcagatttataagaaatctgggatccaggaggttgacagaaccctggctaaggaaggaattaagaggggcgagacagatcatcacgccgtgtcacgcgggagcgccaaactccggtggttcgtcgaaagaaatatggtgactcccgagggaaaggtcgtggacctgggctgcggtcgtgggggatggtcctactattgtggcggtttaaaagatgttagggaagtgaagggccttaccaaagggggaccaggccatgaggagcctatccccatgagtacatacgggtggaacctggtacggctccaatctggaatagacgtgtttttcacgcctccagaaaagtgcgataccctactgtgtgacattggcgagagctcacccaatcctactatcgaagcgggtcgcacattgcgagtcctgaacctcgttgagaattggcttaacaataacacccagttctgcatcaaggtgctgaatccatatatgccctccgtcattgaaaaaatggagactttgcagagaaagtacgggggagctctggtgaggaacccgctcagtcggaatagcacacacgagatgtactgggtatctaacgcaaccggcaatatagtgtcctcagttaacatgatcagccgcatgttaattaatagatttacgatgaaacacaagaaagccacctatgaacctgatgtggacctgggctcggggacaaggaacatcggaattgagtctgaaatcccaaaccttgacataatcggtaagcgaattgagaagatcaaacaggaacatgagactagttggcactacgatcaagaccatccctataagacctgggcttaccacggctcctatgagacaaaacagactgggagcgcctcatccatggtcaatggagtggtccggctgctaaccaagccttgggatgtggttccaatggtaacacagatggcaatgaccgacactacgcccttcggccagcaacgtgtgtttaaagaaaaggtcgatacaagaacccaggagccgaaggaaggtactaaaaagctcatgaaaattaccgccgagtggctgtggaaggagttggggaaaaagaaaacacctcgcatgtgtacgagggaagagttcacccggaaggtgagatctaacgctgcgctgggagccatctttactgacgaaaataagtggaaaagcgcacgcgaggctgttgaagatggcaggttctgggagctcgtggaccgagagcggagtcttcacctggaaggcaagtgcgagacatgtgtctacaacatgatggggaaaagagaaaagaaattaggagagtttggtaaggccaagggctccagggcaatttggtatatgtggctgggggcccgcttcttggaatttgaggctctcggattcctgaatgaggatcattggtttagccgtggcaactctctatcaggtgtggaaggggagggacttcaccggctgggctacatactcagagacgtaggcaaaaaggaagggggagccatgtacgcggatgacaccgcaggttgggacactaggatcacactggaggatttgaaaaatgaagagatggtgaccaaccatatgaagggcgagcacaaaaagctggccgaagctattttcaagctcacatatcagaataaagttgtccgcgtgcagcgacccactccacgggggaccgtgatggacatcatcagtagaagggatcaacgcggatccggccaggtcggtacgtacgggcttaacacctttacaaatatggaggcccagctgattagacaaatggaaggagagggcatattcaagaacatccagcatttaactgcaaccgaggaaattgctgttcagaattggctggcccgggtgggcagggagcgtttgagccgaatggctatctctggggacgattgcgtagtgaaacctattgacgatcgcttcgcctcggcactcacagcgctgaacgacatgggaaaggtcagaaaagatatccagcaatgggaaccctcacggggttggaatgactggactcaggtgccattttgcagccaccacttccatgagctagttatgaaggatggcagggtgcttgtcgtgccctgtcgcaaccaggacgaactgatagggagagcccggatctcccagggagctggctggagtctcaaggagaccgcctgcctgggtaaatcttatgcacaaatgtggacgttgatgtactttcacaggcgagatttacgtctggctgccaacgcaatttgtagcgccgtaccttcccattgggttccaacatcaagaaccacttggagtatccacgcgaagcacgagtggatgacaaccgaagacatgctcgctgtgtggaatcgcgtctggattcaggagaacccgtggatggaagacaaaactcccgtggagtcttgggaagaggtgccttatcttgggaagcgggaggatcagtggtgcggaagcctgatcggcctaacctccagggccacatgggcaaaaaatatacagacggccattaaccaagtcagatcactgatcggcaatgaagagtacaccgactatatgccaagcatgaagcgcttccggaaggaagaggaagaggctggggttctctggtga

SEQ ID NO: 14468 - RNA, 9876 nt, synthetic construct
  misc_feature 1..9876: note = derived and/or modified CDS sequence (opt3) from DENV-2__KJ189370__SS-prME
  source 1..9876: mol_type = other RNA
accgccggcgtgatcgtcatgctgattcccacagctatggcattccacctcactacgagaaacggggagcctcatatgatagttagcaggcaggaaaagggaaaatcccttctgtttaagaccgaggacggtgtgaatatgtgcacattgatggccatcgatttaggcgaactgtgtgaggacactattacctacaaatgcccactactccggcaaaacgaaccggaggatatcgactgttggtgcaattctacatcaacctgggtaacttatgggacatgtaccacgactggagagcaccgccgagaaaagcgtagtgtggcgctggtcccccatgtgggcatgggtcttgagaccagaacagaaacttggatgagctccgagggggcttggaaacacgttcagaggattgagacctggatcctgcggcatcctggattcacaataatggccgcaatcttggcctacaccattggcacgactcactttcagcgcgctctcatcttcattctgctgacagcagtggccccatctatgaccatgagatgcatcggcatatcgaacagggattttgtcgaaggggtgtcaggaggtagctgggtagacattgttctcgagcacggcagttgtgtgactacaatggctaagaataagcccaccttagatttcgaactgatcaaaacggaggccaagcagcctgcgacccttcggaaatattgcattgaagcaaagttgacaaacactaccacagagtcccgctgtccaactcaaggggagccctctctgaatgaagagcaggacaaacgatttatctgcaagcatagcatggtcgatagaggatggggcaacggttgtgggctattcggaaagggcggcatcgtgacctgcgccatgtttacatgcaaaaagaatatggaagggaaagtggtccagcctgagaacctcgaatacaccattgttataactccacactccggagaggagcatgctgtgggtaatgacacgggcaagcacgggaaagaaatcaagattacaccgcagtcaagtatcaccgaggccgaactgactggatatggcaccgtaacaatggagtgtagccccaggaccggtcttgatttcaacgaaatggtgctgttgcaaatggaggacaaagcatggctcgtccaccggcagtggtttctggatttacctctgccatggctccccggggctgacactcagggctctaattggatacagaaggagacacttgtgacgttcaagaaccctcatgccaaaaagcaagacgttgtggtcctgggatcccaggaaggcgcgatgcacaccgccttgactggggcaacagagattcagatgtcaagcggaaatctactgtttaccggtcatctcaaatgccgtctgcgcatggataagcttcaactgaaaggcatgagttactctatgtgtacagggaagttcaagatcgtgaaagaaatcgctgagactcagcacggaaccattgtaatcagagttcagtatgagggcgacggttccccatgcaagattcccttcgaaataacggatttggagaaaaggcatgtgctcgggcggctgatcaccgtcaacccgattgtgacagaaaaggacagccctgtcaacatcgaggccgaacccccatttggcgattcgtacatcattataggagtggagcctggccagttaaaactgaattggttcaagaaggggtcttccatcggacaaatgtttgagactaccatgcgaggtgctaaacgcatggccattctaggcgacacagcatgggatttcgggtcactcggaggcgtttttactagtatcggtaaggccctgcaccaggtgttcggggctatttacggcgcggcatttagcggagtatcctggaccatgaaaatccttataggcgtcatcattacgtggatcgggatgaactctagaagcacatcattgagtgtgtccctggttctcgtgggagtcgtgaccctgtatcttggcgccatggtacaggctgacagcggttgtgtggtttcttggaagaataaagaactgaagtgcgggtcaggaattttcatcactgataacgtccacacatggaccgagcagtacaagtttcaacccgaaagtccaagcaaattggcctccgcaatacagaaggcccatgaggaaggcatttgtggtatcaggtctgtgactcggctcgagaatctgatgtggaaacagattacccccgagttaaaccacatcctgtcggaaaatgaggtgaagctaacaataatgacgggcgacatcaaagggattatgcaggctggaaagcgcagcctcagacctcaaccaaccgaactgaaatattcctggaagacttggggcaaggccaaaatgctttcaacagagagtcataaccagaccttcttgatcgatgggccggaaacagcagagtgccccaatactaacagggcgtggaattctctggaggtcgaagactacggatttggcgttttcaccacgaacatttggctcaagctgaaagagaagcaggacgtgttttgtgatagcaaattaatgtccgctgccatcaaggacaatcgtgcagtgcacgccgatatgggttattggatagaatcagctctgaacgacacatggaagatggagaaagccagcttcattgaggtaaagtcttgccactggcctaaatcccataccctttggagtaatggggtcttggaaagcgagatgatcatcccaaagaacttcgcaggacccgtgtctcagcacaactaccggcctggctatcatactcaaaccgctggtccatggcacctcggcaaactggaaatggattttgacctatgtgaggggacaactgttgtggtcaccgaagattgcggaaatcgaggcccctccctgagaacaacgaccgcctcagggaagctcattactgagtggtgctgtaggagttgcacactgccgcctcttcgctaccggggagaggacggctgttggtacggtatggaaatcagaccattgaaggagaaagaagagaacctggtgaatagcttagttaccgcggggcatggacagattgataacttctcgctcggcgtgctgggtatggccctttttctggaagagatgttgaggactcgcataggcacaaagcacgctatcctcctggtagcagtctccttcgtgaccctaattacggggaatatgtcttttcgagacctgggacgggtgatggtcatggttggcgccactatgaccgatgacatcgggatgggagtgacatatctcgctctgcttgccgcattcaaagtacgtcccacctttgcggccggcttgctgttaagaaagctcactagcaaagagctgatgatggctacaattggtatcgcccttctgtcacagagtaccatacctgaaacaatcctagagctcactgatgcactggctttggggatgatggtgctgaaggtcgtgaggaacatggaaaagtaccaattagccgttaccattatggcaatctcctgcgtgcccaatgccgtcattctccagaacgcttggaaagtgtcttgtacgatcctggcggccgttagcgtgtccccacttctgttgacatcaagccagcagaaggcagactggatacctctcgctctgaccattaaaggactaaatcccactgccatcttcctgaccacacttagtcgcacttctaagaaacggtcctggccactcaacgaggccatcatggctgtcggcatggtaagcattctggcatcgtcattgctgaagaatgacataccgatgaccggccctttagtggccgggggactcctgacggtttgctatgtgcttacaggtagatctgcggatctggaattggagagggctgccgacgtcaaatgggaggatcaagcagaaatcagtggctccagccccattctctctatcaccattagcgaggacgggtccatgtcaatcaagaacgaagaggaggaacagactctgacaatactaatccgaaccggactgcttgtgattagtggcgtatttccagtgagcatccccattactgccgctgcatggtacctctgggaggtcaagaaacagcgcgccggtgttctgtgggatgtgccttctccaccccctgtggaaaaggcggagttggaagacggggcttatcggatcaaacagagaggaatattaggctactcccaaattggcgccggggtctataaggagggaacattccacaccatgtggcatgtgacgaggggtgcagttctgatgcaccgtggcaaacgcatcgagccgtcatgggccgatgtaaagaaggacctcatcagttacgggggaggctggaaactggaaggtgagtggaaggaaggggaggaagtgcaggtccttgctctggagccaggaaaaaatccccgggccgtgcagactaagcctggcatttttaaaaccaacacaggcaccatcggggcagttagcttggatttctccccaggaacatctggttcgcccatagtggacagaaagggcaaggtcgtggggctatacggaaatggcgtagtcactaggagcggtgcttatgtgtcagccattgcgcagaccgagaaatccatcgaagataaccctgagattgaagacgatatctttcgaaagaaacggctgacgataatggacctccatccgggggccggaaagacaaaacgctacctgcccgcaattgttagagaggctatcaagaggggccttcggactttaatcctggccccaacccgagtggtcgctgcagaaatggaggaggccctcagaggcttgcctattcgctatcaaacacccgccatcaaggctgaatacaccgggagggagattgtggacctgatgtgtcacgcgactttcaccatgcgtctcctgagtccagttcgggtgcctaactataatcttataatcatggatgaagcacatttcacagaccccgcctctattgctgccagaggatacatcagcacgagggtcgagatgggtgaggcagccggcatctttatgactgctaccccaccggggtcccgcgatcctttcccccagtcaaacgcgccaattatggacgaagagcgagaaatacccgagagatcttggaatagcggacacgaatgggtgacagattttaaaggcaagaccgtatggttcgtgcctagtatcaaagccggtaacgacattgcagcttgcctgcggaagaatgggaaaaaggttatccagttgtccaggaagacttttgatagcgagtatgtcaaaacacgcgccaacgactgggatttcgtggtgaccacggacatttctgagatgggagcaaattttaaggccgaacgtgtcatcgatccaagacggtgtatgaaacccgtaatactaactgacggcgaggaaagggtgatcctggctggccctatgccggttacacactcatccgccgcgcaacgccgagggagaattggacggaacccaaagaatgagaacgaccagtacatctacatgggtgaacccctcgagaatgatgaggactgcgcacattggaaagaagccaagatgttactggataacattaatacccctgagggcatcatacccagtatgttcgaaccagagagggaaaaagtggacgctattgatggggagtatcgccttagaggagaggccaggaagacctttgtcgacctgatgcggcgtggcgatctccctgtgtggttggcttacaaggttgcagccgaaggtatcaactatgctgaccgcaaatggtgtttcgatgggattaagaataaccagatcctggaggaaaacatggaggtggagatatggactaaagaaggcgagcgaaagaaactcaagcccagatggctggacgccaggatctacagcgatccacttgcactaaaggaatttaaagagttcgcggccggacggaagtcgctgacattgaatttaattaccgaaatgggccgcctgcctacattcatgactcagaaagctagaaacgccctcgacaatctggcagtccttcacacggctgaggccgggggaagggcatataaccatgccctgtctgagctcccggaaaccttggagacactgctactgctcactcttctggctaccgtgacaggtggcatctttttattcttgatgtccgggaagggaattggcaaaatgaccctgggtatgtgctgcatcataactgcgagcattctcctgtggtacgcccaaatccagccccactggatcgcagcttcaattatccttgaatttttcctgatagtactcttgattccagagcctgaaaagcagcggacgccccaggataatcaactgacctatgtggttatcgccattttaacagtcgtggccgcaactatggctaacgagatggggtttctagagaagaccaaaaaggacctgggcctcggaagtatcacaacccaggaatctgagtccaatatacttgacatcgatctgcgaccagccagcgcgtggactttgtacgctgtggccacaacgttcctgacccctatgctcagacactcaattgaaaacagtagcgtcaatgtttccctgactgcaatcgccaaccaggctacagtgcttatgggcctcgggaaaggatggcccctgtctaagatggacattggtgtaccgttgctggcaatcggctgttacagccaggtgaatccaattaccttaaccgccgcgctactgctccttgtcgctcattatgccatcatagggcctggactgcaagcaaaagccacacgcgaggctcagaagagggccgcagctggcattatgaagaaccccactgtggatggtatcacggttatcgacttggatccaattccctacgaccctaaatttgaaaagcagctggggcaggtgatgctcctgatactttgcgtcacccaagtattaatgatgcggacaacttgggccctgtgtgaggcgctcaccttggccacaggcccgatctccaccctgtgggagggaaatcccggccgtttctggaacactacgattgcagtgtcaatggctaatatctttagagggtcttatctagccggagcaggcctgctcttcagtattatgaaaaacacaacctcgactaggcgcggtaccgggaatatcggagaaacacttggcgagaagtggaaaagccggctgaacgctttgggtaagtccgaatttcagatatacaaaaagtctggcatccaggaggttgatcgaactctggccaaggaggggattaaaagaggagaaaccgaccaccatgccgtgtcaaggggcagcgcgaagctccgctggttcgtcgagcggaacatggtgacaccagaagggaaagtcgtggatctgggatgcggcagaggtgggtggtcctattactgtggaggcttaaagaatgttcgtgaggtgaaaggtcttacgaagggcgggcctggacacgaagagcccatccctatgagtacctatggctggaacctggtaaggctccaatctggggtggacgtctttttcactccacccgagaagtgcgatacactactgtgtgacattggagaaagctcacctaatccaaccatcgaggctggccggactttgcgcgttctgaacctcgtggaaaattggcttaacaataacacacagttctgcataaaagtcctgaatccctacatgccgtccgtgattgagaagatggaagcattgcagcgaaaatacggtggggccctggtaagaaaccctctcagtaggaatagcacccatgagatgtattgggtgtctaacgctacgggaaatatcgtttcctcagtgaacatgatcagccggatgttaattaatcgctttaccatgaagcacaaaaaggccacatacgagccagatgtcgacctgggctcgggcactagaaacatagggatcgaatctgaggtgcccaaccttgacattatcggaaagaggattgaaaaaatcaagcaggagcacgaaaccagttggcattatgatcaagaccacccttacaaaacatgggcatatcatggttcctacgagactaagcagaccggcagcgcctcatccatggtcaatggggtggttcgactgctaacaaaaccatgggatgtagtgcccatggtcacccagatggctatgactgacacgacaccgttcggacagcaacgggtgtttaaggagaaggttgatacccgtactcaggaacctaaagagggcaccaagaaactcatgaagataacagcggaatggctgtggaaagagttgggtaagaaaaagacgcccagaatgtgtacccgcgaggaattcactaggaaggtgcggtctaacgccgcactgggggctatctttacagacgagaataaatggaagagcgccagagaagcagtcgaggatggacgcttctgggaactcgtggacagggagcgaaaccttcacctggagggcaaatgcgaaacctgtgtatataatatgatgggcaagcgggagaaaaagttaggggaatttggaaaggccaaaggtagtagagctatttggtacatgtggctgggcgccaggttcttggagtttgaagcgctcgggttcctgaacgaggatcactggttttcccgcggaaatagcctatctggcgtggagggtgaagggcttcatcgtctgggatacatcctccgggaggttggcaagaaagaaggcggggcaatgtatgccgacgatactgctggatgggacacaagaattaccctggaggacttgaagaacgaagagatggtcacaaatcacatgaaaggtgagcataagaagctggccgaagcaatcttcaaactcacttaccagaacaaggtggtgagggtccagcgcccaacccctcgaggcacggttatggatattatatcacggagagaccaaagggggagtggacaggtgggcacctatggtcttaatacatttactaacatggaggctcagctgatccgccaaatggaaggggagggaattttcaaatccatccagcacttaaccgccacagaggaaatcgctgtacagaattggctggtgagagtcggccgggagaggttgagccgtatggccatttctggcgatgactgcgtggttaagcccatagatgaccgattcgcatcggcgctcactgccctgaacgatatggggaaagtgcgcaaggacatccagcaatgggaaccatcaagaggatggaatgattggacccaggtccccttttgcagccatcacttccacgagctagtgatgaaggacggtcgggtacttgttgtgccttgtaggaaccaggatgaactgattggccgcgctagaatctcccagggggccggatggagtctcaaagagacggcatgcctgggcaagtcttacgctcaaatgtggacattgatgtattttcatcggagggacttacgactggccgcaaacgccatttgtagcgcggtcccatcccactgggtgccgacctcacgtactacatggagtatccatgctaaacacgagtggatgaccactgaagatatgctcgccgtgtggaatagagtctggatacaggagaacccctggatggaagacaagacccctgttgagtcttgggaagaggtgccataccttggtaaacgcgaggaccagtggtgcgggagcctgatcggactaacatcccgggcaacgtgggccaagaatattcagaccgctatcaaccaagtaaggtcactgattggcaatgaagagtatactgattacatgcccagcatgaagagattccgccgggaagaggaagaggccggcgtgctctggtga

SEQ ID NO: 14469 - RNA, 9876 nt, synthetic construct
  misc_feature 1..9876: note = derived and/or modified CDS sequence (opt3) from DENV-2__EU482620__SS-prME
  source 1..9876: mol_type = other RNA
accgccggcgtgatagtaatgctgattccaacggctatggcattccacctcactacgagaaacggggaacctcatatgatagttggaaggcaggaaaagggtaaaagccttctgtttaagaccgaagacggcgtgaatatgtgcacattgatggccatcgatttaggggaactgtgtgaagacactattacctacaaatgcccactactccggcaaaacgaaccggaagatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatagaatccgctctgaacgacacatggaagatggagaaggcctcattcattgaggtcaaaagctgccactggcctaagtctcataccctttggtccaatggagtgttggaaagtgagatgatcatccccaagaatttcgcaggccccgttagccagcacaactaccgacctggttatcatactcaaaccgctggcccatggcacctcgggaagctggaaatggattttgacttctgtgagggaacaactgtggtcgtgaccgaagattgcggcaatagagggccctctctaaggacaacgaccgcctccggaaaactgattactgagtggtgctgtcgctcatgcacactcccgcctctgcggtacagaggcgaggacggttgttggtacgggatggaaatcaggccacttaaggagaaggaagagaacttggttaatagtctggtgaccgcgggacatggccagattgataactttagcttaggtgtactcggcatggccctgttccttgaagagatgctgcgcactcgaatagggacaaaacacgctatcttgctcgtcgcagtgtcgtttgtgaccctgattacgggaaatatgtccttccgggacctaggccgtgtcatggttatggtgggggccactatgaccgatgacatcggaatgggcgtaacatatctggctctcctggccgcatttaaggtgagacccaccttcgcggccggtcttttgctgaggaaattaacttctaaggagctcatgatggctacaattgggatcgccctgcttagccagtcaaccatacctgaaacaatcctggagctaactgatgcactcgctctgggaatgatggtcttgaaaattgtgcgcaacatggaaaagtaccaactggccgttaccatcatggcaattagttgcgtgcccaatgccgtcatcttacagaacgcttggaaggtgtcctgtacgatactcgcggccgtttctgtgagcccactgcttctgacatcctcacagcagaaagcagactggattcctttggctctcaccatcaagggcctgaatcccactgccatctttctaaccacactgagccggacaagtaaaaagagatcttggccacttaacgaggccattatggctgtcggcatggtatccatactcgcaagctcgctgttgaaaaatgacatcccgatgaccgggcctctggtggccggaggtttactcacggtttgctatgtgctgacaggcaggtcagcggatcttgaactggagcgagctgccgacgtcaagtgggaggatcaagcagaaatttctgggagttcccccatcttgagcattaccatctctgaggacggaagcatgtccatcaagaacgaagaggaggaacagactctcacaatcctgattcgcaccggcctactggtgatctcaggtgtattcccagtgagtattcccatcactgccgctgcatggtacctttgggaggtcaagaagcagcgggccggggttctctgggatgtgcctagcccaccccctgtggaaaaagcggagctggaagacggagcttatagaataaagcagaggggcattttgggctactctcaaatcggggccggagtctataaagagggtacatttcacaccatgtggcatgtgacgcgtggcgcagttttaatgcaccgcgggaagcggatcgagccgtcctgggccgatgtcaaaaaggacctgatttcatacggaggcggttggaagctcgaaggggagtggaaagaaggagaggaagtgcaggtcctggctcttgagccaggcaagaatcccagagccgtgcagactaaacctggcatcttcaagaccaacacagggaccataggagcagttagtctggattttagcccaggtacatccggctctcccattgtggacaggaaagggaaggtcgtgggattgtacggcaatggtgtagtcactcgatcgggggcttatgtgagcgccatcgcgcagaccgagaagtcaattgaagataaccctgagatcgaagacgatatattccggaaaaagcgcctaacgattatggacctgcatccgggagccggcaaaacaaagagatacctccccgcaatcgttagggaggctatcaaacggggcctgcgaactcttattttagccccaaccagagtggtcgctgcagaaatggaggaggccctgcgcgggctccctatcaggtatcaaacacccgccattaagaccgaacacactggacgtgagatagtggacttgatgtgtcatgctaccttcacaatgcggctgctctccccagttagagtgcctaactacaatctgatcattatggatgaagcgcactttacggaccccgcaagtatcgccgctaggggttatatctctactcgcgtcgagatgggcgaggccgcagggattttcatgaccgccacaccaccgggaagccgagatccttttccccagtccaacgctccaataatggacgaagagagagaaatccccgagcggtcatggaactctggccacgaatgggtgaccgatttcaagggtaaaactgtatggtttgtgcctagcattaaggcggggaacgacatcgccgcatgccttaggaaaaatggaaagaaagttattcagctgagtcgcaagacattcgattccgagtacgtcaagacccgtgctaacgactgggattttgtggtgacgactgacatcagcgagatgggcgccaatttcaaagcagaaagagtcatagatccacggaggtgtatgaagcccgtaatcttgacagacggcgaggaacgcgtgattctagccgggcctatgccggttacccattcttcagctgcccaacgaagaggacggatcggtaggaaccccaaaaatgagaacgaccagtatatttacatgggcgaacccctggagaatgatgaggactgcgcgcactggaaggaagcaaaaatgctcttagataacatcaatacccctgaggggataattccctccatgtttgaaccagagcgcgaaaaggtggacgccatcgatggagagtacagactgaggggcgaggctcggaaaactttcgtcgaccttatgcgtcgcggtgatctgcctgtgtggctcgcctataaggttgctgcagaagggattaactacacagaccgaaagtggtgttttgatggcatcaaaaataaccagatattggaggaaaacatggaggtggagatctggaccaaggaaggagagaggaaaaagctgaaacccagatggctcgacgcccggatttatagtgatccactggctcttaaggagttcaaggagttcgccgcaggccgcaaaagcctaacactgaatttgatcactgaaatggggagattacctacgtttatgacccagaaggcgaggaacgccctggacaatctcgctgtcctgcatacagccgaggcaggaggtcgggcttacaaccacgccctttcggagctgccggaaactctcgagaccttgctgctactgacactccttgcaaccgtgactggcgggattttcctgtttttaatgtctggaaaaggcatcggtaagatgacgttggggatgtgctgcataattaccgcctccatcctgctctggtatgctcaaatccagccccactggattgcggccagcatcatactggagttctttcttattgtactgctcatcccagagcctgaaaaacagcgaacaccccaggataatcaattgacttacgtggttattgcaatcctgaccgtcgtggctgccacaatggccaacgagatgggcttcttagagaagaccaagaaagacctaggactgggctcaataactacacaggaaagtgagtctaatatcctcgacattgatcttagaccagcatccgcttggacgctgtatgccgtggcgaccacttttgtcacacctatgttgcgccatagcatcgaaaactcaagtgttaatgtgagcctgaccgctattgccaaccaggcaaccgtactcatggggctgggaaagggttggcccctttccaaaatggacatcggcgtgccgctcctggccattgggtgttactctcaggtcaatccaatcacattgactgctgcactgttactactggtggcccactacgcgataattggacctggcctccaagctaaggccacgagggaggcacagaaacgggccgctgccggtatcatgaagaaccccaccgttgatgggatcacagtgattgaccttgaaccaataccctatgatcctaagttcgagaaacagctgggccaggtcatgttgctgatcctctgcgtaactcaagtgctgatgatgcgtaccacatgggcactttgtgaggctttaaccctggccactggaccgattagcacgctctgggaaggcaatcccgggagattttggaacacaaccatcgcggtttccatggccaatattttcaggggatcatacttggcaggcgctggtctgctattttctatcatgaagaacactaccagtacacgccgggggactggaaatataggcgagaccctgggtgaaaaatggaagtcgcgactcaacgcccttggcaaaagcgagttccagatctataagaaatccgggattcaggaggtggacagaacactggcaaaggaaggaatcaagaggggcgagacggatcatcacgctgtctctcgcgggtcagccaaattgcggtggtttgtggaaagaaacatggtcaccccagagggaaaggtggttgacctgggctgcggtcgtgggggatggagctactattgtggcggtctcaaaaatgtgagggaagtaaagggcctgactaaagggggacctggccatgaggagcccattcctatgtccacatacgggtggaacttagtgcggcttcaaagtggagtcgatgttttcttcaccccacccgaaaagtgcgacactctgctctgtgatatcggcgagtctagccctaatccaacaatagaagccggtcgcaccctacgagtgctgaacttggtcgagaattggctgaacaataacacgcagttttgcattaaggtgctcaatccctatatgccgtcagtaatcgagaaaatggaggcgcttcagagacagtacgggggagctctggtgaggaaccctttgtcccggaatagtacccacgagatgtactgggttagcaacgcaacaggcaatatcgtgtcttccgtcaacatgatttcacgcatgctgataaatagattcactatgaagcacaaaaaggccacctatgaaccagacgtggatctcggcagcgggacaaggaacatcggaattgagtcggaaatccccaacttagacattatcggtaaacgaatagagaagatcaagcaagaacatgagatttcttggcactacgaccaggatcatccttataaaacttgggcttaccacggcagttatgagaccaagcagacagggtccgccagctcaatggtcaatggagtggttcggctgcttaccaaaccatgggacgtagtgcccatggtcactcagatggcaatgacggatacaaccccgtttggccaacagcgtgtgttcaaggaaaaagttgacactagaacccaggagcctaaggaaggtacaaagaaactgatgaagatcacggccgagtggctatggaaagagctcgggaagaaaaagaccccacgcatgtgtactagggaagagtttacacggaaagtgagatccaacgctgcgctgggagccattttcaccgatgaaaataagtggaagtctgcacgcgaggctgtcgaagacggcaggttttgggagttggtggatcgagagcggaacctgcacctcgaaggcaaatgcgagacttgtgtatacaatatgatggggaagagagagaagaaacttggagagttcggtaaagccaaaggcagcagggcaatctggtatatgtggctgggggcccgctttttagagttcgaggctctgggatttttgaacgaggaccattggttcagtcgtggcaattccctcagcggtgtggaaggggagggactgcaccggctaggctacattcttagagatgttggcaagaaagaagggggagccatgtacgcggacgatacagcaggttgggacaccaggataacactggaggacctcaagaacgaagagatggtcactaatcatatgaaaggcgagcacaagaaactggccgaagctatctttaagttgacctatcagaacaaggtggtgcgcgtccaacgaccaacgcctcgggggaccgttatggatattatctctagaagggaccagcgcggatcaggccaggtgggtacatacgggctgaatactttcaccaacatggaggcccaactcatcagacagatggaaggagagggcattttcaaaagtatacagcatcttacagcaactgaggaaatcgctgtacagaattggctggcccgggtgggcagggagcgtttatcccgaatggctattagcggggatgactgcgtcgtgaagcccatcgatgaccgctttgcctctgcactgaccgcgttgaacgatatgggaaaagttagaaaggacattcaacagtgggaaccatcgcggggttggaatgattggacacaggtgcccttctgctcacaccactttcatgagctcgtcatgaaagacggcagggtgctggtagttccttgtcgcaaccaggatgaactaatcgggagagcccggataagccaaggagctggctggtcccttaaggagacagcctgcctgggtaagagttatgcacagatgtggaccctcatgtacttccacaggcgagacctgcgtttggctgccaacgcaatctgttctgccgtgccaagccattgggtcccgacttccagaacaacctggtcaattcacgcgaaacacgagtggatgactaccgaagatatgttagctgtgtggaatcgcgtgtggatccaggagaacccctggatggaagacaagacacctgtcgagagttgggaagaggttccatatctggggaaacgggaggaccagtggtgcggatctctcattggccttacgagcagggccacctgggcaaagaatatccaaactgccataaaccaggtgagatccctgattggcaatgaagagtacacagattatatgccctcaatgaaacgctttcggagggaagaggaagaggctggggtactatggtga

SEQ ID NO: 14470 - RNA, 9876 nt, synthetic construct
  misc_feature 1..9876: note = derived and/or modified CDS sequence (opt3) from DENV-2__FJ373300__SS-prME
  source 1..9876: mol_type = other RNA
acagccggcgtgatcgtcatgctgattccaacagctatggctttccacctcactacgagaaacggggaacctcatatgatagttggaaggcaggaaaagggtaaaagccttctgtttaagaccgaagacggcgtgaatatgtgcacattgatggccatcgatttaggggaactgtgtgaagacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctaccagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaaccatgcaggctggcaagcgctcgctcagacctcaaccaactgaactgaaatatagctggaagacatgggggaaggccaaaatgctttccaccgagtcacataaccagacattcttgattgatggaccggaaactgcagagtgccccaataccaacagggcgtggaatagtctggaggttgaagactacggctttggtgtgttcacgacaaacatctggctcaagctgcgtgagaaacaggacgtgttttgtgattctaagttaatgagcgctgccattaaagacaatcgggcagtacacgccgatatggggtattggatcgaatccgctctgaacgacacctggaagatggagaaggcctcattcatagaggtcaaaagctgccactggcctaagtctcatactctttggtccaatggagtgttggaaagtgagatgattatccccaagaatttcgcaggccccgttagccagcacaactaccgacctggttatcatacccaaacagctggcccatggcacctcgggaagctggaaatggattttgacttctgtgagggaactaccgtggtcgtgacagaagattgcggcaatagagggccctctctaaggacgaccactgcctccggaaaactgatcacagagtggtgctgtcgctcatgcaccctcccgcctctgcggtacagaggcgaggacggttgttggtacgggatggaaattaggccacttaaggagaaggaagagaacttggttaatagtctggtgactgcgggacatggccagatcgataactttagcttaggtgtactcggcatggccctgttccttgaagagatgctgcgcacacgaattgggaccaaacacgctatattgctcgtcgcagtgtcgtttgtgacgctgatcactggaaatatgtccttccgggacctaggccgtgtcatggttatggtgggggccaccatgacagatgacattggaatgggcgtaacctatctggctctcctggccgcatttaaggtgagacccactttcgcggccggtcttttgctgaggaaattaacatctaaggagctcatgatggctaccatcgggattgccctgcttagccagtcaacaatccctgaaactatactggagctaaccgatgcactcgctctgggaatgatggtcttgaaaatcgtgcgcaacatggaaaagtaccaactggccgttacgattatggcaatcagttgcgtgcccaatgccgtcattttacagaacgcttggaaggtgtcctgtacagttctcgcggccgtgtctgtcagcccactgcttctgacctcctcacagcagaaagcagactggatccctttggctctcactataaagggcctgaatcccaccgccatttttctaacaactctgagccggaccagtaaaaagagatcttggccacttaacgaggccatcatggctgtaggcatggtgtccatcctcgcaagctcgctgttgaaaaatgacattccgatgacggggcctctggttgccggaggtttactcacagtgtgctatgtcctgaccggcaggtcagcggatcttgaactggagcgagctgccgacgtgaagtgggaggatcaagcagaaatatctgggagttcccccatcttgagcattactatctctgaggacggaagcatgtccattaaaaacgaagaggaggaacagacactcaccatcctgatacgcactggcctactggtaatctcaggtgtgttcccagtcagtattcccatcacagccgctgcatggtacctttgggaggttaagaagcagcgggccggggtgctctgggatgtgcctagcccaccccctgtcgaaaaagcggagctggaagacggagcttatagaattaagcagaggggcatcttgggctactctcaaataggggccggagtgtataaagagggtacctttcacacgatgtggcatgttactcgtggcgcagtattaatgcaccgcgggaagcggattgagccgtcctgggccgatgtgaaaaaggacctgatctcatacggaggcggttggaagctcgaaggggagtggaaagaaggagaggaagtccaggtgctggctcttgagccaggcaagaatcccagagccgttcagaccaaacctggcatcttcaagacaaacaccgggacaattggagcagtgagtctggattttagcccaggtacttccggctctcccatcgtcgacaggaaagggaaggtggtaggattgtacggcaatggtgtcgtgacccgatcgggggcttatgttagcgccatagcgcagacggagaagtcaattgaagataaccctgagatcgaagacgatattttccggaaaaagcgcctaacaatcatggacctgcatccgggagccggcaaaactaagagatacctccccgcaatagtgagggaggctattaaacggggcctgcgaacccttatcttagccccaacaagagtcgtggctgcagaaatggaggaggccctgcgcgggctccctatcaggtatcaaacccccgccattaagactgaacacaccggacgtgagatcgttgacttgatgtgtcatgctacattcacgatgcggctgctctccccagtgagagtccctaactacaatctgattataatggatgaagcgcactttactgaccccgcaagtatcgccgctaggggttatatttctacccgcgtggagatgggcgaggccgcagggatcttcatgacagccaccccaccgggaagccgagatccttttccccagtccaacgctccaatcatggacgaagagagagaaattcccgagcggtcatggaactctggccacgaatgggtaactgatttcaagggtaaaacagtgtggtttgttcctagcataaaggcggggaacgacatcgccgcatgccttaggaaaaatggaaagaaagtcattcagctgagtcgcaagaccttcgattccgagtacgtgaagacgcgtgctaacgactgggattttgtggtcactacagacatcagcgagatgggcgccaatttcaaagcagaaagagtaattgatccacggaggtgtatgaagcccgtgatcttgaccgacggcgaggaacgcgttatactagccgggcctatgccggtgacccattcttcagctgcccaacgaagaggacggatcggtaggaaccccaaaaatgagaacgaccagtatatttacatgggcgaacccctggagaatgatgaggactgcgcgcactggaaggaagcaaaaatgctcttagataacatcaatactcctgaggggattatcccctccatgtttgaaccagagcgcgaaaaggtcgacgccatagatggagagtacagactgaggggcgaggctcggaaaacattcgtggaccttatgcgtcgcggtgatctgcctgtttggctcgcctataaggtggctgcagaagggattaactacgccgaccgaaagtggtgttttgatggcatcaaaaataaccagattttggaggaaaacatggaggtcgagatctggaccaaggaaggagagaggaaaaagctgaaacccagatggctcgacgctcggatatatagtgatccactggcccttaaggagttcaaggagttcgcagcgggccgcaaaagcctaacactgaatttgatcactgaaatggggagattacctacgtttatgacccagaaggccaggaacgctctggacaatctcgccgtgctgcatacagcagaggctggaggtcgggcctacaaccacgcactttcggagctgccggaaactctcgagaccttgctgctactgacactccttgccaccgtaactggcgggattttcctgtttttaatgtctggaaaaggcatcggtaagatgacgttggggatgtgctgcattatcaccgcttccatactgctctggtatgcgcaaattcagccccactggatcgccgcaagcatcattctggagttctttcttatcgtgctgctcataccagagcctgaaaaacagcgaacaccccaggataatcaattgacttacgttgtcattgctatcctgaccgtggtggccgccacaatggcaaacgagatgggcttcttagagaagaccaagaaagacctaggactgggctcaattactacacaggaaagtgagtctaatatcctcgacatagatcttagaccagcttccgcctggacgctgtatgcggtcgctaccacttttgttacacctatgttgcgccatagcatcgaaaactcaagtgtgaatgtaagcctgaccgccattgcaaaccaggccaccgtgctcatggggctgggaaagggttggcccctttccaaaatggacatcggcgtcccgctcctggctattgggtgttactctcaggtgaatccaatcacattgactgcagccctgttactactggttgcgcactacgctattatcggacctggcctccaagccaaggcaacgagggaggcccagaaacgggctgccgcaggtataatgaagaaccccaccgtggatgggattacagtcatcgaccttgaaccaatcccctatgatcctaagttcgagaaacagctgggccaggtaatgttgctgattctctgcgtgactcaagttctgatgatgcgtaccacatgggctctttgtgaggccttaaccctggcgactggaccgataagcacgctctgggaaggcaatcccgggagattttggaacacaaccatcgccgtgtccatggcaaatattttcaggggatcatacttggctggcgccggtctgctattttctatcatgaagaacactaccagtacacgccgggggactggaaatattggcgagaccctgggtgaaaaatggaagtcgcgactcaacgcacttggcaaaagcgagttccagatctataagaaatccgggatacaggaggtcgacagaacactggctaaggaaggaatcaagaggggcgagacggatcatcacgccgtgtctcgcgggtcagccaaattgcggtggtttgtcgaaagaaacatggtgaccccagagggaaaggttgtggacctgggctgcggtcgtgggggatggagctactattgtggcggtctcaaaaatgtaagggaagtgaagggcctgactaaagggggacctggccatgaggagcccattcctatgtccacatacgggtggaacttagtccggcttcaaagtggagttgatgtgttcttcaccccacccgaaaagtgcgacactctgctctgtgatatcggcgagtctagccctaatccaacaattgaagcgggtcgcaccctacgagtcctgaacttggtggagaattggctgaacaataacacgcagttttgcatcaaggtactcaatccctatatgccgtcagtgatagagaaaatggaggcacttcagagacagtacgggggagcactggttaggaaccctttgtcccggaatagtacccacgagatgtactgggtgagcaacgccacaggcaatattgtctcttccgtgaacatgatctcacgcatgctgatcaatagattcactatgaagcacaaaaaggctacctatgaaccagacgtcgatctcggcagcgggacaaggaacattggaatagagtcggaaatccccaacttagacattatcggtaaacgaattgagaagatcaagcaagaacatgagatatcttggcactacgaccaggatcatccttataaaacttgggcctaccacggcagttatgagaccaagcagacagggtccgcaagctcaatggtgaatggagttgtacggctgcttaccaaaccatgggacgtggtccccatggtgactcagatggccatgacggatacaaccccgtttggccaacagcgtgttttcaaggaaaaagtggacactagaacccaggagcctaaggaaggtacaaagaaactgatgaagatcacggctgagtggctatggaaagagctcgggaagaaaaagacaccacgcatgtgtactagggaagagtttaccaaaaaggtccggtccaacgcggccctgggagcaattttcaccgatgaaaataagtggaaatctgctagagaggccgtggaagacggccgcttttgggagttggtagatagggagcgaaacctgcacctcgaaggcaagtgcgagacttgtgtgtacaatatgatggggaaacgggaaaagaaacttggagagttcggtaaggcaaagggcagcagagccatctggtatatgtggctgggggctaggtttttagagttcgaggccctgggatttttgaacgaggaccattggttcagtcgcggcaattccctcagcggtgttgaaggggagggactgcaccgtctaggctacattcttcgggatgtcggcaaaaaggaagggggagcgatgtacgcagacgatacagccggttgggacaccagaatcacactggaggacctcaaaaacgaagagatggtgactaatcatatgaagggcgagcacaaaaagctggctgaagccatttttaagttgacctatcagaacaaagtggtcagggttcaacgcccaacgcctcgagggaccgtgatggatataatctctcggagagaccagaggggatcaggccaggtaggtacatacgggctgaatactttcaccaacatggaggcacaactcattcgccagatggaaggagagggcatcttcaagagtatccagcatcttacagctactgaggaaattgccgtgcagaattggctggctagagtcggccgggagaggttatcccgtatggccataagcggggatgactgcgtggttaaacccatcgatgaccgatttgcatctgcgctgaccgccttgaacgatatgggaaaggtgcgcaaagacattcaacagtgggaaccatcgagaggttggaatgattggacgcaggtccccttctgctcacaccactttcatgagctcgtgatgaaggacggccgggtactggttgtgccttgtaggaaccaggatgaactaatcgggcgcgctagaattagccaaggagccggctggtcccttaaggagacagcatgcctgggtaaaagttatgctcagatgtggaccctcatgtacttccaccggagggacctgcgattggccgcaaacgccatctgttctgcggtcccaagccattgggtgccgacttcccgtacaacctggtcaatacacgctaagcacgagtggatgactaccgaagatatgttagccgtgtggaatagagtctggatccaggagaacccctggatggaagacaaaacacctgttgagagttgggaagaggtgccatatctggggaagcgcgaggaccagtggtgcggatctctcattggccttacgagccgggcaacctgggccaaaaatatccaaactgctattaaccaggtaaggtccctgatcggcaatgaagagtacacagattatatgccctcaatgaagagatttcgccgggaagaggaagaggccggggtgctatggtga

SEQ ID NO: 14471 - RNA, 9876 nt, synthetic construct
  misc_feature 1..9876: note = derived and/or modified CDS sequence (opt3) from DENV-2__EU596495__SS-prME
  source 1..9876: mol_type = other RNA
accgccggagtgatagtaatgctgattcccactgctatggctttccacctcactacgaggaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacaggaaaggactcccctgtcaacatcgaagccgagcccccatttggcgatagctacatcattataggggtggaacctggacagttaaaactgaattggttcaagaagggttcgtctatcggccaaatgtttgagactaccatgcgaggggctaaacgcatggccattctaggagacacagcatgggatttcggctccctcggtggggtttttacttcaatcggcaaggccctgcaccaggtgttcggagctatttacggcgcggcatttagtggggtaagctggaccatgaaaatccttataggagtcatcattacgtggatcggcatgaactccagatctactagcttgtcagtgagtctggttctcgtgggtgtcgtgaccctgtatcttggggccgtagtgcaggctgactccggatgtgttgtcagctggaagaataaagagctgaagtgcggctctggtattttcatcactgataacgtgcacacatggaccgaacagtacaagtttcaacccgagtcaccaagtaaattggccagcgcaatacagaaggcccatgaagagggcatttgtgggatcaggtccgtgactcggctcgaaaatctgatgtggaaacagattacccccgagttaaaccacatcctgtctgagaatgaagtcaagctaacaataatgacgggagacatcaaaggcattatgcaggctgggaagcgctcgctcagacctcaaccaaccgagctgaaatatagctggaagacttggggaaaggccaaaatgctttccacagaatcacataaccagaccttcttgatcgatggcccggagacagcagaatgccccaatactaacagggcgtggaatagtctggaggttgaggactacggttttggggtgttcaccacgaacatttggctcaagctgcgtgaaaaacaggacgtgttttgtgattctaagttaatgagcgctgccatcaaagacaatcgggcagtacacgccgatatgggatattggatagagtccgctctgaacgacacatggaagatggaaaaggcctcattcattgaggtcaaaagctgccactggcctaagtctcataccctttggtccaatggcgtgttggagagtgaaatgatcatccccaagaatttcgcaggtcccgttagccagcacaactaccgacctggctatcatactcaaaccgctgggccatggcacctcggaaagctggagatggattttgacttctgtgaaggcacaactgtggtcgtgaccgaggattgcgggaatagaggaccctctctaaggacaacgaccgcctccggcaaactgattactgaatggtgctgtcgctcatgcacactcccgcctctgcggtacagaggtgaggacgggtgttggtacggaatggagatcaggccacttaaggaaaaggaggaaaacttggttaatagtctggtgaccgcgggccatggtcagattgataactttagcttaggcgtactcgggatggccctgttccttgaggaaatgctgcgcactcgaataggaacaaaacacgctatcttgctcgtcgcagtgtcgtttgtgaccctgattacgggcaatatgtccttccgggacctagggcgtgtcatggttatggtgggagccactatgaccgatgacatcggcatgggtgtaacatatctggctctcctggccgcatttaaggtgagacccaccttcgcggccgggcttttgctgaggaaattaacttctaaggagctcatgatggctacaattggaatcgccctgcttagccagtcaaccatacctgagacaatcctggaactaactgatgcactcgctctgggcatgatggtcttgaaaattgtgcgcaacatggagaagtaccaactggccgttaccatcatggcaattagttgcgtgcccaatgccgtcatcttacagaacgcttggaaggtgtcctgtacgatactcgcggccgtttctgtgagcccactgcttctgacatcctcacagcagaaagcagactggattcctttggctctcaccatcaagggcctgaatcccactgccatctttctaaccacactgagccggacaagtaaaaagagatcttggccacttaacgaagccattatggctgtcgggatggtatccatactcgcaagctcgctgttgaaaaatgacatcccgatgaccggacctctggtggccggtggcttactcacggtttgctatgtgctgacagggaggtcagcggatcttgagctggaacgagctgccgacgtcaagtgggaggatcaagcagagatttctggaagttcccccatcttgagcattaccatctctgaagacggcagcatgtccatcaaaaacgaggaagaggagcagactctcacaatcctgattcgcaccggtctactggtgatctcaggggtattcccagtgagtattcccatcactgccgctgcatggtacctttgggaagtcaagaagcagcgggccggagttctctgggatgtgcctagcccaccccctgtggagaaagcggaactggaggacggcgcttatagaataaagcagaggggcattttggggtactctcaaatcggagccggtgtctataaagaaggcacatttcacaccatgtggcatgtgacgcgtggggcagttttaatgcaccgcggaaagcggatcgagccgtcctgggccgatgtcaaaaaggacctgatttcatacggcggtgggtggaagctcgagggagaatggaaagagggcgaagaggtgcaggtcctggctcttgaaccaggcaagaatcccagagccgtgcagactaaacctgggatcttcaagaccaacacaggaaccataggtgcagttagtctggattttagcccaggcacatccgggtctcccattgtggacaggaaaggaaaggtcgtgggcttgtacggtaatggggtagtcactcgatcgggagcttatgtgagcgccatcgcgcagaccgagaagtcaattgaggataaccctgaaatcgaggacgatatattccggaaaaagcgcctaacgattatggacctgcatccgggcgccggcaaaacaaagagatacctccccgcaatcgttagggaagctatcaaacgggggctgcgaactcttattttagccccaaccagagtggtcgctgcagagatggaagaggccctgcgcggactccctatcaggtatcaaacacccgccattaagaccgagcacactggtcgtgaaatagtggacttgatgtgtcatgctaccttcacaatgcggctgctctccccagttagagtgcctaactacaatctgatcattatggatgaggcgcactttacggaccccgcaagtatcgccgctaggggctatatctctactcgcgtcgaaatgggggaggccgcaggaattttcatgaccgccacaccaccgggcagccgagatccttttccccagtccaacgctccaataatggacgaggaaagagagatccccgaacggtcatggaactctggtcacgagtgggtgaccgatttcaaggggaaaactgtatggtttgtgcctagcattaaggcgggaaacgacatcgccgcatgccttaggaaaaatggcaagaaagttattcagctgagtcgcaagacattcgattccgaatacgtcaagacccgtgctaacgactgggattttgtggtgacgactgacatcagcgagatgggcgccaatttcaaagcagagagagtcatagatccacggaggtgtatgaagcccgtaatcttgacagacggggaagaacgcgtgattctagccggacctatgccggttacccattcttcagctgcccaacgaagaggtcggatcggcaggaaccccaaaaatgaaaacgaccagtatatttacatgggggagcccctggaaaatgatgaggactgcgcgcactggaaggaggcaaaaatgctcttagataacatcaatacccctgaaggaataattccctccatgtttgagccagaacgcgagaaggtggacgccatcgatggcgaatacagactgaggggtgaggctcggaaaactttcgtcgaccttatgcgtcgcggggatctgcctgtgtggctcgcctataaggttgctgcagagggcattaactacgccgaccgaaagtggtgttttgatggaatcaaaaataaccagatattggaagagaacatggaagtggagatctggacaaaggagggcgaaaggaaaaagctgaaacccagatggctcgacgctcggatttatagtgatccactggcccttaaggagttcaaggagttcgcagcggggcgcaaaagcctaaccctgaatttgatcacagagatgggaagattacctacttttatgacgcagaaggccaggaacgctctggacaatctcgccgtcctgcataccgcagaagctggtggccgggcctacaaccacgcactttcggagctgccggagacactcgaaactttgctgctactgaccctccttgccacagtgaccgggggaattttcctgtttttaatgtctggcaaaggtatcgggaagatgactttgggcatgtgctgcataattacggcttccatcctgctctggtatgcgcaaatccagccccactggattgccgcaagcatcatactggagttctttcttattgtactgctcatcccagaacctgagaaacagcgaaccccacaggataatcaattgacatacgtggttattgctatcctgactgtcgtggccgccaccatggcaaacgaaatgggattcttagagaagacaaagaaagacctaggcctggggtcaataaccactcaggagagtgaatctaatatcctcgacattgatcttagaccagcttccgcctggacactgtatgcggtggctacgacctttgtcactcctatgttgcgccatagcatcgagaactcaagtgttaatgtgagcctgacagccattgcaaaccaggccaccgtactcatgggactgggtaagggctggcccctttccaaaatggacatcggggtgccgctcctggctattggatgttactctcaggtcaatccaatcaccttgacagcagccctgttactactggtggcgcactacgctataattggccctggtctccaagccaaggcaactagggaagcccagaaacgggctgccgcagggatcatgaagaaccccacggttgatggcatcaccgtgattgaccttgagccaataccctatgatcctaagttcgaaaaacagctgggacaggtcatgttgctgatcctctgcgtaacacaagtgctgatgatgcgtactacctgggctctttgtgaggccttaacactggcgaccggcccgattagcactctctgggaggggaatcccggaagattttggaacacgacaatcgccgtttccatggcaaatattttcaggggctcatacttggctggtgccgggctgctattttctatcatgaagaacaccacaagtacccgccggggaacaggcaatataggtgaaactctgggcgagaaatggaagtcgcgactcaacgcacttgggaaaagcgagttccagatctataagaaatccggcattcaggaggtggacagaaccctggctaaggagggcatcaagagaggggaaacagatcatcacgccgtctctcgcggatcagccaaattgcggtggtttgtggagagaaacatggtcacgccagaaggcaaggtggttgacctgggttgcgggcgtggaggctggagctactattgtggtggcctcaaaaatgtgagggaggtaaaggggctgaccaaaggaggccctgggcatgaagaaccaattcctatgtccacttacggatggaacttagtgcggcttcaaagtggcgtcgatgttttcttcacaccacccgagaagtgcgacaccctgctctgtgatatcggtgaatctagccctaatccaactatagaggcggggcgcacactacgagtgctgaacttggtcgaaaattggctgaacaataacacccagttttgcattaaggtgctcaatccctatatgccgtcagtaatcgagaaaatggaagcacttcagagacagtacggaggcgcactggtgaggaaccctttgtcccggaatagtacgcacgagatgtactgggttagcaacgccaccggcaatatcgtgtcttccgtcaacatgatttcacgcatgctgataaatagattcacaatgaagcacaaaaaggctacttatgagccagacgtggatctcgggagcggaaccaggaacatcggtattgaatcggagatccccaacttagacattatcggcaaacgaatagaaaagatcaagcaagagcatgaaatttcttggcactacgaccaggatcatccttataaaacatgggcctaccacgggagttatgagactaagcagaccggatccgcaagctcaatggtcaatggcgtggttcggctgcttacaaaaccatgggacgtagtgcccatggtcacccagatggccatgactgatacgacaccgtttggtcaacagcgtgtgttcaaggagaaagttgacaccagaactcaggaacctaaggaggggaccaagaaactgatgaagatcacagctgaatggctatggaaagagctcggaaagaaaaagacgccccgcatgtgtaccagggaggaatttactaaaaaggtgcggtccaacgcggccctgggcgcaattttcacagatgagaataagtggaaatctgctagagaagccgtcgaggacggccgcttttgggaattggtggatagggagcgaaacctgcacctcgaggggaagtgcgaaacctgtgtatacaatatgatgggaaaacgggagaagaaacttggtgagttcggcaaggcaaaggggagcagagccatctggtatatgtggctgggagctaggtttttagagttcgaagccctgggctttttgaacgaggaccattggttcagtcgcggtaattccctcagcggggtggagggagaaggcctgcaccgtctaggctacattcttcgggatgttgggaaaaaggagggaggtgcgatgtacgcagacgatactgccggctgggacacaagaataaccctggaagacctcaaaaacgaggaaatggtcacaaatcatatgaagggggagcacaaaaagctggctgaggccatctttaagttgacttatcagaacaaagtggtgagggtccaacgcccaacccctcgaggaacggttatggatattatctctcggagagaccagaggggctcaggtcaggtggggacctacggactgaatacattcactaacatggaagcacaactcatccgccagatggagggcgaaggcattttcaagagtatacagcatcttaccgctacagaggagatcgccgtacagaattggctggctagagtggggcgggaaaggttatcccgtatggccattagcggagatgactgcgtcgtgaaacccatcgatgaccgatttgcatctgcgctgactgccttgaacgatatgggtaaggttcgcaaagacattcaacagtgggagccatcgagaggctggaatgattggacccaggtgcccttctgctcacaccactttcatgaactcgtcatgaaggacgggcgggtgctggtagttccttgtaggaaccaggatgagctaatcggacgcgctagaataagccaaggcgccggttggtcccttaaggaaacggcatgcctggggaaaagttatgctcagatgtggacactcatgtacttccaccggagggacctgcgattggccgcaaacgccatctgttctgcggtgccaagccattgggtcccgacctcccgtactacatggtcaattcacgctaagcacgagtggatgaccactgaggatatgttagccgtgtggaatagagtgtggatccaggaaaacccctggatggaggacaaaacccctgtcgaaagttgggaggaagttccatatctgggaaagcgcgaggaccagtggtgcggctctctcattggccttacaagccgggcaacgtgggccaaaaatatccaaaccgctataaaccaggtgaggtccctgattgggaatgaggaatacactgattatatgccctcaatgaagagatttcgccgggaggaagaggaagccggagtactatggtga

SEQ ID NO: 14472 - RNA, 9876 nt, synthetic construct
  misc_feature 1..9876: note = derived and/or modified CDS sequence (opt3) from DENV-2__EU596497__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactatcaccgagagtcgctgtccaacacaaggagagccctccctgaatgaagagcaggacaaacgatttatctgcaagcattctatggtcgatagaggctggggtaacgggtgtggactattcggcaagggcgggattgtgacttgcgccatgtttacctgcaaaaagaatatggaaggaaaagtggtccagcctgagaacctcgaatacacaatagttatcaccccacacagcggtgaggagcatgctgtgggcaatgacactgggaagcacggaaaagaaattaagatcacgccgcagtcctcaataacagaggccgaactgaccggctatggtactgtaaccatggagtgtagtcccaggacagggcttgatttcaacgaaatggtgctgttgcaaatggaggacaaagcatggctcgtccaccggcagtggtttctggatttacctctgccatggctccccggcgctgacacccagggaagcaattggattcagaaggagactcttgtgacattcaagaaccctcatgccaaaaagcaagacgttgtggtcctgggctctcaggaaggggcgatgcacacggccttgaccggagcaactgagatccagatgtcctcaggtaatctactgtttacaggccatctcaaatgccgtctgcgcatggataagcttcaactgaaagggatgagctacagtatgtgtaccggaaagttcaagatcgtgaaagaaattgctgagacacagcacggcactatcgtaattagagttcagtatgagggtgacgggtctccatgcaagatacccttcgaaatcaccgatttggagaaaaggcatgtgctcggccggctgattacggtcaacccgatcgtgaccgaaaaggactcccctgtcaacatcgaggccgaacccccatttggagatagctacattataatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtttttacatcaattgggaaggccctgcaccaggtgttcggcgctatctacggagcggcatttagtggcgtaagctggactatgaaaatacttatcggggtcattatcacctggattggaatgaactccagatctacgagcttgtcagtgagtctggttctcgtgggcgtcgtgacactgtatcttggtgccgtagtgcaggctgactccgggtgtgttgtcagctggaagaataaagaactgaagtgcggatctggcatcttcataaccgataacgtgcacacttggacagagcagtacaagtttcaacccgaatcaccaagtaaattggccagcgcaattcagaaggcccatgaggaaggtatctgtggcattaggtccgtgacccggctcgagaatctgatgtggaaacagatcactcccgagttaaaccacatactgtctgaaaatgaggtcaagctaaccatcatgacaggggacattaaaggaatcatgcaggctggcaagcgctcgctcagacctcaaccaacggaactgaaatatagctggaagacctgggggaaggccaaaatgctttccactgagtcacataaccagacattcttgattgatggaccggaaaccgcagagtgccccaatacaaacagggcgtggaatagtctggaggttgaagactacggctttggtgtgttcactaccaacatctggctcaagctgcgtgagaaacaggacgtgttttgtgattctaagttaatgagcgctgccataaaagacaatcgggcagtacacgccgatatggggtattggattgaatccgctctgaacgacacgtggaagatggagaaggcctcattcatcgaggtcaaaagctgccactggcctaagtcttacacactttggtccaatggagtgttggaaagtgagatgatcattccaaaaaacttcgcaggccccgttagccagcataactatcgacctggttaccacacccaaactgctggcccatggcatctcgggaagctggaaatggattttgacttctgtgagggaaccacagtggtcgtgactgaagattgcggcaatagagggccctctctaaggaccacaacggcctccggaaaactgatcaccgagtggtgctgtcgctcatgcactctcccgcctctgcggtacagaggcgaggacggttgttggtatgggatggaaattaggccacttaaggagaaggaagagaacttggttaatagtctggtgacagcgggacacggccagatagataactttagcttaggtgtactcggcatggccctgttccttgaagagatgctgcgcacccgaatcgggactaaacatgctattttgctcgtcgcagtgtcgtttgtgacactgatcaccggaaatatgtccttccgggacctaggccgtgtcatggttatggtgggggccacgatgactgatgacattggaatgggcgtaacctacctggctctcctggccgcatttaaggtgagacccacattcgcggccggtcttttgctgaggaaattaacctctaaggagctcatgatggctactatcgggatagccctgcttagccagtcaacaatccctgaaaccattctggagctaacagatgcactcgctctgggaatgatggtcttgaaaatcgtgcgcaacatggaaaagtatcaactggccgttactattatggcaatcagttgcgtgcccaatgccgtcatattacagaacgcttggaaggtgtcctgtaccattctcgcggccgtttctgtgagcccactgcttctgacgtcctcacagcagaaagcagactggatccctttggctctcacaatcaagggcctgaatcccaccgccatttttctaactaccctgagccggacaagtaaaaagagatcttggccacttaacgaggccataatggctgtcggcatggtatccatcctcgcaagctcgctgttgaaaaatgacattccgatgactgggcctctggtggccggaggtttactcaccgtttgctacgtgctgacgggcaggtcagcggatcttgaactggagcgagctgccgacgtcaagtgggaggatcaagcagaaatctctgggagttcccccattttgagcatcacaatatctgaggacggaagcatgtccatcaaaaacgaagaggaggaacagaccctcactattctgatccgcacaggcctactggtgatttcaggtgtattcccagtgagtatccccataaccgccgctgcatggtatctttgggaggtcaagaagcagcgggccggggttctctgggatgtgcctagcccaccccctgtggaaaaagcggagctggaagacggagcttacagaattaagcagaggggcatcttgggctattctcaaatcggggccggagtctacaaagagggtacttttcacacaatgtggcacgtgacccgtggcgcagttttaatgcatcgcgggaagcggattgagccgtcctgggccgatgtaaaaaaggacctgatctcatacggaggcggttggaagctcgaaggggagtggaaagaaggagaggaagtgcaggtcctggctcttgagccaggcaagaatcccagagccgtgcagacgaaacctggcatattcaagactaacaccgggacaattggagcagttagtctggattttagcccaggtacctccggctctcccatcgtggacaggaaagggaaggtcgtgggattgtatggcaatggtgtagtcacacgatcgggggcttacgtgagcgccattgcgcagactgagaagtcaatcgaagataaccctgagatagaagacgatattttccggaaaaagcgcctaaccatcatggacctgcacccgggagccggcaaaacgaagagatatctccccgcaatcgttagggaggctattaaacggggcctgcgaacacttatcttagccccaactagagtggtcgctgcagaaatggaggaggccctgcgcgggctccctattaggtaccaaacccccgccataaagacagaacataccggacgtgagatcgtggacttgatgtgtcacgctactttcaccatgcggctgctctccccagttagagtgcctaactataatctgattatcatggatgaagcgcattttacagaccccgcaagtatcgccgctaggggttacatttctacgcgcgtcgagatgggcgaggccgcagggatattcatgactgccaccccaccgggaagccgagatccttttccccagtccaacgctccaatcatggacgaagagagagaaattcccgagcggtcatggaattctggccacgaatgggtgacagatttcaagggtaaaaccgtatggtttgtgcctagcatcaaggcggggaacgacattgccgcatgccttaggaaaaatggaaagaaagttatccagctgagtcgcaagactttcgattccgagtatgtcaagacacgtgctaacgactgggattttgtggtgaccacggacataagcgagatgggcgccaatttcaaagcagaaagagtcatcgatccacggaggtgtatgaagcccgtaattttgactgacggcgaggaacgcgtgatcctagccgggcctatgccggttacacactcttcagctgcccaacgaagaggacggattggtaggaacccaaaaaatgagaacgaccagtacatctacatgggcgaacccctggagaatgatgaggactgcgcgcattggaaggaagcaaaaatgctcttagataacataaatacccctgaggggattatcccctccatgtttgaaccagagcgcgaaaaggtggacgccattgatggagagtatagactgaggggcgaggctcggaaaaccttcgtcgaccttatgcgtcgcggtgatctgcctgtgtggctcgcctacaaggttgctgcagaagggatcaactatgccgaccgaaagtggtgttttgatggcataaaaaataaccagatcttggaggaaaacatggaggtggagatttggactaaggaaggagagagaaaaaagctgaaacccaggtggctcgacgctcggatctacagtgatccactggcccttaaggaattcaaggagttcgcagcgggccgcaaaagcctaacactgaatttgattaccgaaatggggagattacctacatttatgactcagaaggccaggaacgctctggacaatctcgccgtcctgcacacggcagaggctggaggtcgggcctataaccatgcactttcggagctgccggaaaccctcgagacattgctgctactgactctccttgccaccgtgacaggcgggatcttcctgtttttaatgtctggaaaaggcataggtaagatgaccttggggatgtgctgcattatcactgcttccatcctgctctggtacgcgcaaattcagccccactggatcgccgcaagcataattctggaattctttcttatcgtactgctcattccagagcctgaaaaacagcgaacgccccaggataatcaattgacctatgtggttatcgctatactgacagtcgtggccgccactatggcaaacgagatgggcttcttagagaagaccaagaaagacctaggactgggctcaatcacaacccaggaaagtgagtctaatattctcgacatcgatcttagaccagcttccgcctggactctgtacgcggtggctacaacgtttgtcacccctatgttgcgccacagcattgaaaactcaagtgttaatgtgagcctgactgccatcgcaaaccaggccacagtactcatggggctgggaaagggttggcccctttccaaaatggacattggcgtgccgctcctggctatcgggtgttactctcaggtcaatccaataaccttgaccgcagccctgttactactggtggcgcattatgctattatcggacctggcctccaagccaaggcaacaagggaggcccagaaacgggctgccgcaggtatcatgaagaaccccactgttgatgggattacggtgatagaccttgaaccaatcccctacgatcctaagttcgagaaacagctgggccaggtcatgttgctgattctctgcgtaacccaagtgctgatgatgcgtacaacttgggctctttgtgaggccttaaccctggcgacaggaccgatcagcaccctctgggaaggcaatcccgggagattttggaacactacgattgccgtttccatggcaaatatcttcaggggatcatatttggctggcgccggtctgctattttctataatgaagaacacaaccagtactcgccgggggaccggaaatatcggcgagacactgggtgaaaaatggaagtcgcgactcaacgcacttggcaaaagcgagttccagatttacaagaaatccgggatccaggaggtggacagaactctggctaaggaaggaattaagaggggcgagaccgatcaccatgccgtctctcgcgggtcagccaaattgcggtggtttgtggaaagaaacatggtcacaccagagggaaaggtggttgacctgggctgcggtcgtgggggatggagctattactgtggcggtctcaaaaatgtgagggaagtaaagggcctgacgaaagggggacctggccacgaggagcccatccctatgtccacctatgggtggaacttagtgcggcttcaaagtggagtcgatgttttcttcactccacccgaaaagtgcgacacactgctctgtgatataggcgagtctagccctaatccaaccattgaagcgggtcgcactctacgagtgctgaacttggtcgagaattggctgaacaataacacacagttttgcatcaaggtgctcaatccctacatgccgtcagtaatcgaaaaaatggaggctcttcagagacagtacgggggagcactggtgaggaaccctttgtcccggaatagtacccatgagatgtattgggttagcaacgccacgggcaatattgtgtcttccgtcaacatgatatcacgcatgctgatcaatagattcaccatgaagcacaaaaaggctacatacgaaccagacgtggatctcggcagcgggactaggaacattggaatcgagtcggaaattcccaacttagacatcataggtaaacgaatcgagaagattaagcaagaacacgagatctcttggcattatgaccaggatcacccttacaaaacctgggcctatcatggcagttacgagacaaagcagactgggtccgcaagctcaatggtcaatggagtggttcggctgcttaccaaaccatgggacgtagtgcccatggtcacacagatggccatgaccgatactacgccgtttggccaacagcgtgtgttcaaggaaaaagttgacacaagaacccaggagcctaaggaaggtactaagaaactgatgaagattaccgctgagtggctatggaaagagctcgggaagaaaaagacaccccgcatgtgtacgagggaagagtttaccaaaaaggtgcggtccaacgcggccctgggagcaatcttcactgatgaaaataagtggaaatctgctagagaggccgtcgaagacggccgcttttgggagttggtggatagggagcgaaacctgcacctcgaaggcaagtgcgagacatgtgtatataatatgatggggaaacgggaaaagaaacttggagagttcggtaaggcaaagggcagcagagccatttggtacatgtggctgggggctaggtttttagaattcgaggccctgggatttttgaacgaggaccactggttcagtcgcggcaattccctcagcggtgtggaaggggagggactgcatcgtctaggctacatacttcgggatgttggcaaaaaggaagggggagcgatgtatgcagacgataccgccggttgggacactagaatcacactggaggacctcaaaaacgaagagatggtcaccaatcacatgaagggcgagcataaaaagctggctgaagccatttttaagttgacataccagaacaaagtggtgagggtccaacgcccaactcctcgagggaccgttatggatatcatctctcggagagaccagaggggatcaggccaggtgggtacgtatgggctgaataccttcacaaacatggaggcacaactcattcgccagatggaaggagagggcatattcaagagtatccagcaccttactgctaccgaggaaattgccgtacagaattggctggctagagtgggccgggagaggttatcccgtatggccatcagcggggatgactgcgtcgtgaaacccattgatgaccgatttgcatctgcgctgacagccttgaacgatatgggaaaggttcgcaaagacatccaacagtgggaaccatcgagaggttggaatgattggactcaggtgcccttctgctcacatcactttcacgagctcgtcatgaaggacggccgggtgctggtagttccttgtaggaaccaggatgaactaatagggcgcgctagaatcagccaaggagccggctggtcccttaaggagaccgcatgcctgggtaaaagttacgctcagatgtggacgctcatgtatttccatcggagggacctgcgattggccgcaaacgccatttgttctgcggtgccaagccactgggtcccgacatcccgtaccacttggtcaatccatgctaagcacgagtggatgacaaccgaagatatgttagccgtgtggaatagagtgtggattcaggagaacccctggatggaagacaaaactcctgtcgagagttgggaagaggttccatacctggggaagcgcgaggaccagtggtgcggatctctcatcggccttaccagccgggcaacatgggccaaaaatatacaaacggctattaaccaggtgaggtccctgatcggcaatgaagagtataccgattacatgccctcaatgaagagatttcgccgggaagaggaagaggccggggtactatggtga

SEQ ID NO: 14473 - RNA, 9876 nt, synthetic construct
  misc_feature 1..9876: note = derived and/or modified CDS sequence (opt3) from DENV-2__EU569695__SS-prME
  source 1..9876: mol_type = other RNA
accgccggcgtgatagtaatgctgattccaactgctatggctttccacctcactacgagaaacggggaacctcatatgatagttggaaggcaggaaaagggtaaaagccttctgtttaagaccgaagacggcgtgaatatgtgcacattgatggccatcgatttaggggaactgtgtgaagacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatagaatccgctctgaacgacacatggaagatggagaaggcctcattcattgaggtcaaaagctgccactggcctaagtctcataccctttggtccaatggagtgttggaaagtgagatgatcatccccaagaatttcgcaggccccgttagccagcacaactaccgacctggttatcatactcaaaccgctggcccatggcacctcgggaagctggaaatggattttgacttctgtgagggaacaactgtggtcgtgaccgaagattgcggcaatagagggccctctctaaggacaacgaccgcctccggaaaactgattactgagtggtgctgtcgctcatgcacactcccgcctctgcggtacagaggcgaggacggttgttggtacgggatggaaatcaggccacttaaggagaaggaagagaacttggttaatagtctggtgaccgcgggacatggccagattgataactttagcttaggtgtactcggcatggccctgttccttgaagagatgctgcgcactcgaatagggacaaaacacgctatcttgctcgtcgcagtgtcgtttgtgaccctgattacgggaaatatgtccttccgggacctaggccgtgtcatggttatggtgggggccactatgaccgatgacatcggaatgggcgtaacatatctggctctcctggccgcatttaaggtgagacccaccttcgcggccggtcttttgctgaggaaattaacttctaaggagctcatgatggctacaattgggatcgccctgcttagccagtcaaccatacctgaaacaatcctggagctaactgatgcactcgctctgggaatgatggtcttgaaaattgtgcgcaacatggaaaagtaccaactggccgttaccatcatggcaattagttgcgtgcccaatgccgtcatcttacagaacgcttggaaggtgtcctgtacgatactcgcggccgtttctgtgagcccactgcttctgacatcctcacagcagaaagcagactggattcctttggctctcaccatcaagggcctgaatcccactgccatctttctaaccacactgagccggacaagtaaaaagagatcttggccacttaacgaggccattatggctgtcggcatggtatccatactcgcaagctcgctgttgaaaaatgacatcccgatgaccgggcctctggtggccggaggtttactcacggtttgctatgtgctgacaggcaggtcagcggatcttgaactggagcgagctgccgacgtcaagtgggaggatcaagcagaaatttctgggagttcccccatcttgagcattaccatctctgaggacggaagcatgtccatcaaaaacgaagaggaggaacagactctcacaatcctgattcgcaccggcctactggtgatctcaggtgtattcccagtgagtattcccatcactgccgctgcatggtacctttgggaggtcaagaagcagcgggccggggttctctgggatgtgcctagcccaccccctgtggaaaaagcggagctggaagacggagcttatagaataaagcagaggggcattttgggctactctcaaatcggggccggagtctataaagagggtacatttcacaccatgtggcatgtgacgcgtggcgcagttttaatgcaccgcgggaagcggatcgagccgtcctgggccgatgtcaaaaaggacctgatttcatacggaggcggttggaagctcgaaggggagtggaaagaaggagaggaagtgcaggtcctggctcttgagccaggcaagaatcccagagccgtgcagactaaacctggcatcttcaagaccaacacagggaccataggagcagttagtctggattttagcccaggtacatccggctctcccattgtggacaggaaagggaaggtcgtgggattgtacggcaatggtgtagtcactcgatcgggggcttatgtgagcgccatcgcgcagaccgagaagtcaattgaagataaccctgagatcgaagacgatatattccggaaaaagcgcctaacgattatggacctgcatccgggagccggcaaaacaaagagatacctccccgcaatcgttagggaggctatcaaacggggcctgcgaactcttattttagccccaaccagagtggtcgctgcagaaatggaggaggccctgcgcgggctccctatcaggtatcaaacacccgccattaagaccgaacacactggacgtgagatagtggacttgatgtgtcatgctaccttcacaatgcggctgctctccccagttagagtgcctaactacaatctgatcattatggatgaagcgcactttacggaccccgcaagtatcgccgctaggggttatatctctactcgcgtcgagatgggcgaggccgcagggattttcatgaccgccacaccaccgggaagccgagatccttttccccagtccaacgctccaataatggacgaagagagagaaatccccgagcggtcatggaactctggccacgaatgggtgaccgatttcaagggtaaaactgtatggtttgtgcctagcattaaggcggggaacgacatcgccgcatgccttaggaaaaatggaaagaaagttattcagctgagtcgcaagacattcgattccgagtacgtcaagacccgtgctaacgactgggattttgtggtgacgactgacatcagcgagatgggcgccaatttcaaagcagaaagagtcatagatccacggaggtgtatgaagcccgtaatcttgacagacggcgaggaacgcgtgattctagccgggcctatgccggttacccattcttcagctgcccaacgaagaggacggatcggtaggaaccccaaaaatgagaacgaccagtatatttacatgggcgaacccctggagaatgatgaggactgcgcgcactggaaggaagcaaaaatgctcttagataacatcaatacccctgaggggataattccctccatgtttgaaccagagcgcgaaaaggtggacgccatcgatggagagtacagactgaggggcgaggctcggaaaactttcgtcgaccttatgcgtcgcggtgatctgcctgtgtggctcgcctataaggttgctgcagaagggattaactacgccgaccgaaagtggtgttttgatggcatcaaaaataaccagatattggaggaaaacatggaggtggagatctggacaaaggaaggagagaggaaaaagctgaaacccagatggctcgacgctcggatttatagtgatccactggcccttaaggagttcaaggagttcgcagcgggccgcaaaagcctaaccctgaatttgatcacagaaatggggagattacctacttttatgacgcagaaggccaggaacgctctggacaatctcgccgtcctgcataccgcagaggctggaggtcgggcctacaaccacgcactttcggagctgccggaaacactcgagactttgctgctactgaccctccttgccacagtgaccggcgggattttcctgtttttaatgtctggaaaaggcatcggtaagatgactttggggatgtgctgcataattacggcttccatcctgctctggtatgcgcaaatccagccccactggattgccgcaagcatcatactggagttctttcttattgtactgctcatcccagagcctgaaaaacagcgaaccccacaggataatcaattgacatacgtggttattgctatcctgactgtcgtggccgccaccatggcaaacgagatgggcttcttagagaagacaaagaaagacctaggactgggctcaataaccactcaggaaagtgagtctaatatcctcgacattgatcttagaccagcttccgcctggacactgtatgcggtggctacgacctttgtcactcctatgttgcgccatagcatcgaaaactcaagtgttaatgtgagcctgacagccgtagcaaaccaggccaccgtgctcatggggctgggaaagggttggcccctttccaaaatggacattggcgtcccgctcctggctatcgggtgttactctcaggtgaatccaattaccttgacagcagccctgttactactggttgcgcactacgctatcataggacctggcctccaagccaaggcaactagggaggcccagaaacgggctgccgcaggtattatgaagaaccccacggtggatgggatcaccgtcatcgaccttgaaccaattccctatgatcctaagttcgagaaacagctgggccaggtaatgttgctgatactctgcgtgacacaagttctgatgatgcgtactacctgggctctttgtgaggccttaacactggcgaccggaccgatcagcactctctgggaaggcaatcccgggagattttggaacacgacaattgccgtgtccatggcaaatatcttcaggggatcatacttggctggcgccggtctgctattttctattatgaagaacaccacaagtacccgccgggggacaggaaatatcggcgagactctgggtgaaaaatggaagtcgcgactcaacgcacttggcaaaagcgagttccagatatataagaaatccgggatccaggaggtcgacagaaccctggctaaggaaggaattaagaggggcgagacagatcatcacgccgtgtctcgcgggtcagccaaattgcggtggtttgtcgaaagaaacatggtgacgccagagggaaaggttgtggacctgggctgcggtcgtgggggatggagctactattgtggcggtctcaaaaatgtaagggaagtgaagggcctgaccaaagggggacctggccatgaggagcccatccctatgtccacttacgggtggaacttagtccggcttcaaagtggagttgatgtgttcttcacaccacccgaaaagtgcgacaccctgctctgtgatattggcgagtctagccctaatccaactatcgaagcgggtcgcacactacgagtcctgaacttggtggagaattggctgaacaataacacccagttttgcataaaggtactcaatccctatatgccgtcagtgattgagaaaatggaggcacttcagagacagtacgggggagcactggttaggaaccctttgtcccggaatagtacgcacgagatgtactgggtgagcaacgccaccggcaatatcgtctcttccgtgaacatgatctcacgcatgctgattaatagattcacaatgaagcacaaaaaggctacttatgaaccagacgtcgatctcggcagcgggaccaggaacataggaatcgagtcggaaattcccaacttagacatcattggtaaacgaatcgagaagataaagcaagaacatgagatctcttggcactacgaccaggatcatccttataaaacatgggcctaccacggcagttatgagactaagcagaccgggtccgcaagctcaatggtgaatggagttgtacggctgcttacaaaaccatgggacgtggtccccatggtgacccagatggccatgactgatacgacaccgtttggccaacagcgtgttttcaaggaaaaagtggacaccagaactcaggagcctaaggaaggtaccaagaaactgatgaagattacagctgagtggctatggaaagagctcgggaagaaaaagacgccccgcatgtgtaccagggaagagtttactaaaaaggtccggtccaacgcggccctgggagcaatcttcacagatgaaaataagtggaaatctgctagagaggccgtggaagacggccgcttttgggagttggtagatagggagcgaaacctgcacctcgaaggcaagtgcgagacctgtgtgtacaatatgatggggaaacgggaaaagaaacttggagagttcggtaaggcaaagggcagcagagccatttggtatatgtggctgggggctaggtttttagagttcgaggccctgggatttttgaacgaggaccattggttcagtcgcggcaattccctcagcggtgttgaaggggagggactgcaccgtctaggctacatccttcgggatgtcggcaaaaaggaagggggagcgatgtacgcagacgatactgccggttgggacacaagaattaccctggaggacctcaaaaacgaagagatggtgacaaatcatatgaagggcgagcacaaaaagctggctgaagccatatttaagttgacttatcagaacaaagtggtcagggttcaacgcccaacccctcgagggacggtgatggatatcatttctcggagagaccagaggggatcaggccaggtaggtacctacgggctgaatacattcactaacatggaggcacaactcatccgccagatggaaggagagggcatcttcaagagtattcagcatcttaccgctacagaggaaatagccgtgcagaattggctggctagagtcggccgggagaggttatcccgtatggccatcagcggggatgactgcgtggttaaacccattgatgaccgatttgcatctgcgctgactgccttgaacgatatgggaaaggtgcgcaaagacatccaacagtgggaaccatcgagaggttggaatgattggacccaggtccccttctgctcacaccactttcatgagctcgtgatgaaggacggccgggtactggttgtgccttgtaggaaccaggatgaactaattgggcgcgctagaatcagccaaggagccggctggtcccttaaggagacggcatgcctgggtaaaagttatgctcagatgtggacactcatgtacttccaccggagggacctgcgattggccgcaaacgccatatgttctgcggtcccaagccattgggtgccgacctcccgtactacatggtcaatccacgctaagcacgagtggatgaccactgaagatatgttagccgtgtggaatagagtctggattcaggagaacccctggatggaagacaaaacccctgttgagagttgggaagaggtgccatatctggggaagcgcgaggaccagtggtgcggatctctcatcggccttacaagccgggcaacgtgggccaaaaatattcaaaccgctatcaaccaggtaaggtccctgataggcaatgaagagtacactgattatatgccctcaatgaagagatttcgccgggaagaggaagaggccggggtgctatggtga

SEQ ID NO: 14474 - RNA, 9876 nt, synthetic construct
  misc_feature 1..9876: note = derived and/or modified CDS sequence (opt3) from DENV-2__EU482623__SS-prME
  source 1..9876: mol_type = other RNA
accgccggcgtgatagtaatgctgattccaacagctatggcattccacctcactacgagaaacggggagcctcatatgatagttggaaggcaggaaaagggtaaaagccttctgtttaagaccgaggacggcgtgaatatgtgcacattgatggccatagatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccacatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggttgacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcaggagagcaattggatacagaaggaaacacttgtgacgttcaagaaccctcatgccaaaaagcaagacgttgtggtcctgggatctcaggagggcgcgatgcacaccgccttgactggggcaacagaaattcagatgtcctcaggaaatctactgtttaccggtcatctcaaatgccgtctgcgcatggataaacttcaactgaaaggcatgagctacagtatgtgtacagggaagttcaagatcgtgaaagagatcgctgagactcagcacggaaccattgtaatcagagttcagtatgaaggcgacggttctccatgcaagattcccttcgagataacggatttggagaagaggcatgtgctcgggcggctgatcaccgtcaacccgattgtgacagagaaggactcccctgtcaacatcgaagccgagcccccatttggcgatagctacatcattataggagtggagcctggccagttaaaactgaattggttcaagaaggggtcgtctatcggacaaatgtttgaaactaccatgcgaggtgctaaacgcatggccattctaggcgacacagcatgggatttcgggtccctcggaggcgtttttacttcaatcggtaaggccctgcaccaggtgttcggggctatttacggcgcggcatttagtggagtaagctggaccatgaaaatccttataggcgtcatcattacgtggatcgggatgaactccagatctactagcttgtcagtgagtctggttctcgtgggagtcgtgaccctgtatcttggcgccgtagtgcaggctgactccggttgtgttgtcagctggaagaataaagagctgaagtgcgggtctggaattttcatcactgataacgtgcacacatggaccgaacagtacaagtttcaacccgagtcaccaagtaaattggccagcgcaatacagaaggcccatgaagagggcatttgtggtatcaggtccgtgactcggctcgagaatctgatgtggaaacagattacccccgaattaaaccacatcctgtctgagaatgaagtcaagctaacaataatgacgggcgacatcaaagggattatgcaggctggaaagcgctcgctcagacctcaaccaaccgagctgaaatatagctggaagacttggggcaaggccaaaatgctttccacagaatcacataaccagaccttcttgatcgatgggccggagacagcagagtgccccaatactaacagggcgtggaatagtctggaagttgaggactacggatttggcgtgttcaccacgaacatttggctcaagctgcgtgaaaaacaggacgtgttttgtgattctaagttaatgagcgctgccatcaaagacaatcgggcagtacacgccgatatgggttattggatagagtccgctctgaacgacacatggaagatggagaaggcctcattcattgaagtcaaaagctgccactggcctaagtctcataccctttggtccaatggggtgttggagagtgaaatgatcatccccaagaacttcgcaggacccgttagccagcacaactaccgacctggctatcatactcaaaccgctggtccatggcacctcggcaagctggagatggattttgacttctgtgaagggacaactgtggtcgtgaccgaggattgcggaaatagaggcccctctctaaggacaacgaccgcctccgggaaactgattactgagtggtgctgtcgctcatgcacactcccgcctctgcggtacagaggagaagacggctgttggtacggtatggagatcaggccacttaaggaaaaggaggaaaacttggttaatagtctggtgaccgcggggcatggacagattgataactttagcttaggcgtactcggtatggccctgcttctggaggagatgttgcgcactcgaataggcacaaaacacgctatcctcctggtcgcagtgtcgttcgtgaccctaattacggggaatatgtcctttcgggacctgggacgtgtcatggttatggtgggcgccactatgaccgatgacatcgggatgggagtaacatatctcgctctgcttgccgcattcaaggtgagacccacctttgcggccggcttgctgttaaggaaactcacttctaaggaactgatgatggctacaattggtatcgcccttctgagccagtcaaccatacctgagacaatcctagaactcactgatgcactggctttggggatgatggtcctgaaaattgtgcgcaacatggagaagtaccaattagccgttaccatcatggcaattagttgcgtgcccaatgccgtcatcctccagaacgcttggaaggtgtcctgtacgatactggcggccgtttctgtgagcccacttctgttgacatcctcacagcagaaagcagactggattcctctcgctctgaccatcaagggactaaatcccactgccatcttcctgaccacacttagccggacaagtaaaaagagatcttggccactcaacgaagccattatggctgtcggcatggtatccatactggcaagctcgttgctgaaaaatgacatcccgatgaccggccctttagtggccgggggactcctgacggtttgctatgtgcttacaggtaggtcagcggatctggagttggagcgagctgccgacgtcaagtgggaagatcaagcagagatttctggcagttcccccatcctcagcattaccatctctgaagacgggagcatgtccatcaaaaacgaggaggaagaacagactctgacaatcctaattcgcaccggactgcttgtgatctcaggcgtatttccagtgagtattcccatcactgccgctgcatggtacctctgggaagtcaagaagcagcgggccggtgttctgtgggatgtgcctagcccaccccctgtggagaaagcggaattggaggacggggcttatagaataaagcagaggggaattttaggctactctcaaatcggcgccggggtctataaagagggaacattccacaccatgtggcatgtgacgcgtggtgcagttctgatgcaccgcggcaagcggatcgaaccgtcctgggccgatgtcaaaaaggacctcatttcatacgggggaggctggaagctggagggtgaatggaaagagggggaagaggtgcaggtccttgctctggagccaggaaagaatcccagagccgtgcagactaaacctggcatctttaagaccaacagtggcacaataggggcagttagcttggatttctccccaggaacctctggttcgcccattgtggacaggaaaggcaaggtcgtggggctatacggaaatggcgtagtcacacgaagcggtgcttatgtgtcagccatcgcgcagactgaaaagtccattgaggataaccctgaaatcgaggacgatatatttcggaaaaagcgcctgaccattatggacctccatccgggggccggaaaaacgaagagatacctgcccgcaatcgttagggaagctatcaaacggggccttcgaacattaattctggccccaactagagtggtcgctgcagagatggaggaagccctccgcggcttgcctatcaggtatcaaacccccgccattaagacagagcacaccgggcgtgaaatagtggacctgatgtgtcatgctactttcaccatgcggctcctgagtccagttagagtgcctaactacaatcttatcattatggatgaggcgcacttcacagaccccgcatctatcgccgctaggggatatatcagcacgcgcgtcgagatgggtgaagccgcaggcatttttatgactgccaccccaccggggtcccgagatcctttcccccagtcaaacgctccaataatggacgaggaaagagagatccccgaacggtcttggaatagcggacacgagtgggtgacagattttaagggcaaaaccgtatggttcgtgcctagtattaaggcgggtaacgacatcgccgcatgcctgaggaaaaatgggaagaaagttattcagttgtcccgcaagacttttgatagcgagtacgtcaagacacgtgctatcgactgggatttcgtggtgaccacggacatatctgaaatgggagccaactttaaagcagagagagtcatcgatccacggaggtgtatgaagcccgtaattctaactgacggcgaagaacgcgtgatcctggccggccctatgccggttacacattcatccgctgcccaacgaagagggcggattggaaggaatcccaaaaacgaaaatgaccagtatatctacatgggtgagcccctcgagaacgatgaagactgcgcgcactggaaggaggcaaaaatgttactggataatataaacacccctgaaggcattatccccagtatgttcgagccagaacgcgagaaggtggacgccattgatggggagtacagacttaggggagaagctcggaaaacctttgtcgacctgatgcgtcgcggcgatctccctgtgtggttggcctataaggttgctgcagagggtatcaattacgccgaccgaaagtggtgtttcgatgggatcaaaaacaatcagatcctggaagagaacatggaggtggaaatttggactaaggagggcgaaaggaaaaagctcaaacccagatggctggacgctcggatctatagcgatccacttgccctaaaggagtttaaggagttcgcagcgggacgcaaatcgctgacattgaacttaattaccgagatgggcagactgcctacattcatgactcagaaggccaggaatgctctcgacaacctggccgtccttcatacggcagaggctgggggacgggcctacaatcacgcactgtctgaactcccggagaccttggaaacactgctactgctcactcttctggccaccgtgacaggtggcatctttttattcttgatgtccgggaaaggaataggcaagatgaccctgggtatgtgctgcattatcactgctagcatcctcctgtggtatgcgcaaattcagccccactggatcgccgcatcaataattcttgagtttttcctgatcgtactcttgattccagaacctgagaaacagcgaacgccccaggataaccaactgacctacgtggttatcgctatattaacagtcgtggccgccactatggcaaatgagatggggtttctagaaaagaccaagaaagacctgggcctcggaagtatcacaacccaggagtctgaatccaacattcttgacatcgatctgagaccagctagcgcctggactttgtatgcggtggctacaacgttcgtcacccctatgctgcgccattcaattgagaatagtagcgttaacgtgtccctcactgccatcgcaaatcaggccacagtactgatgggccttgggaagggatggcccctctctaaaatggacattggtgtgccgctgttggctatcggctgttacagccaggtcaacccaataaccctgaccgcagccttactactgctcgtggcgcactacgctattatcgggcctggacttcaagccaaggcaacaagggaagcccagaaacgggctgccgcaggcatcatgaagaatcccactgttgatggtattacggtgatagacctggagccaatcccctatgatcctaagtttgagaaacagttggggcaggtcatgctgctcattctgtgcgtaacccaagtgcttatgatgcgtacaacttgggctttatgtgaagccctgaccctcgcgacaggcccgatctccaccttgtgggagggaaaccccggcagattctggaatactacgattgccgtttcaatggcaaacatctttagggggtcttacctggctggagccggcctactgttcagtataatgaagaatacaacctcgactcgccggggtaccgggaacatcggagaaacactcggcgagaaatggaaaagccgacttaatgcactgggtaaatccgagtttcagatttataagaaatctggcatccaggaagtggacagaactttggctaaggaggggattaagaggggagaaaccgatcatcacgccgtctcacgcggcagcgccaaactgcggtggttcgtggagagaaacatggtcacaccagaagggaaggtggttgacctcggatgcggccgtggtgggtggtcctactattgtggaggcctgaaaaacgtgagggaggtaaagggtttaacgaaaggcgggcctggacatgaggaacccatccctatgagtacctacggctggaatcttgtgcggctgcaatctggggtcgatgtatttttcactccacccgagaagtgcgacacactcctatgtgatataggagaaagctcacctaacccaaccattgaggcgggccgcactctgcgagtgttgaatctggtcgaaaactggctcaataacaatacacagttctgcatcaaggtgcttaacccctatatgccgtccgtaatcgagaaaatggaggctctgcagagacagtacggtggggcattggtgaggaatcctctgagtcggaacagcacccacgaaatgtactgggtttctaatgccacgggaaacattgtgtcctcagtcaatatgataagccgcatgctcatcaacagatttaccatgaagcacaaaaaggctacatatgagccagacgtggatttaggctcgggcactaggaatattgggatcgaatctgagattcccaacctggacatcataggaaaacgaatcgaaaagattaagcaagagcatgagatcagttggcactacgaccaggatcatccttataaaacctgggcctaccacggttcctatgaaacaaagcagactggcagcgcatcatccatggtcaacggggtggttcggcttctgaccaaaccatgggacgtagtgcccatggtcacacagatggccatgaccgatactacgccgttcggacaacagcgtgtgtttaaggagaaagttgacacaagaacccaggaacctaaggagggcactaagaaactaatgaagattaccgctgagtggctctggaaagaactgggtaagaaaaagacaccccgcatgtgtacgagggaggagttcaccaaaaaggtgcggtctaatgcggccttgggggcaatctttactgatgagaacaagtggaaaagcgctagagaagccgtcgaggacggacgcttctgggagctggtggatagggaacgaaatctccaccttgagggcaagtgcgaaacatgtgtatacaacatgatgggcaaacgggagaagaaactgggggaatttggaaaggcaaagggtagtagagccatttggtatatgtggttaggcgctaggttcctggagtttgaggccttggggttcctcaatgaagaccattggttttcccgcggaaacagcctgtctggcgtggagggtgaagggctacaccgtcttggatacatactgcgggatgttggcaaaaaggagggcggggcgatgtacgcagacgataccgccggatgggacactagaatcacactcgaagacctgaaaaatgaggagatggtcaccaaccatatgaagggtgaacacaaaaagttggctgaggccattttcaagctgacatatcagaataaagtggtgagggtccaacgcccaactcctcgaggcaccgttatggatatcatctcacggagagaccagagggggagtggacaggtgggcacgtacggtctcaacacctttacaaatatggaagcacaacttattcgccagatggagggggagggaatattcaagtccatccagcatctgactgctaccgaagagattgccgtacagaactggttagctagagtgggccgggaaaggctgagccgtatggccatctctggcgatgactgcgtcgtgaaacccattgatgaccgattcgcatcggcgttgacagccctcaatgatatggggaaggttcgcaaagacatccaacagtgggagccatcaagaggatggaacgattggactcaggtgcccttttgcagccaccacttccatgaactggtcatgaaggacggtcgggtgctagtagttccttgtaggaatcaggatgagcttataggccgcgctagaatctcccaaggggccggatggagtctgaaggagaccgcatgcctcggcaaatcttatgctcagatgtggacgctgatgtactttcaccggagggacttgcgattagccgcaaacgccatttgtagcgcggtgccatcccattgggtcccgacatcacgtaccacttggagtatccacgctaagcacgaatggatgacaaccgaggatatgctggccgtgtggaacagagtgtggattcaggaaaatccctggatggaggacaaaactcctgtcgaatcttgggaggaggttccatatctcggtaagcgcgaagaccagtggtgcgggagccttatcggactgacctcccgggcaacatgggccaaaaacatacaaacggctattaatcaggtgaggtcactaatcggcaacgaggaatacaccgattatatgcccagcatgaagagattccgccgggaggaagaggaggccggcgtactgtggtga

SEQ ID NO: 14475 - RNA, 9876 nt, synthetic construct
  misc_feature 1..9876: note = derived and/or modified CDS sequence (opt3) from DENV-2__EU569698__SS-prME
  source 1..9876: mol_type = other RNA
accgccggcgtgatagtaatgctgattccaacagctatggctttccacctcactacgagaaacggggaacctcatatgatagttggaaggcaggaaaagggtaaaagccttctgtttaagaccgaagacggcgtgaatatgtgcacattgatggccatcgatttaggggaactgtgtgaagacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatagaatccgctctgaacgacacatggaagatggagaaggcctcattcattgaggtcaaaagctgccactggcctaagtctcataccctttggtccaatggagtgttggaaagtgagatgatcatccccaagaacttcgcaggccccgttagccagcacaactaccgacctggttatcatactcaaaccgctggcccatggcacctcgggaagctggaaatggattttgacttctgtgagggaacaactgtggtcgtgaccgaagattgcggcaatagagggccctctctaaggacaacgaccgcctccggaaaactgattactgagtggtgctgtcgctcatgcacactcccgcctctgcggtacagaggcgaggacggttgttggtacgggatggaaatcaggccacttaaggagaaggaagagaacttggttaatagtctggtgaccgcgggacatggccagattgataactttagcttaggtgtactcggcatggccctgttccttgaagagatgctgcgcactcgaatagggacaaaacacgctatcttgctcgtcgcagtgtcgtttgtgaccctgattacgggaaatatgtccttccgggacctaggccgtgtcatggttatggtgggggccactatgaccgatgacatcggaatgggcgtaacatatctggctctcctggccgcatttaaggtgagacccaccttcgcggccggtcttttgctgaggaaattaacttctaaggagctcatgatggctacaattgggatcgccctgcttagccagtcaaccatacctgaaacaatcctggagctaactgatgcactcgctctgggaatgatggtcttgaaaattgtgcgcaacatggaaaagtaccaactggccgttaccatcatggcaattagttgcgtgcccaatgccgtcatcttacagaacgcttggaaggtgtcctgtacgatactcgcggccgtttctgtgagcccactgcttctgacatcctcacagcagaaagcagactggattcctttggctctcaccatcaagggcctgaatcccactgccatctttctaaccacactgagccggacaagtaaaaagagatcttggccacttaacgaggccattatggctgtcggcatggtatccatactcgcaagctcgctgttgaaaaatgacatcccgatgaccgggcctctggtggccggaggtttactcacggtttgctatgtgctgacaggcaggtcagcggatcttgaactggagcgagctgccgacgtcaagtgggaggatcaagcagaaatttctgggagttcccccatcttgagcattaccatctctgaggacggaagcatgtccatcaagaacgaagaggaggaacagactctcacaatcctgattcgcaccggcctactggtgatctcaggtgtattcccagtgagtattcccatcactgccgctgcatggtacctttgggaggtcaagaagcagcgggccggggttctctgggatgtgcctagcccaccccctgtggaaaaagcggagctggaagacggagcttatagaataaagcagaggggcattttgggctactctcaaatcggggccggagtctataaagagggtacatttcacaccatgtggcatgtgacgcgtggcgcagttttaatgcaccgcgggaagcggatcgagccgtcctgggccgatgtcaaaaaggacctgatttcatacggaggcggttggaagctcgaaggggagtggaaagaaggagaggaagtgcaggtcctggctcttgagccaggcaagaatcccagagccgtgcagactaaacctggcatcttcaagaccaacacagggaccataggagcagttagtctggattttagcccaggtacatccggctctcccattgtggacaggaaagggaaggtcgtgggattgtacggcaatggtgtagtcactcgatcgggggcttatgtgagcgccatcgcgcagaccgagaagtcaattgaagataaccctgagatcgaagacgatatattccggaaaaagcgcctaacgattatggacctgcatccgggagccggcaaaacaaagagatacctccccgcaatcgttagggaggctatcaaacggggcctgcgaactcttattttagccccaaccagagtggtcgctgcagaaatggaggaggccctgcgcgggctccctatcaggtatcaaacacccgccattaagaccgaacacactggacgtgagatagtggacttgatgtgtcatgctaccttcacaatgcggctgctctccccagttagagtgcctaactacaatctgatcattatggatgaagcgcactttacggaccccgcaagtatcgccgctaggggttatatctctactcgcgtcgagatgggcgaggccgcagggattttcatgaccgccacaccaccgggaagccgagattcctttcctcagtcaaacgctcccataatggacgaagagagagaaatcccagagcggtcttggaatagcggccacgaatgggtgaccgatttcaagggtaaaactgtatggtttgtgcccagtattaaggcggggaacgacatcgccgcatgccttaggaaaaatggaaagaaagttattcagctgtcccgcaagacattcgatagcgagtacgtcaagacccgtgctaacgactgggattttgtggtgacgactgacatctctgagatgggcgccaatttcaaagcagaaagagtcatagatcctcggaggtgtatgaagccagtaatcttgacagacggcgaggaacgcgtgattctagccgggcccatgcctgttacccattcatccgctgcccaacgaagaggacggatcggtaggaacccgaaaaatgagaacgaccagtatatttacatgggcgaaccactggagaatgatgaggactgcgcgcactggaaggaagcaaaaatgctcttagataacatcaatacccccgaggggataattcctagtatgtttgaacccgagcgcgaaaaggtggacgccatcgatggagagtacagactgaggggcgaggctcggaaaactttcgtcgaccttatgcgtcgcggtgatctgccagtgtggctcgcctataaggttgctgcagaagggattaactacgccgaccgaaagtggtgttttgatggcatcaaaaataaccagatattggaggaaaacatggaggtggagatctggacaaaggaaggagagaggaaaaagctgaaacctagatggctcgacgctcggatttatagcgatcccctggcccttaaggagttcaaggagttcgcagcgggccgcaaatcgctaaccctgaatttgatcacagaaatggggagattaccaacttttatgacgcagaaggccaggaacgctctggacaatctcgccgtcctgcataccgcagaggctggaggtcgggcctacaaccacgcactttctgagctgcctgaaacactcgagactttgctgctactgaccctccttgccacagtgaccggcgggattttcctgtttttaatgtccggaaaaggcatcggtaagatgactttggggatgtgctgcataattacggctagcatcctgctctggtatgcgcaaatccagccgcactggattgccgcatcaatcatactggagttctttcttattgtactgctcatccccgagccagaaaaacagcgaacccctcaggataatcaattgacatacgtggttattgctatcctgactgtcgtggccgccaccatggcaaacgagatgggcttcttagagaagacaaagaaagacctaggactgggcagtataaccactcaggaatctgagtccaatatcctcgacattgatcttagacccgctagcgcctggacactgtatgcggtggctacgacctttgtcactccaatgttgcgccattcaatcgaaaacagtagcgttaatgtgtccctgacagccattgcaaaccaggccaccgtactcatggggctgggaaagggttggcctctttctaaaatggacatcggcgtgcccctcctggctattgggtgttacagccaggtcaatccgatcaccttgacagcagccctgttactactggtggcgcactacgctataattggaccaggcctccaagccaaggcaactagggaggcccagaaacgggctgccgcaggtatcatgaagaaccctacggttgatgggatcaccgtgattgaccttgaacccataccatatgatcccaagttcgagaaacagctgggccaggtcatgttgctgatcctctgcgtaacacaagtgctgatgatgcgtactacctgggctctttgtgaggccttaacactggcgaccggacctatttccactctctgggaaggcaatccggggagattttggaacacgacaatcgccgtttcaatggcaaatattttcaggggatcttacttggctggcgccggtctgctatttagtatcatgaagaacaccacttcgacccgccgggggacaggaaatataggcgagactctgggtgaaaaatggaaaagccgactcaacgcacttggcaaatccgagttccagatctataagaaatctgggattcaggaggtggacagaaccctggctaaggaaggaatcaagaggggcgagacagatcatcacgccgtctcacgcgggagcgccaaattgcggtggtttgtggaaagaaacatggtcacgcccgagggaaaggtggttgacctgggctgcggtcgtgggggatggtcctactattgtggcggtctcaaaaatgtgagggaagtaaagggcctgaccaaagggggaccaggccatgaggagcctattcccatgagtacttacgggtggaacttagtgcggcttcaatctggagtcgatgttttcttcacacctccagaaaagtgcgacaccctgctctgtgatatcggcgagagctcacccaatcctactatagaagcgggtcgcacactacgagtgctgaacttggtcgagaattggctgaacaataacacccagttttgcattaaggtgctcaatccatatatgccctccgtaatcgagaaaatggaggcacttcagagacagtacgggggagcactggtgaggaacccgttgagtcggaatagcacgcacgagatgtactgggtttctaacgccaccggcaatatcgtgtcctcagtcaacatgattagccgcatgctgataaatagattcacaatgaagcacaaaaaggctacttatgaacctgacgtggatctcggctcggggaccaggaacatcggaattgagtctgaaatcccaaacttagacattatcggtaaacgaatagagaagatcaagcaagaacatgagattagttggcactacgaccaggatcatccctataaaacatgggcctaccacggctcctatgagactaagcagaccgggagcgcatcatccatggtcaatggagtggttcggctgcttacaaaaccttgggacgtagtgccaatggtcacccagatggccatgactgatacgacaccctttggccaacagcgtgtgttcaaggaaaaagttgacaccagaactcaggagccgaaggaaggtaccaagaaactgatgaagatcacagctgagtggctatggaaagagctcgggaagaaaaagacgcctcgcatgtgtaccagggaagagtttactaaaaaggtgcggtctaacgcggccctgggagcaattttcacagatgaaaataagtggaaaagcgctagagaggccgtcgaagacggccgcttttgggagttggtggatagggagcgaaacctgcacctcgaaggcaagtgcgagacctgtgtatacaatatgatggggaaacgggaaaagaaacttggagagttcggtaaggcaaagggcagtagagccatctggtatatgtggctgggggctaggtttttagagttcgaggccctgggatttttgaacgaggaccattggttctcccgcggcaatagcctctctggtgtggaaggggagggactgcaccgtctaggctacattcttcgggatgttggcaaaaaggaagggggagcgatgtacgcagacgatactgccggttgggacacaagaataaccctggaggacctcaaaaacgaagagatggtcacaaatcatatgaagggcgagcacaaaaagctggctgaagccatctttaagttgacttatcagaacaaagtggtgagggtccaacgccccaccccacgagggacggttatggatattatctcacggagagaccagaggggaagtggccaggtgggtacctacgggctgaatacattcactaacatggaggcacaactcatccgccagatggaaggagagggcattttcaagtccatacagcatcttaccgctacagaggaaatcgccgtacagaattggctggctagagtgggccgggagaggttaagccgtatggccatttctggggatgactgcgtcgtgaaacctatcgatgaccgatttgcatcggcgctgactgccttgaacgatatgggaaaggttcgcaaagacattcaacagtgggaaccctcaagaggttggaatgattggacccaggtgccattctgcagccaccactttcatgagctcgtcatgaaggacggccgggtgctggtagttccctgtaggaaccaggatgaactaatcgggcgcgctagaatatcccaaggagccggctggagtcttaaggagacggcatgcctgggtaaatcttatgctcagatgtggacactcatgtacttccaccggagggacctgcgattggccgcaaacgccatctgtagcgcggtgccttcccattgggtcccaacctcacgtactacatggagtattcacgctaagcacgagtggatgaccactgaagatatgttagccgtgtggaatagagtgtggatccaggagaacccgtggatggaagacaaaacccccgtcgagtcttgggaagaggttccttatctggggaagcgcgaggaccagtggtgcggaagcctcattggccttacatcccgggcaacgtgggccaaaaatatccaaaccgctataaaccaggtgaggtcactgattggcaatgaagagtacactgattatatgccaagcatgaagagatttcgccgggaagaggaagaggccggggtactatggtga

SEQ ID NO: 14476 - RNA, 9876 nt, synthetic construct
  misc_feature 1..9876: note = derived and/or modified CDS sequence (opt3) from DENV-2__EU569699__SS-prME
  source 1..9876: mol_type = other RNA
accgccggcgtgatcgtaatgctgattcccaccgctatggcattccacctcactacgcgtaacggggaacctcatatgatagttggaaggcaggaaaagggtaaaagccttctgtttaagaccgaggacggcgtgaatatgtgcacattgatggccatcgatttaggggaactgtgtgaggacactattacctacaaatgcccattactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccaaatttacatgcaagaaaaatatggaaggaaaggtggtccagcctgagaacctcgaatacaccattgttataactccacacagcggtgaggagcatgctgtgggcaatgacacggggaaacacggaaaggaaatcaaaattacaccgcagtcctcaatcaccgaggccgaactgactggctatggtaccgtaacaatggagtgtagtcccaggaccgggcttgatttcaacgaaatggtgctgttgcaaatggaggacaaggcatggctcgtccaccggcagtggtttctggatttacctctgccatggctccccggcgctgacactcagggaagcaattggatacagaaggagacacttgtgacgttcaaaaaccctcatgccaagaaacaagacgttgtggtcctgggctctcaggaaggggcgatgcacaccgccttgactggagcaacagagattcagatgtcctcaggtaatctactgtttaccggccatctcaagtgccgtctgcgcatggataaacttcaactgaaggggatgagctacagtatgtgtacaggaaagttcaaaatcgtgaaggaaatcgctgagactcagcacggcaccattgtaatcagagttcagtatgagggtgacgggtctccatgcaaaattcccttcgaaataacggatttggagaagaggcatgtgctcggccggctgatcaccgtcaacccgattgtgacagaaaaagactcccctgtcaacatcgaggccgaacccccatttggagatagctacatcattataggcgtggagcctgggcagttaaagctgaattggttcaagaaaggatcgtctatcggtcaaatgtttgagactaccatgcgaggcgctaagcgcatggccattctaggggacacagcatgggatttcggatccctcggcggtgtttttacttcaatcgggaaagccctgcaccaggtgttcggcgctatttacggagcggcatttagtggcgtaagctggaccatgaagatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaaaaataaggaactgaagtgcggatctggcattttcatcactgataacgtccacacatggaccgagcagtacaaatttcaacccgaatcaccaagtaagttggccagcgcaatacagaaagcccatgaggaaggtatttgtggcatcaggtccgtgactcggctcgagaatctgatgtggaagcagattacccccgagttaaaccacatcctgtctgaaaatgaggtgaaactaacaataatgacgggggacatccgcggaattatgcaggctggcaagagatcgctcaggcctcaaccaaccgaactgaaatatagctggaagacttgggggaaggccaaaatgctttccacagagtcacataaccagaccttcttgatcgatggaccggaaacagcagagtgccccaatactaaccgtgcgtggaatagtctggaggtcgaagactacggctttggtgttttcaccacgaacatttggctcaagctgcgggacaaacaggatgtgttttgtgactctaagttaatgagcgctgccatcaaagataatcgagcagtgcacgccgacatggggtattggatagagtccgctctgaacgatacatggaagatggaaaaggcctcattcattgaggtaaaaagctgccactggcctaagtctcataccctttggtccaatggagtcttggagagtgaaatgatcatccccaagaatttcgcaggccccgtgagccagcacaactacagacctggttatcatactcaaaccgctggcccatggcacctcgggaagctggagatggactttgatctatgtgaaggaacaactgttgtggtcaccgaggactgcggcaatagggggccctctctgcgcacaacgaccgcctccggaaaactcattactgaatggtgctgtcggtcatgcacactgccgcctcttagatacaggggcgaggatggttgttggtacgggatggagatccgcccattgaaggaaaaggaggaaaacctggtgaatagtttagttaccgcgggacatggccagattgacaacttcagcctcggtgtgctgggcatggcccttctgttggaggaaatgctccgaactcggatagggacaaaacacgctatcctgctagtagcagtctcgtttgtgaccctgattacgggaaatatgtccttccgtgatctcggcagagtgatggtcatggttggggccactatgaccgacgatatcggaatgggcgtgacatatctggctcttttggccgcatttaaggtaaggcccaccttcgcggccggtctgttactccgcaaactgacttctaaggagcttatgatggctacaattgggatcgccctgctaagccagtcaaccatacctgagacaatcctcgaactgactgacgcattggctctgggaatgatggtgttaaaaattgtccggaacatggagaagtaccaactcgccgtgaccgttatggcaatcagttgcgtgcccaatgccgtcattctgcagaacgcttggaaggtgtcctgtacgatccttgcggccgtttctgtgagcccactgttgctcacatcctcacagcagaaagcagactggatacctctggctctaaccattaagggcctgaatcccactgccatctttcttaccacactcagcagaacaagtaaaaagaggtcttggccactgaacgaagccatcatggctgtcggcatggtatccattttggcaagctcgctgctcaaaaatgatataccgatgaccgggcctctagtggccggaggtctgcttacggtttgctatgtgctgacaggccgatcagcggacttggagctcgaacgcgctgccgatgtcaagtgggaggaccaagcagagatctctgggagttcccccattctgagcatcaccatttctgaagatggaagcatgtccatcaaaaacgaggaagaggagcagactctaacaatactgatccggaccggccttctcgtgatttcaggtgtattcccagtgagtatccccattactgccgctgcatggtacctgtgggaagtcaagaagcagagagccggggttttgtgggacgtgcctagcccaccccctgtggagaaagcggaattagaggatggagcttataggatcaagcagcgtggcatactgggctactctcaaattggggccggagtctataaagaaggtacatttcacaccatgtggcatgtgacgcgcggcgcagttctcatgcaccgggggaagagaatcgagccgtcctgggccgacgtcaagaaagatctgatctcatacggaggcggttggaaacttgagggggaatggaaagagggagaagaggtgcaggtcctggctttggaaccaggcaaaaatcccagggccgtgcagactaaacctggcattttcaagaccaacacagggaccatcggagcagttagtctagactttagcccaggtacatccggctctcccatagtggatcgaaaagggaaggtcgtgggactgtacggcaatggtgtagtcactcggtcgggggcttatgtgagcgccattgcgcagaccgagaagtcaatcgaggacaaccctgaaattgaggatgacatcttccgcaaaaagagactcacgataatggacctgcatccgggagccggcaaaacaaagaggtaccttcccgcaattgttcgggaagctatcaaacgaggcttaagaactctgatcctcgccccaacccgcgtggtcgctgcagagatggaagaggccttgagggggctgcctattcgttatcaaacaaccgccatcaagactgagcacaccggacgggaaattgtggatctcatgtgtcatgctacatttacgatgagactgctttcccccgttagggtgccaaactacaatctgataatcatggacgaggcgcacttcactgatcctgcaagtattgccgctcgcggttatatctctacccgagtcgaaatgggcgaggccgcagggatcttcatgacagccacaccaccaggaagcagagacccgtttcctcagtccaacgctcccattatggatgaggaacgggagataccagaaaggtcatggaactctggccacgagtgggtgactgacttcaagggtaaaacagtatggtttgtgcccagcatcaaggcggggaacgatattgccgcatgcttgcgcaaaaatggaaagaaagttatccagctaagtcgtaagaccttcgactccgaatacgtcaagacgagagctaacgattgggactttgtggtgactacagatattagcgagatgggcgccaatttcaaagcagagcgggtcatcgaccctaggcgctgtatgaagccagtaatactgaccgacggcgaagaacgagtgatcctcgccgggcccatgcctgttacccattcttcagctgcccaaagacggggaaggattggtcgcaacccgaaaaatgaaaacgatcagtatatctacatgggcgagccattagaaaatgacgaggattgcgcgcactggaaggaggcaaaaatgctgcttgacaacattaatactcccgaagggatcataccttccatgtttgagcccgaaagagagaaggtggatgccattgacggagaatacaggctgcggggcgaggctcgtaaaacattcgtcgatctcatgcgccgaggtgacttgccagtgtggctggcctataaggttgctgcagaggggatcaactacgccgatagaaagtggtgttttgacggcattaaaaataaccagatcctcgaagagaacatggaagtggagatatggaccaaggagggagaaaggaaaaagctgaaacctcggtggcttgatgctcgcatctatagtgaccccctagccctgaaggagttcaaggaatttgcagcgggcagaaagagcttgacattaaatctgattactgagatggggaggctcccaacgttcatgacccagaaggcccggaacgctctggataatcttgccgtcctgcatacagcagaagctggaggtcgagcctacaaccacgcactctcggagttgcctgagactctggaaaccctactgctccttacactgttagccaccgtgactggcgggatcttcttgtttctgatgtctggaaaaggcattggtaagatgacgctcgggatgtgctgcatcataaccgcttccattctgctttggtatgcgcaaatccagccgcactggatcgccgcaagcattatcctggagttctttctcatagtattgctgattcccgaaccagagaaacagagaacacctcaggacaatcaattaacttacgtggttatcgctattctaaccgtcgtggccgccacaatggcaaacgaaatgggcttcctggagaagaccaagaaagacctcggacttggctcaatcactacacaggagagtgaatctaatatactggatatcgacttgcgccccgcttccgcctggacgctgtatgcggtggctaccacttttgtcacaccaatgctcaggcatagcattgagaactcaagtgttaatgtgagcctgaccgccatcgcaaaccaggccaccgtacttatggggctcggaaagggttggcctctgtccaaaatggatattggcgtgcccttgctggctatcgggtgttactctcaggtcaatccgattacattaactgcagccctactgctccttgtggcgcactacgctatcataggaccaggcctgcaagccaaggcaacgcgggaagcccagaaacgtgctgccgcaggtattatgaagaaccctaccgttgacgggatcacagtgatcgatttggagcccattccatatgaccccaagttcgaaaaacagctgggccaggtcatgctcctgatactttgcgtaactcaagtgttaatgatgagaaccacatgggctctgtgtgaggccctcaccttggcgactggacctatcagcacgctgtgggagggcaatccggggaggttttggaacacaaccattgccgtttccatggcaaatatcttccgcggatcatacctagctggcgccggtctgctcttttctattatgaagaacactaccaatacacggcgagggactggaaacatcggcgaaacccttggtgagaaatggaagagtagactgaacgcattgggcaaatcggagttccagatatataagaaaagcgggatccaggaggtggataggacactggctaaggagggaattaagcgcggcgaaacggaccatcacgccgtctcccgggggtctgccaaactcagatggtttgtggagcgtaatatggtcacccccgaaggaaaggtggttgatctgggctgcggtagagggggatggtcatactattgtggcggtcttaaaaacgtgcgggaggtaaagggcctaactaaagggggaccaggccatgaagaacctatccccatgagcacatacgggtggaatctggtgcgcctccaatccggagtcgacgttttctttacccctccagagaagtgcgatactctactgtgtgacattggcgaaagttctcccaaccctacaatcgaggcgggtcgaaccttgagagtgctgaatctcgtcgaaaactggcttaataacaatacgcagttctgcataaaggtgctgaacccatatatgcccagcgtaattgagaaaatggaggctttgcagaggaagtacgggggagcactggtgcggaatccgctctcacgcaactccacccacgagatgtactgggttagtaatgccacaggcaacatcgtgagctctgtcaatatgatctccagaatgttaattaacaggttcactatgaaacacaagaaagctacctatgagcctgatgtggacctgggctcagggacacgaaacataggaatcgaaagcgagattccaaatcttgacatcattggtaagcggatcgaaaagataaaacaggagcatgaaacttcgtggcactacgatcaagaccatccctataagacctgggcctaccacggctcttatgagacaaaacagaccgggagtgcatccagcatggtcaacggagtggttcgtctgctaactaagccttgggatgtagtgccaatggtcacgcagatggccatgacagacaccactccctttggccagcaaagagtgttcaaagagaaggttgatacccgcacacaggaaccgaaggagggtacgaaaaagctcatgaaaatcaccgctgaatggctgtggaaggagttggggaaaaagaaaactcctaggatgtgtacacgggaggaatttaccagaaaggtgcgctcaaatgcggccctgggagcaattttcactgacgagaacaagtggaaatccgctagggaagccgtcgaggatggccgattttgggaactcgtggaccgggagagaaatcttcacctggagggcaagtgcgaaacatgtgtatacaacatgatggggaaaagggagaagaaattaggagagttcggtaaggcaaagggctctcgcgccatctggtatatgtggctgggggctagatttttggagttcgaagccctcggatttctgaatgaggatcattggttcagccggggcaacagtctatccggtgtggagggggaaggacttcacagactgggctacattctcagggacgttggcaaaaaggaagggggagcgatgtacgcagatgacaccgccggttgggacacacgcatcactctggaagatttgaaaaatgaggaaatggtcaccaaccatatgaagggcgagcacaaaaagctggctgaggccatttttaagctcacgtatcagaataaagtggtgcgagtccagcggcccaccccaagagggacagttatggacataatcagcaggcgcgatcaaagaggatctggccaggtgggtacttacgggcttaacaccttcacaaatatggaagcacagctgattcggcaaatggagggagaaggcatctttaagtcaatccagcatttaactgctattgaggagatagccgtacagaactggctggctagggtgggccgtgaacgattgagtcgcatggccatctccggggacgattgcgtcattaaacctatcgacgatagattcgcaagcgcgctcaccgccctgaatgacatgggaaaggtgcggaaagatattcagcaatgggagccctctaggggttggaacgactggacgcaggttccattctgctcgcaccactttcatgagttagtgatgaaggatggccgcgtccttgtggtaccctgtagaaaccaggacgagctgatcgggcgggctaggatatcacagggagccggctggagcctcaaggaaacagcatgcctgggtaaatcctatgctcaaatgtggaccttgatgtacttccaccgacgtgatttaagactggccgcaaatgccatctgtagtgcggttccttctcattgggtgccaactagccgcacaacctggtccattcacgctaagcacgagtggatgactaccgaggacatgctcgccgtctggaaccgggtgtggatccaggaaaatccgtggatggaggacaaaacacccgtggaatcatgggaggaagtcccttatcttgggaagagggaggatcagtggtgcggaagtctgattggcctaacgtctagagcaacctgggccaaaaacatccagactgctataaatcaagttcgcagcctgattggcaacgaggaatacacagactatatgccatccatgaagcggtttaggcgagaggaagaggaagccggggtgctctggtga

SEQ ID NO: 14477 - RNA, 9876 nt, synthetic construct
  misc_feature 1..9876: note = derived and/or modified CDS sequence (opt3) from DENV-2__KF955366__SS-prME
  source 1..9876: mol_type = other RNA
accgccggcgtgatagtaatgctgattccaacagctatggctttccacctcactacgagaaacggggaacctcatatgatagttggaaggcaggaaaagggtaaaagccttctgtttaagaccgaagacggcgtgaatatgtgcacattgatggccatcgatttaggggaactgtgtgaagacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatagaatccgctctgaacgacacatggaagatggagaaggcctcattcattgaggtcaaaagctgccactggcctaagtctcataccctttggtccaatggagtgttggaaagtgagatgatcatccccaagaacttcgcaggccccgttagccagcacaactaccgacctggttatcatactcaaaccgctggcccatggcacctcgggaagctggaaatggattttgacttctgtgagggaacaactgtggtcgtgaccgaagattgcggcaatagagggccctctctaaggacaacgaccgcctccggaaaactgattactgagtggtgctgtcgctcatgcacactcccgcctctgcggtacagaggcgaggacggttgttggtacgggatggaaatcaggccacttaaggagaaggaagagaacttggttaatagtctggtgaccgcgggacatggccagattgataactttagcttaggtgtactcggcatggccctgttccttgaagagatgctgcgcactcgaatagggacaaaacacgctatcttgctcgtcgcagtgtcgtttgtgaccctgattacgggaaatatgtccttccgggacctaggccgtgtcatggttatggtgggggccactatgaccgatgacatcggaatgggcgtaacatatctggctctcctggccgcatttaaggtgagacccaccttcgcggccggtcttttgctgaggaaattaacttctaaggagctcatgatggctacaattgggatcgccctgcttagccagtcaaccatacctgaaacaatcctggagctaactgatgcactcgctctgggaatgatggtcttgaaaattgtgcgcaacatggaaaagtaccaactggccgttaccatcatggcaattagttgcgtgcccaatgccgtcatcttacagaacgcttggaaggtgtcctgtacgatactcgcggccgtttctgtgagcccactgcttctgacatcctcacagcagaaagcagactggattcctttggctctcaccatcaagggcctgaatcccactgccatctttctaaccacactgagccggacaagtaaaaagagatcttggccacttaacgaggccattatggctgtcggcatggtatccatactcgcaagctcgctgttgaaaaatgacatcccgatgaccgggcctctggtggccggaggtttactcacggtttgctatgtgctgacaggcaggtcagcggatcttgaactggagcgagctgccgacgtcaagtgggaggatcaagcagaaatttctgggagttcccccatcttgagcattaccatctctgaggacggaagcatgtccatcaagaacgaagaggaggaacagactctcacaatcctgattcgcaccggcctactggtgatctcaggtgtattcccagtgagtattcccatcactgccgctgcatggtacctttgggaggtcaagaagcagcgggccggggttctctgggatgtgcctagcccaccccctgtggaaaaagcggagctggaagacggagcttatagaataaagcagaggggcattttgggctactctcaaatcggggccggagtctataaagagggtacatttcacaccatgtggcatgtgacgcgtggcgcagttttaatgcaccgcgggaagcggatcgagccgtcctgggccgatgtcaaaaaggacctgatttcatacggaggcggttggaagctcgaaggggagtggaaagaaggagaggaagtgcaggtcctggctcttgagccaggcaagaatcccagagccgtgcagactaaacctggcatcttcaagaccaacacagggaccataggagcagttagtctggattttagcccaggtacatccggctctcccattgtggacaggaaagggaaggtcgtgggattgtacggcaatggtgtagtcactcgatcgggggcttatgtgagcgccatcgcgcagaccgagaagtcaattgaagataaccctgagatcgaagacgatatattccggaaaaagcgcctaacgattatggacctgcatccgggagccggcaaaacaaagagatacctccccgcaatcgttagggaggctatcaaacggggcctgcgaactcttattttagccccaaccagagtggtcgctgcagaaatggaggaggccctgcgcgggctccctatcaggtatcaaacacccgccattaagaccgaacacactggacgtgagatagtggacttgatgtgtcatgctaccttcacaatgcggctgctctccccagttagagtgcctaactacaatctgatcattatggatgaagcgcactttacggaccccgcaagtatcgccgctaggggttatatctctactcgcgtcgagatgggcgaggccgcagggattttcatgaccgccacaagcccaggatcccgagatccgtttcctcagtcaaacgctcccataatggacgaagagagagaaatcccagagcggtcttggaatagcggccacgaatgggtgaccgatttcaagggtaaaactgtatggtttgtgcccagtattaaggcggggaacgacatcgccgcatgccttaggaaaaatggaaagaaagttattcagctgtcccgcaagacattcgatagcgagtacgtcaagacccgtgctaacgactgggattttgtggtgacgactgacatctctgagatgggcgccaatttcaaagcagaaagagtcatagatcctcggaggtgtatgaagccagtaatcttgacagacggcgaggaacgcgtgattctagccgggcccatgcctgttacccattcatccgctgcccaacgaagaggacggatcggtaggaacccgaaaaatgagaacgaccagtatatttacatgggcgaaccactggagaatgatgaggactgcgcgcactggaaggaagcaaaaatgctcttagataacatcaatacccccgaggggataattcctagtatgtttgaacccgagcgcgaaaaggtggacgccatcgatggagagtacagactgaggggcgaggctcggaaaactttcgtcgaccttatgcgtcgcggtgatctgccagtgtggctcgcctataaggttgctgcagaagggattaactacgccgaccgaaagtggtgttttgatggcatcaaaaataaccagatattggaggaaaacatggaggtggagatctggacaaaggaaggagagaggaaaaagctgaaacctagatggctcgacgctcggatttatagcgatcccctggcccttaaggagttcaaggagttcgcagcgggccgcaaatcgctaaccctgaatttgatcacagaaatggggagattaccaacttttatgacgcagaaggccaggaacgctctggacaatctcgccgtcctgcataccgcagaggctggaggtcgggcctacaaccacgcactttctgagctgcctgaaacactcgagactttgctgctactgaccctccttgccacagtgaccggcgggattttcctgtttttaatgtccggaaaaggcatcggtaagatgactttggggatgtgctgcataattacggctagcatcctgctctggtatgcgcaaatccagccgcactggattgccgcatcaatcatactggagttctttcttattgtactgctcatccccgagccagaaaaacagcgaacccctcaggataatcaattgacatacgtggttattgctatcctgactgtcgtggccgccaccatggcaaacgagatgggcttcttagagaagacaaagaaagacctaggactgggcagtataaccactcaggaatctgagtccaatatcctcgacattgatcttagacccgctagcgcctggacactgtatgcggtggctacgacctttgtcactccaatgttgcgccattcaatcgaaaacagtagcgttaatgtgtccctgacagccattgcaaaccaggccaccgtactcatggggctgggaaagggttggcctctttctaaaatggacatcggcgtgcccctcctggctattgggtgttacagccaggtcaatccgatcaccttgacagcagccctgttactactggtggcgcactacgctataattggaccaggcctccaagccaaggcaactagggaggcccagaaacgggctgccgcaggtatcatgaagaaccctacggttgatgggatcaccgtgattgaccttgaacccataccatatgatcccaagttcgagaaacagctgggccaggtcatgttgctgatcctctgcgtaacacaagtgctgatgatgcgtactacctgggctctttgtgaggccttaacactggcgaccggacctatttccactctctgggaaggcaatccggggagattttggaacacgacaatcgccgtttcaatggcaaatattttcaggggatcttacttggctggcgccggtctgctatttagtatcatgaagaacaccacttcgacccgccgggggacaggaaatataggcgagactctgggtgaaaaatggaaaagccgactcaacgcacttggcaaatccgagttccagatctataagaaatctgggattcaggaggtggacagaaccctggctaaggaaggaatcaagaggggcgagacagatcatcacgccgtctcacgcgggagcgccaaattgcggtggtttgtggaaagaaacatggtcacgcccgagggaaaggtggttgacctgggctgcggtcgtgggggatggtcctactattgtggcggtctcaaaaatgtgagggaagtaaagggcctgaccaaagggggaccaggccatgaggagcctattcccatgagtacttacgggtggaacttagtgcggcttcaatctggagtcgatgttttcttcacacctccagaaaagtgcgacaccctgctctgtgatatcggcgagagctcacccaatcctactatagaagcgggtcgcacactacgagtgctgaacttggtcgagaattggctgaacaataacacccagttttgcattaaggtgctcaatccatatatgccctccgtaatcgagaaaatggaggcacttcagagacagtacgggggagcactggtgaggaacccgttgagtcggaatagcacgcacgagatgtactgggtttctaacgccaccggcaatatcgtgtcctcagtcaacatgattagccgcatgctgataaatagattcacaatgaagcacaaaaaggctacttatgaacctgacgtggatctcggctcggggaccaggaacatcggaattgagtctgaaatcccaaacttagacattatcggtaaacgaatagagaagatcaagcaagaacatgagattagttggcactacgaccaggatcatccctataaaacatgggcctaccacggctcctatgagactaagcagaccgggagcgcatcatccatggtcaatggagtggttcggctgcttacaaaaccttgggacgtagtgccaatggtcacccagatggccatgactgatacgacaccctttggccaacagcgtgtgttcaaggaaaaagttgacaccagaactcaggagccgaaggaaggtaccaagaaactgatgaagatcacagctgagtggctatggaaagagctcgggaagaaaaagacgcctcgcatgtgtaccagggaagagtttactaaaaaggtgcggtctaacgcggccctgggagcaattttcacagatgaaaataagtggaaaagcgctagagaggccgtcgaagacggccgcttttgggagttggtggatagggagcgaaacctgcacctcgaaggcaagtgcgagacctgtgtatacaatatgatggggaaacgggaaaagaaacttggagagttcggtaaggcaaagggcagtagagccatctggtatatgtggctgggggctaggtttttagagttcgaggccctgggatttttgaacgaggaccattggttctcccgcggcaatagcctctctggtgtggaaggggagggactgcaccgtctaggctacattcttcgggatgttggcaaaaaggaagggggagcgatgtacgcagacgatactgccggttgggacacaagaataaccctggaggacctcaaaaacgaagagatggtcacaaatcatatgaagggcgagcacaaaaagctggctgaagccatctttaagttgacttatcagaacaaagtggtgagggtccaacgccccaccccacgagggacggttatggatattatctcacggagagaccagaggggaagtggccaggtgggtacctacgggctgaatacattcactaacatggaggcacaactcatccgccagatggaaggagagggcattttcaagtccatacagcatcttaccgctacagaggaaatcgccgtacagaattggctggctagagtgggccgggagaggttaagccgtatggccatttctggggatgactgcgtcgtgaaacctatcgatgaccgatttgcatcggcgctgactgccttgaacgatatgggaaaggttcgcaaagacattcaacagtgggaaccctcaagaggttggaatgattggacccaggtgccattctgcagccaccactttcatgagctcgtcatgaaggacggccgggtgctggtagttccctgtaggaaccaggatgaactaatcgggcgcgctagaatatcccaaggagccggctggagtcttaaggagacggcatgcctgggtaaatcttatgctcagatgtggacactcatgtacttccaccggagggacctgcgattggccgcaaacgccatctgtagcgcggtgccttcccattgggtcccaacctcacgtactacatggagtattcacgctaagcacgagtggatgaccactgaagatatgttagccgtgtggaatagagtgtggatccaggagaacccgtggatggaagacaaaacccccgtcgagtcttgggaagaggttccttatctggggaagcgcgaggaccagtggtgcggaagcctcattggccttacatcccgggcaacgtgggccaaaaatatccaaaccgctataaaccaggtgaggtcactgattggcaatgaagagtacactgattatatgccaagcatgaagagatttcgccgggaagaggaagaggccggggtactatggtga

SEQ ID NO: 14478 - RNA, 9876 nt, synthetic construct
  misc_feature 1..9876: note = derived and/or modified CDS sequence (opt3) from DENV-2__EU569700__SS-prME
  source 1..9876: mol_type = other RNA
accgccggcgtgatagtaatgctgattccaactgctatggctttccacctcactacgagaaacggggaacctcatatgatagttggaaggcaggaaaagggtaaaagccttctgtttaagaccgaagacggcgtgaatatgtgcacattgatggccatcgatttaggggaactgtgtgaagacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatagaatccgctctgaacgacacatggaagatggagaaggcctcattcattgaggtcaaaagctgccactggcctaagtctcataccctttggtccaatggagtgttggaaagtgagatgatcatccccaagaatttcgcaggccccgttagccagcacaactaccgacctggttatcatactcaaaccgctggcccatggcacctcgggaagctggaaatggattttgacttctgtgagggaacaactgtggtcgtgaccgaagattgcggcaatagagggccctctctaaggacaacgaccgcctccggaaaactgattactgagtggtgctgtcgctcatgcacactcccgcctctgcggtacagaggcgaggacggttgttggtacgggatggaaatcaggccacttaaggagaaggaagagaacttggttaatagtctggtgaccgcgggacatggccagattgataactttagcttaggtgtactcggcatggccctgttccttgaagagatgctgcgcactcgaatagggacaaaacacgctatcttgctcgtcgcagtgtcgtttgtgaccctgattacgggaaatatgtccttccgggacctaggccgtgtcatggttatggtgggggccactatgaccgatgacatcggaatgggcgtaacatatctggctctcctggccgcatttaaggtgagacccaccttcgcggccggtcttttgctgaggaaattaacttctaaggagctcatgatggctacaattgggatcgccctgcttagccagtcaaccatacctgaaacaatcctggagctaactgatgcactcgctctgggaatgatggtcttgaaaattgtgcgcaacatggaaaagtaccaactggccgttaccatcatggcaattagttgcgtgcccaatgccgtcatcttacagaacgcttggaaggtgtcctgtacgatactcgcggccgtttctgtgagcccactgcttctgacatcctcacagcagaaagcagactggattcctttggctctcaccatcaagggcctgaatcccactgccatctttctaaccacactgagccggacaagtaaaaagagatcttggccacttaacgaggccattatggctgtcggcatggtatccatactcgcaagctcgctgttgaaaaatgacatcccgatgaccgggcctctggtggccggaggtttactcacggtttgctatgtgctgacaggcaggtcagcggatcttgaactggagcgagctgccgacgtcaagtgggaggatcaagcagaaatttctgggagttcccccatcttgagcattaccatctctgaggacggaagcatgtccatcaaaaacgaagaggaggaacagactctcacaatcctgattcgcaccggcctactggtgatctcaggtgtattcccagtgagtattcccatcactgccgctgcatggtacctttgggaggtcaagaagcagcgggccggggttctctgggatgtgcctagcccaccccctgtggaaaaagcggagctggaagacggagcttatagaataaagcagaggggcattttgggctactctcaaatcggggccggagtctataaagagggtacatttcacaccatgtggcatgtgacgcgtggcgcagttttaatgcaccgcgggaagcggatcgagccgtcctgggccgatgtcaaaaaggacctgatttcatacggaggcggttggaagctcgaaggggagtggaaagaaggagaggaagtgcaggtcctggctcttgagccaggcaagaatcccagagccgtgcagactaaacctggcatcttcaagaccaacacagggaccataggagcagttagtctggattttagcccaggtacatccggctctcccattgtggacaggaaagggaaggtcgtgggattgtacggcaatggtgtagtcactcgatcgggggcttatgtgagcgccatcgcgcagaccgagaagtcaattgaagataaccctgagatcgaagacgatatattccggaaaaagcgcctaacgattatggacctgcatccgggagccggcaaaacaaagagatacctccccgcaatcgttagggaggctatcaaacggggcctgcgaactcttattttagccccaaccagagtggtcgctgcagaaatggaggaggccctgcgcgggctccctatcaggtatcaaacacccgccattaagaccgaacacactggacgtgagatagtggacttgatgtgtcatgctaccttcacaatgcggctgctctccccagttagagtgcctaactacaatctgatcattatggatgaagcgcactttacggaccccgcaagtatcgccgctaggggttatatctctactcgcgtcgagatgggcgaggccgcagggattttcatgaccgccacaccaccgggaagccgagatccttttccccagtccaacgctccaataatggacgaagagagagaaatccccgagcggtcatggaactctggccacgaatgggtgaccgatttcaagggtaaaactgtatggtttgtgcctagcattaaggcggggaacgacatcgccgcatgccttaggaaaaatggaaagaaagttattcagctgagtcgcaagacattcgattccgagtacgtcaagacccgtgctaacgactgggattttgtggtgacgactgacatcagcgagatgggcgccaatttcaaagcagaaagagtcatagatccacggaggtgtatgaagcccgtaatcttgacagacggcgaggaacgcgtgattctagccgggcctatgccggttacccattcttcagctgcccaacgaagaggacggatcggtaggaaccccaaaaatgagaacgaccagtatatttacatgggcgaacccctggagaatgatgaggactgcgcgcactggaaggaagcaaaaatgctcttagataacatcaatacccctgaggggataattccctccatgtttgaaccagagcgcgaaaaggtggacgccatcgatggagagtacagactgaggggcgaggctcggaaaactttcgtcgaccttatgcgtcgcggtgatctgcctgtgtggctcgcctataaggttgctgcagaagggattaactacgccgaccgaaagtggtgttttgatggcatcaaaaataaccagatattggaggaaaacatggaggtggagatctggacaaaggaaggagagaggaaaaagctgaaacccagatggctcgacgctcggatttatagtgatccactggcccttaaggagttcaaggagttcgcagcgggccgcaaaagcctaaccctgaatttgatcacagaaatggggagattacctacttttatgacgcagaaggccaggaacgctctggacaatctcgccgtcctgcataccgcagaggctggaggtcgggcctacaaccacgcactttcggagctgccggaaacactcgagactttgctgctactgaccctccttgccacagtgaccggcgggattttcctgtttttaatgtctggaaaaggcatcggtaagatgactttggggatgtgctgcataattacggcttccatcctgctctggtatgcgcaaatccagccccactggattgccgcaagcatcatactggagttctttcttattgtactgctcatcccagagcctgaaaaacagcgaaccccacaggataatcaattgacatacgtggttattgctatcctgactgtcgtggccgccaccatggcaaacgagatgggcttcttagagaagacaaagaaagacctaggactgggctcaataaccactcaggaaagtgagtctaatatcctcgacattgatcttagaccagcttccgcctggacactgtatgcggtggctacgacctttgtcactcctatgttgcgccatagcatcgaaaactcaagtgttaatgtgagcctgacagccattgcaaaccaggccaccgtactcatggggctgggaaagggttggcccctttccaaaatggacatcggcgtgccgctcctggctattgggtgttactctcaggtcaatccaatcaccttgacagcagccctgttactactggtggcgcactacgctataattggacctggcctccaagccaaggcaactagggaggcccagaaacgggctgccgcaggtatcatgaagaaccccacggttgatgggatcaccgtgattgaccttgaaccaataccctatgatcctaagttcgagaaacagctgggccaggtcatgttgctgatcctctgcgtaacacaagtgctgatgatgcgtactacctgggctctttgtgaggccttaacactggcgaccggaccgattagcactctctgggaaggcaatcccgggagattttggaacacgacaatcgccgtttccatggcaaatattttcaggggatcatacttggctggcgccggtctgctattttctatcatgaagaacaccacaagtacccgccgggggacaggaaatataggcgagactctgggtgaaaaatggaagtcgcgactcaacgcacttggcaaaagcgagttccagatctataagaaatccgggattcaggaggtggacagaaccctggctaaggaaggaatcaagaggggcgagacagatcatcacgccgtctctcgcgggtcagccaaattgcggtggtttgtggaaagaaacatggtcacgccagagggaaaggtggttgacctgggctgcggtcgtgggggatggagctactattgtggcggtctcaaaaatgtgagggaagtaaagggcctgaccaaagggggacctggccatgaggagcccattcctatgtccacttacgggtggaacttagtgcggcttcaaagtggagtcgatgttttcttcacaccacccgaaaagtgcgacaccctgctctgtgatatcggcgagtctagccctaatccaactatagaagcgggtcgcacactacgagtgctgaacttggtcgagaattggctgaacaataacacccagttttgcattaaggtgctcaatccctatatgccgtcagtaatcgagaaaatggaggcacttcagagacagtacgggggagcactggtgaggaaccctttgtcccggaatagtacgcacgagatgtactgggttagcaacgccaccggcaatatcgtgtcttccgtcaacatgatttcacgcatgctgataaatagattcacaatgaagcacaaaaaggctacttatgaaccagacgtggatctcggcagcgggaccaggaacatcggaattgagtcggaaatccccaacttagacattatcggtaaacgaatagagaagatcaagcaagaacatgagatttcttggcactacgaccaggatcatccttataaaacatgggcctaccacggcagttatgagactaagcagaccgggtccgcaagctcaatggtcaatggagtggttcggctgcttacaaaaccatgggacgtagtgcccatggtcacccagatggccatgactgatacgacaccgtttggccaacagcgtgtgttcaaggaaaaagttgacaccagaactcaggagcctaaggaaggtaccaagaaactgatgaagatcacagctgagtggctatggaaagagctcgggaagaaaaagacgccccgcatgtgtaccagggaagagtttactaaaaaggtgcggtccaacgcggccctgggagcaattttcacagatgaaaataagtggaaatctgctagagaggccgtcgaagacggccgcttttgggagttggtggatagggagcgaaacctgcacctcgaaggcaagtgcgagacctgtgtatacaatatgatggggaaacgggaaaagaaacttggagagttcggtaaggcaaagggcagcagagccatctggtatatgtggctgggggctaggtttttagagttcgaggccctgggatttttgaacgaggaccattggttcagtcgcggcaattccctcagcggtgtggaaggggagggactgcaccgtctaggctacattcttcgggatgttggcaaaaaggaagggggagcgatgtacgcagacgatactgccggttgggacacaagaataaccctggaggacctcaaaaacgaagagatggtcacaaatcatatgaagggcgagcacaaaaagctggctgaagccatctttaagttgacttatcagaacaaagtggtgagggtccaacgcccaacccctcgagggacggttatggatattatctctcggagagaccagaggggatcaggccaggtgggtacctacgggctgaatacattcactaacatggaggcacaactcatccgccagatggaaggagagggcattttcaagagtatacagcatcttaccgctacagaggaaatcgccgtacagaattggctggctagagtgggccgggagaggttatcccgtatggccattagcggggatgactgcgtcgtgaaacccatcgatgaccgatttgcatctgcgctgactgccttgaacgatatgggaaaggttcgcaaagacattcaacagtgggaaccatcgagaggttggaatgattggacccaggtgcccttctgctcacaccactttcatgagctcgtcatgaaggacggccgggtgctggtagttccttgtaggaaccaggatgaactaatcgggcgcgctagaataagccaaggagccggctggtcccttaaggagacggcatgcctgggtaaaagttatgctcagatgtggacactcatgtacttccaccggagggacctgcgattggccgcaaacgccatctgttctgcggtgccaagccattgggtcccgacctcccgtactacatggtcaattcacgctaagcacgagtggatgaccactgaagatatgttagccgtgtggaatagagtgtggatccaggagaacccctggatggaagacaaaacccctgtcgagagttgggaagaggttccatatctggggaagcgcgaggaccagtggtgcggatctctcattggccttacaagccgggcaacgtgggccaaaaatatccaaaccgctataaaccaggtgaggtccctgattggcaatgaagagtacactgattatatgccctcaatgaagagatttcgccgggaagaggaagaggccggggtactatggtga

SEQ ID NO: 14479 - RNA, 9876 nt, synthetic construct
  misc_feature 1..9876: note = derived and/or modified CDS sequence (opt3) from DENV-2__KF955369__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacaaccgtggcaccatccatgactatgagatgcatcgggatatctaacagggattttgtcgaaggagtgtcgggtggctcatgggtagacattgttctcgagcacgggagctgtgtgacaaccatggccaagaataagcccacgttagatttcgaactgatcaaaaccgaggctaagcagcctgccacacttcggaaatattgcattgaagcgaagttgactaacaccacaactgagagtcgctgtccaacccaaggagagccctccctgaatgaagagcaggacaaacgatttatctgcaagcattctatggtcgatagaggctggggtaacgggtgtggactattcggcaagggcgggatcgtgacatgcgcaatgtttacctgcaaaaagaatatggaaggaaaagtggtccagcctgagaacctcgaatacactattgttataacgccacacagcggtgaggagcatgccgtgggcaatgacacagggaagcacggaaaagaaatcaagattaccccgcagtcctcaatcactgaggctgaactgaccggctatggtacagtaaccatggagtgtagtcccaggactgggcttgatttcaacgaaatggtgctgttgcaaatggaggacaaagcctggctcgtccaccggcagtggtttctggatttacctctgccatggctccccggcgcagacacacagggaagcaattggatacagaaggagacgcttgtgaccttcaagaaccctcatgctaaaaagcaagacgttgtggtcctgggctctcaggaaggggccatgcacactgcgttgacaggagccaccgagattcagatgtcctcaggtaatctactgtttacaggccatctcaaatgccgtctgcgcatggataagcttcaactgaaagggatgagctacagtatgtgtactggaaagttcaagatcgtgaaagaaatcgcagagacccagcacggcacgattgtaatcagagttcagtatgagggtgacgggtctccatgcaagattcccttcgaaataaccgatttggagaaaaggcatgtgctcggccggctgatcacagtcaacccgattgtgactgaaaaggactcccctgtcaacatcgaggctgaacccccatttggagatagctacatcattataggcgtggagcctgggcagttaaaactgaattggttcaagaagggatcgtctatcggtcaaatgtttgagaccacaatgcgaggcgccaaacgcatggctattctaggggacactgcctgggatttcggatccctcggcggtgtttttacctcaatcgggaaggcactgcaccaggtgttcggcgccatttacggagctgcgtttagtggcgtaagctggacgatgaaaatccttataggggtcatcattacatggatcggaatgaactccagatctaccagcttgtcagtgagtctggttctcgtgggcgtcgtgactctgtatcttggtgcagtagtgcaggccgactccgggtgtgttgtcagctggaagaataaagaactgaagtgcggatctggcattttcatcacagataacgtgcacacctggactgagcagtacaagtttcaacccgaatcaccaagtaaattggctagcgccatacagaaggcacatgaggaaggtatttgtggcatcaggtccgtgacccggctcgagaatctgatgtggaaacagattacacccgagttaaaccacatcctgtctgaaaatgaggtcaagctaacgataatgaccggggacatcaaaggaattatgcaggccggcaagcgctcgctcagacctcaaccaactgaactgaaatatagctggaagacatgggggaaggctaaaatgctttccaccgagtcacataaccagacattcttgatcgatggaccggaaactgccgagtgccccaataccaacagggcatggaatagtctggaggttgaagactacggctttggtgtgttcacgacaaacatttggctcaagctgcgtgagaaacaggacgtgttttgtgattctaagttaatgagcgcggctatcaaagacaatcgggccgtacacgcagatatggggtattggatagaatccgccctgaacgacacctggaagatggagaaggcttcattcattgaggtcaaaagctgccactggcctaagtctcatactctttggtccaatggagtgttggaaagtgagatgatcatcccaaaaaacttcgccggccccgttagccagcacaactaccgacctggttatcatacccaaacagcaggcccatggcacctcgggaagctggaaatggattttgacttctgtgagggaactaccgtggtcgtgacagaagattgcggcaatagagggccctctctaaggacgaccactgcttccggaaaactgattacagagtggtgctgtcgctcatgcaccctcccgcctctgcggtacagaggcgaggacggttgttggtacgggatggaaatcaggccacttaaggagaaggaagagaacttggttaatagtctggtgactgccggacatggccagattgataactttagcttaggtgtactcggcatggcgctgttccttgaagagatgctgcgcacacgaatagggaccaaacacgccatcttgctcgtcgctgtgtcgtttgtgacgctgattactggaaatatgtccttccgggacctaggccgtgtcatggttatggtgggggcaaccatgacagatgacatcggaatgggcgtaacctatctggccctcctggctgcctttaaggtgagacccactttcgcagcgggtcttttgctgaggaaattaacatctaaggagctcatgatggccaccattgggatcgctctgcttagccagtcaacaatacctgaaactatcctggagctaaccgatgccctcgcactgggaatgatggtcttgaaaattgtgcgcaacatggaaaagtaccaactggctgttacgatcatggccattagttgcgtgcccaatgcagtcatcttacagaacgcctggaaggtgtcctgtacaatactcgctgcggtttctgtgagcccactgcttctgacctcctcacagcagaaagccgactggattcctttggcactcactatcaagggcctgaatcccaccgctatctttctaacaactctgagccggaccagtaaaaagagatcttggccacttaacgaggccattatggccgtcggcatggtatccatactcgctagctcgctgttgaaaaatgacatcccgatgacggggcctctggtggcaggaggtttactcacagtttgctatgtgctgaccggcaggtcagccgatcttgaactggagcgagcggctgacgtcaagtgggaggatcaagccgaaatttctgggagttcccccatcttgagcattactatctctgaggacggaagcatgtccataaaaaacgaagaggaggaacagacactcaccatcctgattcgcactggcctactggtgatctcaggtgtattcccagtgagtattcccatcacagcagccgcttggtacctttgggaggtcaagaagcagcgggcaggggttctctgggatgtgcctagcccaccccctgtggaaaaagccgagctggaagacggagcgtatagaataaagcagaggggcattttgggctactctcaaatcggggctggagtctataaagagggtacctttcacacgatgtggcatgtgactcgtggcgccgttttaatgcaccgcgggaagcggatcgagccgtcctgggcagatgtaaaaaaggacctgatttcatacggaggcggttggaagctcgaaggggagtggaaagaaggagaggaagtgcaggtcctggcccttgagccaggcaagaatcccagagctgtgcagaccaaacctggcatcttcaagacaaacaccgggacaataggagccgttagtctggattttagcccaggtacttccggctctcccattgtggacaggaaagggaaggtcgtgggattgtacggcaatggtgtagtcacccgatcgggggcatatgtgagcgctatcgcccagacggagaagtcaattgaagataaccctgagatcgaagacgatatattccggaaaaagcgcctaacaattatggacctgcatccgggagcgggcaaaactaagagatacctccccgccatcgttagggaggcaatcaaacggggcctgcgaacccttattttagctccaacaagagtggtcgccgctgaaatggaggaggcactgcgcgggctccctatcaggtatcaaacccccgccattaagactgaacacaccggacgtgagatagtggacttgatgtgtcatgccacattcacgatgcggctgctctccccagttagagtgcctaactacaatctgatcattatggatgaagctcactttactgaccccgcgagtatcgcagccaggggttatatctctacccgcgtcgagatgggcgaggctgccgggattttcatgacagcaaccccaccgggaagccgagatccttttccccagtccaacgccccaataatggacgaagagagagaaatccccgagcggtcatggaattctggccacgaatgggtgactgatttcaagggtaaaacagtatggtttgtgcctagcattaaggctgggaacgacatcgcggcctgccttaggaaaaatggaaagaaagttattcagctgagtcgcaagaccttcgattccgagtacgtcaagacgcgtgcaaacgactgggattttgtggtgactacagacatcagcgagatgggcgctaatttcaaagccgaaagagtcatagatccacggaggtgtatgaagcccgtaatcttgaccgacggcgaggaacgcgtgattctagcagggcctatgccggttacccattcttcagccgctcaacgaagaggacggatcggtaggaacccaaaaaatgagaacgaccagtatatttacatgggcgaacccctggagaatgatgaggactgcgcccactggaaggaagcgaaaatgctcttagataacatcaatactcctgaggggataattccctccatgtttgaaccagagcgcgaaaaggtggacgcaatcgatggagagtacagactgaggggcgaggcccggaaaacattcgtcgaccttatgcgtcgcggtgatctgcctgtgtggctcgcttataaggttgccgctgaagggattaactacgcagaccgaaagtggtgttttgatggcatcaaaaataaccagatattggaggaaaacatggaggtggagatctggaccaaggaaggagagagaaaaaagctgaaacccaggtggctcgacgcccggatttatagtgatccactggctcttaaggaattcaaggagttcgccgcaggccgcaaaagcctaacactgaatttgatcactgaaatggggagattacctacgtttatgacccagaaggcgaggaacgccctggacaatctcgctgtcctgcatacagccgaggcaggaggtcgggcttacaaccacgccctttcggagctgccggaaactctcgagaccttgctgctactgacactccttgcaaccgtgactggcgggattttcctgtttttaatgtctggaaaaggcatcggtaagatgacgttggggatgtgctgcataattaccgcctccatcctgctctggtatgctcaaatccagccccactggattgcggccagcatcatactggaattctttcttattgtactgctcatcccagagcctgaaaaacagcgaacaccccaggataatcaattgacttacgtggttattgcaatcctgaccgtcgtggctgccacaatggccaacgagatgggcttcttagagaagaccaagaaagacctaggactgggctcaataactacacaggaaagtgagtctaatatcctcgacattgatcttagaccagcatccgcttggacgctgtatgccgtggcgaccacttttgtcacacctatgttgcgccatagcatcgaaaactcaagtgttaatgtgagcctgaccgctattgccaaccaggcaaccgtactcatggggctgggaaagggttggcccctttccaaaatggacatcggcgtgccgctcctggccattgggtgttactctcaggtcaatccaatcacattgactgctgcactgttactactggtggcccactacgcgataattggacctggcctccaagctaaggccacgagggaggcacagaaacgggccgctgccggtatcatgaagaaccccaccgttgatgggatcacagtgattgaccttgaaccaataccctatgatcctaagttcgagaaacagctgggccaggtcatgttgctgatcctctgcgtaactcaagtgctgatgatgcgtaccacatgggcactttgtgaggctttaaccctggccactggaccgattagcacgctctgggaaggcaatcccgggagattttggaacacaaccatcgcggtttccatggccaatattttcaggggatcatacttggcaggcgctggtctgctattttctatcatgaagaacactaccagtacacgccgggggactggaaatataggcgagaccctgggtgaaaaatggaagtcgcgactcaacgcccttggcaaaagcgagttccagatctataagaaatccgggattcaggaggtggacagaacactggcaaaggaaggaatcaagaggggcgagacggatcatcacgctgtctctcgcgggtcagccaaattgcggtggtttgtggaaagaaacatggtcaccccagagggaaaggtggttgacctgggctgcggtcgtgggggatggagctactattgtggcggtctcaaaaatgtgagggaagtaaagggcctgactaaagggggacctggccatgaggagcccattcctatgtccacatacgggtggaacttagtgcggcttcaaagtggagtcgatgttttcttcaccccacccgaaaagtgcgacactctgctctgtgatatcggcgagtctagccctaatccaacaatagaagccggtcgcaccctacgagtgctgaacttggtcgagaattggctgaacaataacacgcagttttgcattaaggtgctcaatccctatatgccgtcagtaatcgaaaaaatggaggcgcttcagagacagtacgggggagctctggtgaggaaccctttgtcccggaatagtacccacgagatgtactgggttagcaacgcaacaggcaatatcgtgtcttccgtcaacatgatttcacgcatgctgataaatagattcactatgaagcacaaaaaggccacctatgaaccagacgtggatctcggcagcgggacaaggaacatcggaattgagtcggaaatccccaacttagacattatcggtaaacgaatagagaagatcaagcaagaacatgagatttcttggcactacgaccaggatcatccttataaaacttgggcttaccacggcagttatgagaccaagcagacagggtccgccagctcaatggtcaatggagtggttcggctgcttaccaaaccatgggacgtagtgcccatggtcactcagatggcaatgacggatacaaccccgtttggccaacagcgtgtgttcaaggaaaaagttgacactagaacccaggagcctaaggaaggtacaaagaaactgatgaagatcacggccgagtggctatggaaagagctcgggaagaaaaagaccccccgcatgtgtactagggaagagtttacaaaaaaggtgcggtccaacgctgcgctgggagccattttcaccgatgaaaataagtggaaatctgcaagagaggctgtcgaagacggccgcttttgggagttggtggatagggagcgaaacctgcacctcgaaggcaagtgcgagacttgtgtatacaatatgatggggaaacgggaaaagaaacttggagagttcggtaaggccaagggcagcagagcaatctggtatatgtggctgggggccaggtttttagaattcgaggctctgggatttttgaacgaggaccattggttcagtcgcggcaattccctcagcggtgtggaaggggagggactgcaccgtctaggctacattcttcgggatgttggcaaaaaggaagggggagccatgtacgcggacgatacagcaggttgggacaccagaataacactggaggacctcaaaaacgaagagatggtcactaatcatatgaagggcgagcacaaaaagctggccgaagctatctttaagttgacctatcagaacaaagtggtgagggtccaacgcccaacgcctcgagggaccgttatggatattatctctcggagagaccagaggggatcaggccaggtgggtacatacgggctgaatactttcaccaacatggaggcccaactcatccgccagatggaaggagagggcattttcaagagtatacagcatcttacagcaactgaggaaatcgctgtacagaattggctggccagagtgggccgggagaggttatcccgtatggctattagcggggatgactgcgtcgtgaaacccatcgatgaccgatttgcctctgcactgaccgcgttgaacgatatgggaaaggttcgcaaagacattcaacagtgggaaccatcgagaggttggaatgattggacgcaggtgcccttctgctcacaccactttcatgagctcgtcatgaaggacggccgggtgctggtagttccttgtaggaaccaggatgaactaatcgggcgcgccagaataagccaaggagctggctggtcccttaaggagacagcctgcctgggtaaaagttatgcacagatgtggaccctcatgtacttccaccggagggacctgcgattggctgccaacgcaatctgttctgccgtgccaagccattgggtcccgacttcccgtacaacctggtcaattcacgcgaagcacgagtggatgactaccgaagatatgttagctgtgtggaatagagtgtggatccaggagaacccctggatggaagacaaaacacctgtcgagagttgggaagaggttccatatctggggaagcgcgaggaccagtggtgcggatctctcattggccttacgagccgggccacctgggcaaaaaatatccaaactgccataaaccaggtgaggtccctgattggcaatgaagagtacacagattatatgccctcaatgaagagatttcgccgggaagaggaagaggctggggtactatggtga

SEQ ID NO: 14480 - RNA, 9876 nt, synthetic construct
  misc_feature 1..9876: note = derived and/or modified CDS sequence (opt3) from DENV-2__EU569702__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctacaagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatagaatccgctctgaacgacacatggaagatggagcgagcctcattcattgaggtcaagagctgccactggcctaaatctcataccctttggtccaatggagtgttggaaagtgagatgatcatcccaaagaacttcgcaggccccgttagccagcacaactacagacctggttatcatactcaaaccgctggcccatggcacctcgggaaactggaaatggattttgacttctgtgagggaacaactgtggtcgtgaccgaagattgcggcaatagggggccctctctacgcacaacgaccgcctccggaaagctgattactgagtggtgctgtcggtcatgcacactcccgcctctgagatacaggggcgaggacggttgttggtacgggatggaaatccgcccacttaaagagaaggaagagaacttggttaatagtctggtgaccgcgggacatggccagattgataactttagcttaggtgtactcggcatggccctgttccttgaagagatgctgcgaactcggatagggacaaagcacgctatcttgctcgtcgcagtgtcgtttgtgaccctgattacgggaaatatgtccttccgtgacctaggcagagtcatggttatggtgggggccactatgaccgatgacatcggaatgggcgtaacatatctggctctcctggccgcatttaaagtgaggcccaccttcgcggccggtcttttgctgcgcaagttaacttctaaagagctcatgatggctacaattgggatcgccctgcttagccagtcaaccatacctgaaacaatcctggagctaactgatgcactcgctctgggaatgatggtcttgaagattgtgcggaacatggaaaaataccaactggccgttaccatcatggcaattagttgcgtgcccaatgccgtcatcttacagaacgcttggaaggtgtcctgtacgatactcgcggccgtttctgtgagcccactgcttctgacatcctcacagcagaaggcagactggattcctttggctctcaccatcaaaggcctgaatcccactgccatctttctaaccacactgagcagaactagtaagaaaaggtcttggccacttaacgaggccattatggctgtcggcatggtatccatactcgcaagctcgctgttgaagaatgacatcccgatgaccgggcctctggtggccggaggtttactcacggtttgctatgtgctgacaggccgatcagcggatcttgaactggagcgcgctgccgacgtcaaatgggaggatcaagcagaaatttctgggagttcccccatcttgagcattaccatctctgaggacggaagcatgtccataaagaacgaagaggaggaacagactctcacaatcctgattcggaccggcctactggtgatctcaggtgtattcccagtgagtattcccatcactgccgctgcatggtacctttgggaggtcaaaaagcagagagccggggttctctgggatgtgcctagcccaccccctgtggaaaaggcggagctggaagacggagcttataggataaaacagcgtggcattttgggctactctcaaatcggggccggagtctataaggagggtacatttcacaccatgtggcatgtgacgcgcggcgcagttttaatgcaccgggggaaaagaatcgagccgtcctgggccgatgtaaagaaagacctgatttcatacggaggcggttggaagctcgaaggggagtggaaggaaggagaggaagtgcaggtcctggctcttgagccaggcaaaaatcccagggccgtgcagactaagcctggcatcttcaaaaccaacacagggaccataggagcagttagtctggattttagcccaggtacatccggctctcccattgtggaccgaaaggggaaagtcgtgggattgtacggcaatggtgtagtcactcggtcgggggcttatgtgagcgccatcgcgcagaccgagaagtcaattgaagataaccctgagatcgaagacgatatattccgcaagaaaagactaacgattatggacctgcatccgggagccggcaagacaaaaaggtacctccccgcaatcgttcgggaggctatcaagcgaggcctgagaactcttattttagccccaacccgcgtggtcgctgcagaaatggaggaggccctgagggggctccctatccgttatcaaacacccgccattaaaaccgaacacactggacgggagatagtggacttgatgtgtcatgctaccttcacaatgagactgctctccccagttagggtgcctaactacaatctgatcattatggatgaagcgcactttacggaccccgcaagtatcgccgctcgcggttatatctctactcgagtcgagatgggcgaggccgcagggattttcatgaccgccacaccaccgggaagcagagatccttttccccagtccaacgctccaataatggacgaagagcgggaaatccccgagaggtcatggaattctggccacgaatgggtgaccgatttcaagggtaagactgtatggtttgtgcctagcattaaagcggggaacgacatcgccgcatgccttcgcaagaatggaaaaaaggttattcagctgagtcgtaaaacattcgattccgagtacgtcaagaccagagctaacgactgggattttgtggtgacgactgacatcagcgagatgggcgccaatttcaaggcagaacgggtcatagatccaaggcgctgtatgaaacccgtaatcttgacagactctgaggaacgagtgattctagccggccctatgccggttacccattcatccgctgcccaaagacgggggaggatcggacgcaacccaaagaatgagaacgaccagtatatttacatgggtgaacccctggagaatgatgaggactgcgcgcactggaaagaagcaaagatgctcttagataacatcaatacccctgagggcataattcccagtatgtttgaaccagagagagaaaaagtggacgccatcgatggggagtacaggctgcggggagaggctcgtaagactttcgtcgaccttatgcgccgaggcgatctgcctgtgtggctcgcctataaagttgctgcagaaggtattaactacgccgacagaaagtggtgttttgatgggatcaagaataaccagatattggaggaaaacatggaggtggagatctggacaaaagaaggcgagaggaagaaactgaagccccggtggctcgacgctcgcatttatagcgatccactggcccttaaagaattcaaggagttcgcagcgggaagaaagtcgctaaccctgaatttgatcacagaaatgggcaggttacctacttttatgacgcagaaagcccggaacgctctggacaatctcgccgtcctgcataccgcagaggctgggggacgagcctacaaccacgcactttctgagctgccggaaacactcgagactttgctgctactgaccctccttgccacagtgaccggtggcattttcctgtttttaatgtccgggaagggaatcggcaaaatgactttgggtatgtgctgcataattacggctagcatcctgctctggtatgcgcaaatccagccccactggattgccgcatcaatcatactggaattctttcttattgtactgctcatcccagagcctgaaaagcagagaaccccccaggataatcaattgacatacgtggttattgctatcctgactgtcgtggccgccaccatggcaaacgagatggggttcttagagaaaacaaagaaggacctaggcctgggaagtataaccactcaggaatctgagtccaatatcctcgacattgatcttcgcccagctagcgcctggacactgtatgcggtggctacgacctttgtcactcctatgttgaggcattcaatcgaaaacagtagcgttaatgtgtccctgacagccattgcaaaccaggccaccgtactcatgggcctggggaaaggatggcccctttctaagatggacatcggtgtgccgctcctggctattggctgttacagccaggtcaatccaatcaccttgacagcagccctgttactactggtggcgcactacgctataattgggcctggactccaagccaaagcaactcgggaggcccagaagcgtgctgccgcaggcatcatgaaaaaccccacggttgatggtatcaccgtgattgaccttgaaccaataccctatgatcctaagttcgagaagcagctggggcaggtcatgttgctgatcctctgcgtaacacaagtgctgatgatgagaactacctgggctctttgtgaggccttaacactggcgaccggcccgatttccactctctgggaaggaaatcccggcaggttttggaacacgacaatcgccgtttcaatggcaaatattttccgcgggtcttacttggctggagccggcctgctatttagtatcatgaaaaacaccacttcgacccggcgaggtacagggaatataggagagactctgggcgaaaagtggaaaagcagactcaacgcacttggtaagtccgagttccagatctataaaaagtctggcattcaggaggtggacaggaccctggctaaagaagggatcaagcgcggagagacagatcatcacgccgtctcacggggcagcgccaagttgagatggtttgtggaacgtaacatggtcacgccagaggggaaagtggttgacctgggatgcggcaggggtgggtggtcctactattgtggaggcctcaagaatgtgcgggaagtaaaaggtctgaccaagggcgggcctggacatgaggagcccattcctatgagtacttacggctggaacttagtgcgccttcaatctggggtcgatgttttcttcacaccacccgaaaaatgcgacaccctgctctgtgatatcggagagagctcacctaatccaactatagaagcgggccgaacactaagagtgctgaacttggtcgagaattggctgaacaataacacccagttttgcattaaggtgctcaatccctatatgccgtccgtaatcgaaaagatggaggctcttcagaggcagtacggtggggcactggtgcggaaccctttgagtcgcaatagcacgcacgagatgtactgggtttctaacgccaccggaaatatcgtgtcctcagtcaacatgattagcagaatgctgataaataggttcacaatgaaacacaagaaagctacttatgaaccagacgtggatctcggctcgggcacccgaaacatcgggattgagtctgaaatccccaacttagacattatcggaaagcggatagagaaaatcaagcaagaacatgagattagttggcactacgaccaggatcatccttataagacatgggcctaccacggttcctatgagactaaacagaccggcagcgcatcatccatggtcaatggggtggttcgtctgcttacaaagccatgggacgtagtgcccatggtcacccagatggccatgactgatacgacaccgtttggacaacagagagtgttcaaagaaaaggttgacacccgcactcaggagcctaaagaaggcaccaagaagctgatgaaaatcacagctgagtggctatggaaggagctcggtaaaaagaaaacgcccaggatgtgtacccgggaagagtttactaagaaagtgagatctaacgcggccctgggggcaattttcacagatgaaaataagtggaagagcgctcgcgaggccgtcgaagacggaaggttttgggagttggtggatcgagagcggaacctgcacctcgaaggcaaatgcgagacctgtgtatacaatatgatgggcaagagagaaaaaaagcttggggagttcggaaaagcaaagggtagtagggccatctggtatatgtggctgggcgctcgctttttagaattcgaggccctggggtttttgaacgaggaccattggttctcccgtggaaatagcctctctggcgtggaaggtgaggggctgcaccggctaggatacattcttagagatgttggcaagaaagaaggcggggcgatgtacgcagacgatactgccggatgggacacaaggataaccctggaggacctcaagaacgaagagatggtcacaaatcatatgaaaggtgagcacaagaaactggctgaagccatctttaagttgacttatcagaacaaggtggtgcgcgtccaacgaccaacccctcggggcacggttatggatattatctcaagaagggaccagcgcgggagtggacaggtgggcacctacggtctgaatacattcactaacatggaggcacaactcatcagacagatggaaggggagggaattttcaaatccatacagcatcttaccgctacagaggaaatcgccgtacagaattggctggctcgggtgggcagggagcgtttaagccgaatggccatttctggcgatgactgcgtcgtgaagcccatcgatgaccgctttgcatcggcgctgactgccttgaacgatatggggaaagttagaaaggacattcaacagtgggaaccatcacggggatggaatgattggacccaggtgcccttctgcagccaccactttcatgagctcgtcatgaaagacggtagggtgctggtagttccttgtcgcaaccaggatgaactaatcggcagagctcggatatcccaaggggccggatggagtcttaaggagacggcatgcctgggcaagtcttatgctcagatgtggacactcatgtacttccacaggcgagacctgcgtttggccgcaaacgccatctgtagcgcggtgccatcccattgggtcccgacctcaagaactacatggagtattcacgctaaacacgagtggatgaccactgaagatatgttagccgtgtggaatcgcgtgtggatccaggagaacccctggatggaagacaagacccctgtcgagtcttgggaagaggttccatatctgggtaaacgggaggaccagtggtgcgggagcctcattggacttacatccagggcaacgtgggccaagaatatccaaaccgctataaaccaggtgagatcactgattggcaatgaagagtacactgattatatgcccagcatgaaacgctttcggagggaagaggaagaggccggcgtactatggtga

SEQ ID NO: 14481 - RNA, 9876 nt, synthetic construct
  misc_feature 1..9876: note = derived and/or modified CDS sequence (opt3) from DENV-2__EU482624__SS-prME
  source 1..9876: mol_type = other RNA
accgccggcgtgatcgtaatgctgattccaacagctatggctttccacctcactacgagaaacggggaacctcatatgatagttggaagacaggaaaagggtaaaagccttctgtttaagaccgaagacggcgtgaatatgtgcacattgatggccatcgatttaggggaactgtgtgaagacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccacatgtgggtatggggcttgagaccagaacagaaacttggatgagtagcgagggagcttggaaacacgttcagaggattgagacctggatcctgcggcatcctggcttcacaataatggccgcaatcttggccaacaccattggcacgactcactttcagcgcgctctcatcttcattctgctgacagcagtggccccatccatgaccatgagatgcatcgggatatctaatagggattttgtcgaaggagtgtcgggtggctcatgggtagacattgttctcgagcacgggagctgtgtgactacaatggctaagaacaagcccaccttagatttcgaactgatcaaaacggaggccaagcagcctgcgacccttcggaaatactgcattgaagcaaagttgacaaatactaccacagagagtcgctgtccaactcaaggagagccctccctgaacgaagaacaggacaaacgatttatctgcaagcattctatggtcgatagaggctggggtaatgggtgtggactattcggcaagggcgggatcgtgacctgcgccatgtttacatgcaaaaagaacatggaaggaaaagtggtccagcctgagaatctcgaatataccattgttataactccacacagcggtgaggagcatgctgtgggcaacgacacggggaagcacggaaaagaaatcaagattacaccgcagtcctcaatcaccgaggccgaactgactggctacggtaccgtaacaatggagtgtagtcccaggaccgggcttgatttcaatgaaatggtgctgttgcaaatggaggacaaagcatggctcgtccaccggcagtggtttctggatttacctctgccatggctccccggcgctgacatacagggaagcaactggattcagaaggagactcttgtgacattcaagaatcctcatgccaaaaagcaagacgttgtggtcctgggctctcaggaaggggcgatgcacacggccttgaccggagcaactgagatccagatgtcctcaggtaacctactgtttacaggccatctcaaatgccgtctgcgcatggataaacttcaactgaaagggatgagctatagtatgtgtaccggaaagttcaagatcgtgaaagaaattgctgagacacagcacggcactatcgtaattagagttcagtacgagggtgacgggtctccatgcaagatacccttcgaaatcaccgatttggagaaaaggcatgtgctcggccggctgattacggtcaacccgatcgtgaccgaaaaggactcccctgtcaatatcgaggccgaacccccatttggagatagctatattataatcggcgtggagcctgggcagttaaaactgaactggttcaagaagggatcgtctattggtcaaatgtttgagacaactatgcgaggcgctaaacgcatggccatcctaggggacaccgcatgggatttcggatccctcggcggtgtttttacatcaattgggaaggccctgcaccaggtgttcggcgctatctacggagcggcatttagtggcgtaagctggactatgaaaatacttatcggggtcattatcacctggattggaatgaactccagatctacgagcttgtcagtgagtctggttctcgtgggcgtcgtgacactgtaccttggtgccgtagtgcaggctgactccgggtgtgttgtcagctggaagaacaaagaactgaagtgcggatctggcatcttcataaccgataatgtgcacacttggacagagcagtataagtttcaacccgaatcaccaagtaaattggccagcgcaattcagaaggcccatgaggaaggtatctgtggcattaggtccgtgacccggctcgagaacctgatgtggaaacagatcactcccgagttaaatcacatactgtctgaaaacgaggtcaagctaaccatcatgacaggggacattaaaggaatcatgcaggctggcaagcgctcgctcagacctcaaccaacggaactgaaatacagctggaagacctgggggaaggccaaaatgctttccactgagtcacataatcagacattcttgattgatggaccggaaaccgcagagtgccccaacacaaatagggcgtggaacagtctggaggttgaagactatggctttggtgtgttcactaccaatatctggctcaagctgcgtgagaaacaggacgtgttttgtgattctaagttaatgagcgctgccataaaagacaaccgggcagtacacgccgatatggggtactggattgaatccgctctgaatgacacgtggaagatggagaaggcctcattcatcgaggtcaaaagctgccactggcctaagtctcatacactttggtccaacggagtgttggaaagtgagatgatcattcccaagaatttcgcaggccccgttagccagcacaattatcgacctggttaccatacccaaactgctggcccatggcacctcgggaagctggaaatggattttgacttctgtgagggaaccacagtggtcgtgactgaagattgcggcaacagagggccctctctaaggaccacaacggcctccggaaaactgatcaccgagtggtgctgtcgctcatgcactctcccgcctctgcggtatagaggcgaggacggttgttggtacgggatggaaattaggccacttaaggagaaggaagagaatttggttaacagtctggtgacagcgggacatggccagatagataattttagcttaggtgtactcggcatggccctgttccttgaagagatgctgcgcacccgaatcgggactaaacacgctattttgctcgtcgcagtgtcgtttgtgacactgatcaccggaaacatgtccttccgggacctaggccgtgtcatggttatggtgggggccacgatgactgatgacattggaatgggcgtaacctacctggctctcctggccgcatttaaggtgagacccacattcgcggccggtcttttgctgaggaaattaacctctaaggagctcatgatggctactatcgggatagccctgcttagccagtcaacaatccctgaaaccattctggagctaacagatgcactcgctctgggaatgatggtcttgaaaatcgtgcgcaatatggaaaagtatcaactggccgttactattatggcaatcagttgcgtgcccaacgccgtcatattacagaatgcttggaaggtgtcctgtaccattctcgcggccgtttctgtgagcccactgcttctgacgtcctcacagcagaaagcagactggatccctttggctctcacaatcaagggcctgaaccccaccgccatttttctaactaccctgagccggacaagtaaaaagagatcttggccacttaatgaggccataatggctgtcggcatggtatccatcctcgcaagctcgctgttgaaaaacgacattccgatgactgggcctctggtggccggaggtttactcaccgtttgctacgtgctgacgggcaggtcagcggatcttgaactggagcgagctgccgacgtcaagtgggaggatcaagcagaaatctctgggagttcccccattttgagcatcacaatatctgaggacggaagcatgtccatcaaaaatgaagaggaggaacagaccctcactattctgatccgcacaggcctactggtgatttcaggtgtattcccagtgagtatccccataaccgccgctgcatggtatctttgggaggtcaagaagcagcgggccggggttctctgggatgtgcctagcccaccccctgtggaaaaagcggagctggaagacggagcttacagaattaagcagaggggcatcttgggctattctcaaatcggggccggagtctacaaagagggtacttttcacacaatgtggcatgtgacccgtggcgcagttttaatgcaccgcgggaagcggattgagccgtcctgggccgatgtcaaaaaggacctgatctcatatggaggcggttggaagctcgaaggggagtggaaagaaggagaggaagtgcaggtcctggctcttgagccaggcaagaaccccagagccgtgcagacgaaacctggcatattcaagactaataccgggacaattggagcagttagtctggattttagcccaggtacctccggctctcccatcgtggacaggaaagggaaggtcgtgggattgtacggcaacggtgtagtcacacgatcgggggcttacgtgagcgccattgcgcagactgagaagtcaatcgaagataaccctgagatagaagacgatattttccggaaaaagcgcctaaccatcatggacctgcatccgggagccggcaaaacgaagagatatctccccgcaatcgttagggaggctattaaacggggcctgcgaacacttatcttagccccaactagagtggtcgctgcagaaatggaggaggccctgcgcgggctccctattaggtaccaaacccccgccataaagacagaacacaccggacgtgagatcgtggacttgatgtgtcatgctactttcaccatgcggctgctctccccagttagagtgcctaattataacctgattatcatggatgaagcgcactttacagaccccgcaagtatcgccgctaggggttacatttctacgcgcgtcgagatgggcgaggccgcagggatattcatgactgccaccccaccgggaagccgagatccttttccccagtccaatgctccaatcatggacgaagagagagaaattcccgagcggtcatggaactctggccacgaatgggtgacagatttcaagggtaaaaccgtatggtttgtgcctagcatcaaggcggggaatgacattgccgcatgccttaggaaaaacggaaagaaagttatccagctgagtcgcaagactttcgattccgagtatgtcaagacacgtgctaatgactgggattttgtggtgaccacggacataagcgagatgggcgccaacttcaaagcagaaagagtcatcgatccacggaggtgtatgaagcccgtaattttgactgacggcgaggaacgcgtgatcctagccgggcctatgccggttacacattcttcagctgcccaacgaagaggacggattggtaggaatcccaaaaacgagaatgaccagtacatctatatgggcgaacccctggagaacgatgaggactgcgcgcactggaaggaagcaaaaatgctcttagataatataaacacccctgaggggattatcccctccatgtttgaaccagagcgcgaaaaggtggacgccattgatggagagtacagactgaggggcgaggctcggaaaaccttcgtcgaccttatgcgtcgcggtgatctgcctgtgtggctcgcctacaaggttgctgcagaagggatcaattatgccgaccgaaagtggtgttttgatggcatcaaaaacaaccagatattggaggaaaatatggaggtggagatttggactaaggaaggagagaggaaaaagctgaaacccaggtggctcgacgctcggatctacagtgatccactggcccttaaggagttcaaggagttcgcagcgggccgcaaaagcctaacactgaacttgattaccgaaatggggagattacctacatttatgactcagaaggccaggaatgctctggacaacctcgccgtcctgcatacggcagaggctggaggtcgggcctataatcacgcactttcggagctgccggaaaccctcgagacattgctgctactgactctccttgccaccgtgacaggcgggatcttcctgtttttaatgtctggaaaaggcataggtaagatgaccttggggatgtgctgcattatcactgcttccatcctgctctggtacgcgcaaattcagccccactggatcgccgcaagcataattctggagttctttcttatcgtactgctcattccagagcctgaaaaacagcgaacgccccaggataaccaattgacctatgtggttatcgctatactgacagtcgtggccgccactatggcaaatgagatgggcttcttagagaagaccaagaaagacctaggactgggctcaatcacaacccaggaaagtgagtctaacattctcgacatcgatcttagaccagcttccgcctggactctgtacgcggtggctacaacgtttgtcacccctatgttgcgccatagcattgaaaattcaagtgttaacgtgagcctgactgccatcgcaaatcaggccacagtactcatggggctgggaaagggttggcccctttccaaaatggacattggcgtgccgctcctggctatcgggtgttattctcaggtcaacccaataaccttgaccgcagccctgttactactggtggcgcactacgctattatcggacctggcctccaagccaaggcaacaagggaggcccagaaacgggctgccgcaggtatcatgaagaatcccactgttgatgggattacggtgatagaccttgaaccaatcccctacgatcctaagttcgagaaacagctgggccaggtcatgttgctgattctctgcgtaacccaagtgctgatgatgcgtacaacttgggctctttgtgaggccttaaccctggcgacaggaccgatcagcaccctctgggaaggcaaccccgggagattttggaatactacgattgccgtttccatggcaaacatcttcaggggatcatatttggctggcgccggtctgctattttctataatgaagaatacaaccagtactcgccgggggaccggaaacatcggcgagacactgggtgaaaaatggaagtcgcgactcaacgcacttggcaaaagcgagttccagatttacaagaaatccgggatccaggaggtggacagaactctggctaaggaaggaattaagaggggcgagaccgatcatcacgccgtctctcgcgggtcagccaaattgcggtggtttgtggaaagaaatatggtcacaccagagggaaaggtggttgacctgggctgcggtcgtgggggatggagctattactgtggcggtctcaaaaacgtgagggaagtaaagggcctgacgaaagggggacctggccatgaggagcccatccctatgtccacctatgggtggaatttagtgcggcttcaaagtggagtcgatgttttcttcactccacccgaaaagtgcgacacactgctctgtgatataggcgagtctagccctaacccaaccattgaagcgggtcgcactctacgagtgctgaatttggtcgagaactggctgaataacaatacacagttttgcatcaaggtgctcaacccctacatgccgtcagtaatcgagaaaatggaggcacttcagagacagtatgggggagcactggtgaggaatcctttgtcccggaacagtacccacgagatgtactgggttagcaatgccacgggcaacattgtgtcttccgtcaatatgatatcacgcatgctgatcaacagattcaccatgaagcacaaaaaggctacatacgaaccagacgtggatctcggcagcgggactaggaacattggaatcgagtcggaaattcccaatttagacatcataggtaaacgaatcgagaagattaagcaagaacatgagatctcttggcactatgaccaggatcatccttacaaaacctgggcctatcacggcagttacgagacaaagcagactgggtccgcaagctcaatggtcaacggagtggttcggctgcttaccaaaccatgggacgtagtgcccatggtcacacagatggccatgaccgatactacgccgtttggccaacagcgtgtgttcaaggaaaaagttgacacaagaacccaggagcctaaggaaggtactaagaaactgatgaagattaccgctgagtggctatggaaagagctcgggaagaaaaagacaccccgcatgtgtacgagggaagagtttaccaaaaaggtgcggtccaatgcggccctgggagcaatcttcactgatgaaaacaagtggaaatctgctagagaggccgtcgaagacggccgcttttgggagttggtggatagggagcgaaatctgcacctcgaaggcaagtgcgagacatgtgtatataacatgatggggaaacgggaaaagaaacttggagagttcggtaaggcaaagggcagcagagccatttggtacatgtggctgggggctaggtttttagagttcgaggccctgggatttttgaatgaggaccattggttcagtcgcggcaactccctcagcggtgtggaaggggagggactgcaccgtctaggctatatacttcgggatgttggcaaaaaggaagggggagcgatgtacgcagacgataccgccggttgggacactagaatcacactggaggacctcaaaaatgaagagatggtcaccaaccatatgaagggcgagcacaaaaagctggctgaagccatttttaagttgacataccagaataaagtggtgagggtccaacgcccaactcctcgagggaccgttatggatatcatctctcggagagaccagaggggatcaggccaggtgggtacgtatgggctgaacaccttcacaaatatggaggcacaactcattcgccagatggaaggagagggcatattcaagagtatccagcatcttactgctaccgaggaaattgccgtacagaactggctggctagagtgggccgggagaggttatcccgtatggccatcagcggggatgactgcgtcgtgaaacccattgatgaccgatttgcatctgcgctgacagccttgaatgatatgggaaaggttcgcaaagacatccaacagtgggaaccatcgagaggttggaacgattggactcaggtgcccttctgctcacaccactttcatgagctcgtcatgaaggacggccgggtgctggtagttccttgtaggaaccaggatgaactaatagggcgcgctagaatcagccaaggagccggctggtcccttaaggagaccgcatgcctgggtaaaagttacgctcagatgtggacgctcatgtatttccaccggagggacctgcgattggccgcaaatgccatttgttctgcggtgccaagccattgggtcccgacatcccgtaccacttggtcaatccacgctaagcacgagtggatgacaaccgaagatatgttagccgtgtggaacagagtgtggattcaggagaatccctggatggaagacaaaactcctgtcgagagttgggaagaggttccatacctggggaagcgcgaggaccagtggtgcggatctctcatcggccttaccagccgggcaacatgggccaaaaacatacaaacggctattaatcaggtgaggtccctgatcggcaacgaagagtataccgattacatgccctcaatgaagagatttcgccgggaagaggaagaggccggggtactatggtga

SEQ ID NO: 14482 - RNA, 9876 nt, synthetic construct
  misc_feature 1..9876: note = derived and/or modified CDS sequence (opt3) from DENV-2__EU596500__SS-prME
  source 1..9876: mol_type = other RNA
accgccggcgtgatcgtcatgctgattccaactgctatggcattccacctcactacgagaaacggggaacctcatatgatagttggaaggcaggaaaagggtaaaagccttctgtttaagaccgaagacggcgtgaatatgtgcacattgatggccatcgatttaggggaactgtgtgaagacactattacctacaaatgcccgctactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatagaatccgctctgaacgacacatggaagatggagaaggcctcattcattgaggtcaaaagctgccactggcctaagtctcataccctttggtccaatggagtgttggaaagtgagatggttatccccaagaatttcgcaggccccgtgagccagcacaactaccgacctggttatcatactcaaaccgctggcccatggcacctcgggaagctggaaatggattttgacttctgtgagggaacaactgtcgtggttaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaattaggccacttaaggagaaggaagagaacttggtgaatagtctggtaaccgcgggacatggccagatcgataactttagcttaggtgtcctcggcatggccctgttccttgaagagatgctgcgcactcgaattgggacaaaacacgctatattgctcgtggcagtgtcgtttgtcaccctgatcacgggaaatatgtccttccgggacctaggccgtgttatggtgatggtaggggccactatgaccgatgacattggaatgggcgtgacatatctggctctcctggccgcatttaaggtcagacccaccttcgcggccggtcttttgctgaggaaattaacttctaaggagctcatgatggctacaatcgggattgccctgcttagccagtcaaccatccctgaaacaatactggagctaactgatgcactcgctctgggaatgatggtgttgaaaatcgttcgcaacatggaaaagtaccaactggccgtgaccattatggcaatcagttgcgtccccaatgccgtgattttacagaacgcttggaaggtttcctgtacgatcctcgcggccgtgtctgtcagcccactgcttctgacatcctcacagcagaaagcagactggatacctttggctctcaccattaagggcctgaatcccactgccatctttctaaccacactgagccggacaagtaaaaagagatcttggccacttaacgaggccatcatggctgtaggcatggtgtccattctcgcaagctcgctgttgaaaaatgacataccgatgaccgggcctctggttgccggaggtttactcacggtgtgctatgtcctgacaggcaggtcagcggatcttgaactggagcgagctgccgacgtgaagtgggaggatcaagcagaaatctctgggagttcccccattttgagcatcaccatttctgaggacggaagcatgtccatcaaaaacgaagaggaggaacagactctcacaatactgatccgcaccggcctactggtaatttcaggtgtgttcccagtcagtatccccattactgccgctgcatggtacctttgggaggttaagaagcagcgggccggggtgctctgggatgtgcctagcccaccccctgtcgaaaaagcggagctggaagacggagcttatagaatcaagcagaggggcatattgggctactctcaaattggggccggagtgtataaagagggtacatttcacaccatgtggcatgttacgcgtggcgcagtattaatgcaccgcgggaagcggatcgagccgtcctgggccgatgtgaaaaaggacctgatctcatacggaggcggttggaagctcgaaggggagtggaaagaaggagaggaagtccaggtgctggctcttgagccaggcaagaatcccagagccgttcagactaaacctggcattttcaagaccaacacagggaccatcggagcagtgagtctggattttagcccaggtacatccggctctcccatagtcgacaggaaagggaaggtggtaggattgtacggcaatggtgtcgtgactcgatcgggggcttatgttagcgccattgcgcagaccgagaagtcaatcgaagataaccctgagattgaagacgatatcttccggaaaaagcgcctaacgataatggacctgcatccgggagccggcaaaacaaagagatacctccccgcaattgtgagggaggctatcaaacggggcctgcgaactcttatcttagccccaaccagagtcgtggctgcagaaatggaggaggccctgcgcgggctccctattaggtatcaaacacccgccatcaagaccgaacacactggacgtgagattgttgacttgatgtgtcatgctaccttcacaatgcggctgctctccccagtgagagtccctaactacaatctgataatcatggatgaagcgcactttacggaccccgcaagtattgccgctaggggttatatctctactcgcgtggagatgggcgaggccgcagggatcttcatgaccgccacaccaccgggaagccgagatccttttccccagtccaacgctccaattatggacgaagagagagaaatacccgagcggtcatggaactctggccacgaatgggtaaccgatttcaagggtaaaactgtgtggtttgttcctagcatcaaggcggggaacgacattgccgcatgccttaggaaaaatggaaagaaagtcatccagctgagtcgcaagacattcgattccgagtacgtgaagacccgtgctaacgactgggattttgtggtcacgactgacattagcgagatgggcgccaatttcaaagcagaaagagtaatcgatccacggaggtgtatgaagcccgtgatattgacagacggcgaggaacgcgttatcctagccgggcctatgccggtgacccattcttcagctgcccaacgaagaggacggattggtaggaaccccaaaaatgagaacgaccagtatatctacatgggcgaacccctggagaatgatgaggactgcgcgcactggaaggaagcaaaaatgctcttagataacattaatacccctgaggggatcataccctccatgtttgaaccagagcgcgaaaaggtcgacgccattgatggagagtacagactgaggggcgaggctcggaaaactttcgtggaccttatgcgtcgcggtgatctgcctgtttggctcgcctataaggtggctgcagaagggatcaactacgccgaccgaaagtggtgttttgatggcattaaaaataaccagatcttggaggaaaacatggaggtcgagatatggacaaaggaaggagagaggaaaaagctgaaacccagatggctcgacgctcggatctatagtgatccactggcccttaaggagttcaaggagttcgcagcgggccgcaaaagcctaaccctgaatttgattacagaaatggggagattacctacttttatgacgcagaaggccaggaacgctctggacaatctcgccgtgctgcataccgcagaggctggaggtcgggcctacaaccacgcactttcggagctgccggaaacactcgagactttgctgctactgaccctccttgccacagtaaccggcgggatcttcctgtttttaatgtctggaaaatccattggcaagatgactttgggtatgtgctgcatcataacggctagcattctgctctggcacgcgcaaatccagccccattggatcgccgcatcaattatcctggagttctttcttatagtgctgctcattccagagcctgaaaaacagcgaaccccacaggataatcaattgacatatgttgtcatcgctattctgactgtggtggccgccaccatggcaaacgagatggggttcttagagaagacaaagaaagacctaggcctgggaagtatcaccactcaggaatctgagtccaatatactcgacatcgatcttagaccagctagcgcctggacactgtacgcggtcgctacgacctttgttactcctatgttgcgccactcaattgaaaacagtagcgtgaatgtatccctgacagccatcgcaaaccaggccaccgtgctcatgggcctggggaagggatggcccctttctaaaatggacattggtgtcccactcttcgctatcggctgttattaccaggtgaatccaattaccctgacagcagccttgctgctattagttgcgcataacgctatcatagggcaaggactgcaggccaaggcaactagggaggcccagaaacgggctgccgcaggcattatgaagaatcctacggtggatggtatcaccgtcatcgacctcgaacccattccatacgatcccaagtttgagaaacagcttgggcaagtaatgctgttgatactgtgcgtgacacaggttctcatgatgcgtactacctgggctctgtgtgaggcccttacattagcgaccggccctatcagcactctgtgggaaggaaacccgggcagattctggaatacgacaattgccgtgtccatggcaaacatctttagggggtcatatctcgctggagccggcttgctgttctctattatgaagaataccacaagtacccgccggggtacagggaacatcggagagactctaggcgaaaaatggaagtcgcgactgaacgcactcggtaaaagcgagtttcagatatacaagaaatccggcatccaagaggtcgacagaacccttgctaaggaagggattaagaggggagagacagatcaccatgccgtgtctcgcggctcagccaaactgcggtggttcgtcgaaagaaatatggtgacgcccgaggggaaggttgtggacttgggatgcggccgtggtgggtggagctattactgtggaggcctgaaaaacgtaagggaagtgaagggtctcaccaaaggcgggccaggacacgaggagcctatccccatgtccacttatggctggaatctggtccggttacagagtggggttgatgtgttctttacacctccagaaaagtgcgacacccttctgtgtgatattggagagtctagccccaaccctactatcgaagcgggccgcacactccgagtcctaaatctggtggagaactggttgaataacaatacccagttctgcataaaggtactgaacccatacatgccctcagtgattgagaaaatggaggctctccagagacaatatggtggggcacttgttaggaatccgctgtcccggaacagtacgcacgagatgtactgggtgagcaatgccaccggaaacatcgtctcttccgtgaatatgatctcacgcatgttgattaacagatttacaatgaagcataaaaaggctacttacgaacctgacgtcgatctgggcagcggcaccaggaacatagggatcgagaatgaaattccaaacctcgacatcattggaaaacgaatcgagaagataaagcaggaacacgagatctcgtggcattatgaccaggatcacccctacaaaacatgggcctatcacggttcttacgagactaagcagaccggcagtgcatccagcatggtgaatggggttgtacggttactgacaaaaccttgggacgtggtcccaatggtgacccaaatggccatgactgatacgacacccttcggacagcagcgtgtttttaaggaaaaagtggacaccagaactcaggagccgaaggaaggcaccaagaaacttatgaagattacagctgagtggctgtggaaagagctaggtaagaaaaagacgcctcgcatgtgtaccagggaagagttcactcggaaagtcagatcaaacgcggccctcggggcaatctttacagatgaaaataagtggaagtccgctcgcgaggccgtggaagacggaaggttctgggagctggtagatcgagagcggaacttgcatctggaaggcaaatgcgagacctgtgtgtataatatgatgggcaagagagagaaaaagctcggggagtttggaaaagcaaagggttctagggccatttggtacatgtggcttggcgctcgcttcctggaatttgaggccttagggttcctgaacgaggaccactggtttagccgtggaaatagtttgtccggcgttgaaggtgaggggctccatcggctgggatatatcctaagagatgtcggcaagaaagaaggcggggcgatgtacgcagacgatactgccggatgggacacaaggattacccttgaggacctgaagaacgaagagatggtgacaaatcacatgaaaggtgagcataagaaactcgctgaagccatattcaagctgacttaccaaaacaaggtggtccgcgttcagcgacccaccccacggggcacggtgatggatatcattagcagaagggaccagcgcgggtctggacaagtaggcacctatggtttgaatacattcactaacatggaggcacagctgatcagacagatggaaggggagggaatctttaaatcaattcagcacctcaccgctacagaggaaatagccgtgcaaaattggcttgctcgggtcggcagggagcgtctgagtcgaatggccatctccggcgatgactgcgtggttaagcctattgatgaccgcttcgcaagcgcgttaactgccctgaacgatatggggaaagtgagaaaggacatccagcagtgggaaccctctcggggatggaacgattggacccaggtcccattttgctcgcaccatttccacgagttggtgatgaaagacggtagggtactcgttgtgccctgtcgcaatcaagatgaactgattggcagagctcggatctcacagggggccggatggagcctaaaggagacggcatgccttggcaagtcctacgctcagatgtggacactgatgtattttcataggcgagacctccgtctggccgcaaacgccatatgtagtgcggtcccttctcactgggtgccaaccagcagaactacatggtccatccacgctaaacatgagtggatgaccactgaagatatgttggccgtgtggaatcgcgtctggattcaggagaacccgtggatggaagacaagacccccgttgagtcatgggaagaggtgccttacttaggtaaacgggaggaccaatggtgcgggagtctgatcggactcacatctagggcaacgtgggccaagaatattcagaccgctatcaaccaggtaagaagccttataggcaatgaagagtatactgattacatgccatccatgaaacgcttccggagggaagaggaagaggccggcgtgctgtggtga

SEQ ID NO: 14483 - RNA, 9876 nt, synthetic construct
  misc_feature 1..9876: note = derived and/or modified CDS sequence (opt3) from DENV-2__EU482626__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacatacagggaagcaattggattcagaaggagactcttgtgacattcaagaaccctcatgccaaaaagcaagacgttgtggtcctgggctctcaggaaggggcgatgcacacggccttgaccggagcaactgagatccagatgtcctcaggtaatctactgtttacaggccatctcaaatgccgtctgcgcatggataagcttcaactgaaagggatgagctacagtatgtgtaccggaaagttcaagatcgtgaaagaaattgctgagacacagcacggcactatcgtaattagagttcagtatgagggtgacgggtctccatgcaagatacccttcgaaatcaccgatttggagaaaaggcatgtgctcggccggctgattacggtcaacccgatcgtgaccgaaaaggactcccctgtcaacatcgaggccgaacccccatttggagatagctacattataatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtttttacatcaattgggaaggccctgcaccaggtgttcggcgctatctacggagcggcatttagtggcgtaagctggactatgaaaatacttatcggggtcattatcacctggattggaatgaactccagatctacgagcttgtcagtgagtctggttctcgtgggcgtcgtgacactgtatcttggtgccgtagtgcaggctgactccgggtgtgttgtcagctggaagaataaagaactgaagtgcggatctggcatcttcataaccgataacgtgcacacttggacagagcagtacaagtttcaacccgaatcaccaagtaaattggccagcgcaattcagaaggcccatgaggaaggtatctgtggcattaggtccgtgacccggctcgagaatctgatgtggaaacagatcactcccgagttaaaccacatactgtctgaaaatgaggtcaagctaaccatcatgacaggggacattaaaggaatcatgcaggctggcaagcgctcgctcagacctcaaccaacgcagctgaaatatagctggaagacctgggggaaggccaaaatgctttccactgaatcacataaccagacattcttgattgatggaccggagaccgcagaatgccccaatacaaacagggcgtggaatagtctggaggttgaggactacggctttggtgtgttcactaccaacatctggctcaagctgcgtgaaaaacaggacgtgttttgtgattctaagttaatgagcgctgccataaaagacaatcgggcagtacacgccgatatggggtattggattgagtccgctctgaacgacacgtggaagatggaaaaggcctcattcatcgaggtcaaaagctgccactggcctaagtctcatacactttggtccaatggagtgttggagagtgaaatgatcattccaaaaaacttcgcaggccccgttagccaacacaactaccgacctggttatcatacccagactgctggcccatggcacctcgggaagctggagatggattttgacttctgtgaaggaaccacagtggtcgtgactgaggattgcggcaatagagggccctctctaaggaccacaacggcctccggaaaactgatcaccgaatggtgctgtcgctcatgcactctcccgcctctgcggtacagaggcgaggacggttgttggtacgggatggagattaggccacttaaggaaaaggaggaaaacttggttaatagtctggtgacagcgggacatggccagatagataactttagcttaggtgtactcggcatggccctgttccttgaggaaatgctgcgcacccgaatcgggactaaacacgctattttgctcgtcgcagtgtcgtttgtgacactgatcaccggaaatatgtccttccgggacctaggccgtgtcatggttatggtgggggccacgatgactgatgacattggaatgggcgtaacctatctggctctcctggccgcatttaaggtgagacccacattcgcggccggtcttttgctgaggaaattaacctctaaggagctcatgatggctactatcgggatagccctgcttagccaatcaacaatccctgagaccattctggaactaacagatgcactcgctctgggaatgatggtcttgaaaatcgtgcgcaacatggagaagtaccagctggccgttactattatggcaatcagttgcgtgcccaatgccgtcatattacagaacgcttggaaggtgtcctgtaccattctcgcggccgtttctgtgagcccactgcttctgacgtcctcacagcaaaaagcagactggatccctttggctctcacaatcaagggcctgaatcccaccgccatttttctaactaccctgagccggacaagtaaaaagagatcttggccacttaacgaagccataatggctgtcggcatggtatccatcctcgcaagctcgctgttgaaaaatgacattccgatgactgggcctctggtggccggaggtttactcaccgtttgctatgtgctgacgggcaggtcagcggatcttgagctggaacgagctgccgacgtcaagtgggaggatcaggcagagatctctgggagttcccccattttgagcatcacaatatctgaagacggaagcatgtccatcaaaaacgaggaagaggagcagaccctcactattctgatccgcacaggcctactggtgatttcaggtgtattcccagtgagtatccccataaccgccgctgcatggtacctttgggaagtcaagaagcagcgggccggggttctctgggatgtgcctagcccaccccctgtggagaaagcggaactggaggacggagcttatagaattaagcaaaggggcatcttgggctactctcagatcggggccggagtctataaagaaggtacttttcacacaatgtggcatgtgacccgtggcgcagttttaatgcaccgcgggaagcggattgagccgtcctgggccgatgtaaaaaaggacctgatctcatacggaggcggttggaagctcgagggggaatggaaagagggagaagaggtgcaggtcctggctcttgaaccaggcaagaatcccagagccgtgcagacgaaacctggcatattcaagactaacaccgggacaattggagcagttagtctggattttagcccaggtacctccggctctcccatcgtggacaggaaagggaaggtcgtgggattgtacggcaatggtgtagtcacacgatcgggggcttatgtgagcgccattgcgcaaactgagaagtcaatcgaggataaccctgaaatagaggacgatattttccggaaaaagcgcctaaccatcatggacctgcatccgggagccggcaaaacgaagagatacctccccgcaatcgttagggaagctattaaacggggcctgcgaacacttatcttagccccaactagagtggtcgctgcagagatggaagaggccctgcgcgggctccctattaggtatcagacccccgccataaagacagagcacaccggacgtgaaatcgtggacttgatgtgtcatgctactttcaccatgcggctgctctccccagttagagtgcctaactacaatctgattatcatggatgaggcgcactttacagaccccgcaagtatcgccgctaggggttatatttctacgcgcgtcgaaatgggcgaggccgcagggatattcatgactgccaccccaccgggaagccgagatccttttccccagtccaacgctccaatcatggacgaggaaagagagattcccgaacggtcatggaattctggccacgagtgggtgacagatttcaagggtaaaaccgtatggtttgtgcctagcatcaaggcggggaacgacattgccgcatgccttaggaaaaatggaaagaaagttatccaactgagtcgcaagactttcgattccgaatacgtcaagacacgtgctaacgactgggattttgtggtgaccacggacataagcgagatgggcgccaatttcaaagcagagagagtcatcgatccacggaggtgtatgaagcccgtaattttgactgacggcgaagagcgcgtgatcctagccgggcctatgccggttacacattcttcagctgcccagcgaagaggacggattggtaggaacccaaaaaatgaaaacgaccagtatatctacatgggcgagcccctggaaaatgatgaggactgcgcgcactggaaggaggcaaaaatgctcttagataacataaatacccctgaagggattatcccctccatgtttgagccagaacgcgagaaggtggacgccattgatggagaatacagactgaggggcgaggctcggaaaaccttcgtcgaccttatgcgtcgcggtgatctgcctgtgtggctcgcctataaggttgctgcagaggggatcaactacgccgaccgaaagtggtgttttgatggcataaaaaataaccagatcttggaagagaacatggaagtggagatttggactaaggagggagaaagaaaaaagctgaaacccaggtggctcgacgctcggatctatagtgatccactggcccttaaggagttcaaggaattcgcagcgggccgcaaaagcctaacactgaatttgattaccgagatggggagattacctacatttatgactcaaaaggccaggaacgctctggacaatctcgccgtcctgcatacggcagaagctggaggtcgggcctacaaccacgcactttcggagctgccggagaccctcgaaacattgctgctactgactctccttgccaccgtgacaggcgggatcttcctgtttttaatgtctggaaaaggcataggtaagatgaccttggggatgtgctgcattatcactgcttccatcctgctctggtatgcgcagattcagccccactggatcgccgcaagcataattctggagttctttcttatcgtactgctcattccagaacctgagaaacagcgaacgccccaagataatcagttgacctacgtggttatcgctatactgacagtcgtggccgccactatggcaaacgaaatgggcttcttagagaagaccaagaaagacctaggactgggctcaatcacaacccaggagagtgaatctaatattctcgacatcgatcttagaccagcttccgcctggactctgtatgcggtggctacaacgtttgtcacccctatgttgcgccatagcattgagaactcaagtgttaatgtgagcctgactgccatcgcaaaccaggccacagtactcatggggctgggaaagggttggcccctttccaaaatggacattggcgtgccgctcctggctatcgggtgttactctcaagtcaatccaataaccttgaccgcagccctgttactactggtggcgcactacgctattatcggacctggcctccaggccaaggcaacaagggaagcccagaaacgggctgccgcaggtatcatgaagaaccccactgttgatgggattacggtgatagaccttgagccaatcccctatgatcctaagttcgaaaaacagctgggccaagtcatgttgctgattctctgcgtaacccaggtgctgatgatgcgtacaacttgggctctttgtgaggccttaaccctggcgacaggaccgatcagcaccctctgggagggcaatcccgggagattttggaacactacgattgccgtttccatggcaaatatcttcaggggatcatacttggctggcgccggtctgctattttctataatgaagaacacaaccagtactcgccgggggaccggaaatatcggcgaaacactgggtgagaaatggaagtcgcgactcaacgcacttggcaaaagcgaattccagatttataagaaatccgggatccaagaggtggacagaactctggctaaggagggaattaagaggggcgaaaccgatcatcacgccgtctctcgcgggtcagccaaattgcggtggtttgtggagagaaacatggtcacaccagaaggaaaggtggttgacctgggctgcggtcgtgggggatggagctactattgtggcggtctcaaaaatgtgagggaggtaaagggcctgacgaaagggggacctggccatgaagagcccatccctatgtccacctacgggtggaacttagtgcggcttcagagtggagtcgatgttttcttcactccacccgagaagtgcgacacactgctctgtgatataggcgaatctagccctaatccaaccattgaggcgggtcgcactctacgagtgctgaacttggtcgaaaattggctgaacaataacacacagttttgcatcaaggtgctcaatccctatatgccgtcagtaatcgagaaaatggaagctcttcagagacaatacgggggagcactggtgaggaaccctttgtcccggaatagtacccacgagatgtactgggttagcaacgccacgggcaatattgtgtcttccgtcaacatgatatcacgcatgctgatcaatagattcaccatgaagcacaaaaaggctacatatgagccagacgtggatctcggcagcgggactaggaacattggaatcgaatcggagattcccaacttagacatcataggtaaacgaatcgaaaagattaagcaggagcatgaaatctcttggcactacgaccaggatcatccttataaaacctgggcctaccacggcagttatgagacaaagcagactgggtccgcaagctcaatggtcaatggagtggttcggctgcttaccaaaccatgggacgtagtgcccatggtcacacaaatggccatgaccgatactacgccgtttggccagcagcgtgtgttcaaggagaaagttgacacaagaacccaggaacctaaggagggtactaagaaactgatgaagattaccgctgaatggctatggaaagagctcgggaagaaaaagacaccccgcatgtgtacgagggaggaatttaccaaaaaggtgcggtccaacgcggccctgggagcaatcttcactgatgagaataagtggaaatctgctagagaagccgtcgaggacggccgcttttgggaattggtggatagggagcgaaacctgcacctcgagggcaagtgcgaaacatgtgtatacaatatgatggggaaacgggagaagaaacttggagaattcggtaaggcaaagggcagcagagccatttggtatatgtggctgggggctaggtttttagagttcgaagccctgggatttttgaacgaggaccattggttcagtcgcggcaattccctcagcggtgtggagggggaaggactgcaccgtctaggctacatacttcgggatgttggcaaaaaggaggggggagcgatgtacgcagacgataccgccggttgggacactagaatcacactggaagacctcaaaaacgaggaaatggtcaccaatcatatgaagggcgagcacaaaaagctggctgaggccatttttaagttgacatatcaaaacaaagtggtgagggtccagcgcccaactcctcgagggaccgttatggatatcatctctcggagagaccagaggggatcaggccaagtgggtacgtacgggctgaataccttcacaaacatggaagcacagctcattcgccagatggagggagaaggcatattcaagagtatccagcatcttactgctaccgaggagattgccgtacaaaattggctggctagagtgggccgggaaaggttatcccgtatggccatcagcggggatgactgcgtcgtgaaacccattgatgaccgatttgcatctgcgctgacagccttgaacgatatgggaaaggttcgcaaagacatccagcagtgggagccatcgagaggttggaatgattggactcaggtgcccttctgctcacaccactttcatgaactcgtcatgaaggacggccgggtgctggtagttccttgtaggaaccaagatgagctaatagggcgcgctagaatcagccagggagccggctggtcccttaaggaaaccgcatgcctgggtaaaagttatgctcagatgtggacgctcatgtacttccaccggagggacctgcgattggccgcaaacgccatttgttctgcggtgccaagccattgggtcccgacatcccgtaccacttggtcaatccacgctaagcacgagtggatgacaaccgaggatatgttagccgtgtggaatagagtgtggattcaggaaaacccctggatggaggacaaaactcctgtcgaaagttgggaggaagttccatatctggggaagcgcgaggaccaatggtgcggatctctcatcggccttaccagccgggcaacatgggccaaaaatatacagacggctattaaccaggtgaggtccctgatcggcaatgaggaatacaccgattatatgccctcaatgaagagatttcgccgggaggaagaggaagccggggtactatggtga

SEQ ID NO: 14484 - RNA, 9876 nt, synthetic construct
  misc_feature 1..9876: note = derived and/or modified CDS sequence (opt3) from DENV-2__EU482629__SS-prME
  source 1..9876: mol_type = other RNA
accgccggcgtgatagtcatgctgattcccacagctatggcattccacctcactacgagaaatggggagcctcatatgatagttggaaggcaggaaaagggtaaaagccttctgtttaagaccgaggacggcgtgaatatgtgcaccttgatggccatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtggacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtcaaagaaattgctgagactcagcacggcaccatcgtgattagagtacagtatgagggtgacgggtctccatgcaagatacccttcgaaatcacggatttggagaaaaggcatgttctcggccggctgattaccgtgaacccgatcgtcacagaaaaggactcccctgtgaacatcgaggccgaacccccatttggagatagctacattataatcggcgtcgagcctgggcagttaaaactgaattggttcaagaagggatcgtctattggtcaaatgtttgagactaccatgcgaggcgctaaacgcatggccatcctaggggacacagcatgggatttcggatccctcggcggtgtgtttacttcaattgggaaggccctgcaccaggttttcggcgctatctacggagcggcatttagtggcgtgagctggaccatgaaaatacttatcggggtaattatcacgtggattggaatgaactccagatctactagcttgtcagtcagtctggtgctcgttggcgtggtcaccctgtatcttggtgccatggtgcaggctgactccgggtgtgtagtgagctggaagaataaagaactgaagtgcggatctggcatcttcataactgataacgttcacacatggaccgagcagtacaagtttcaacccgaatcaccaagtaaattggccagcgcaattcagaaggcccatgaggaaggtatctgtggcattaggtccgtcactcggctcgagaatctgatgtggaaacagatcacccccgagttaaaccacatactgtctgaaaatgaggtgaagctaacaatcatgacgggggacattcgcggaatcatgcaggctggcaaaagatcgctcaggcctcaaccaaccgaactgaagtatagctggaaaacttgggggaaggccaagatgctttccacagagtcacataaccagaccttcttgattgatggaccggaaacagcagagtgccccaatactaaccgtgcgtggaatagtctggaggtggaagactacggctttggtgtcttcaccacgaacatctggctcaaactgcgggagaagcaggacgtattttgtgattctaaattaatgagcgctgccataaaggacaatcgagcagtgcacgccgatatggggtattggattgaatccgctctgaacgacacatggaaaatggagaaggcctcattcatcgaggtaaagagctgccactggcctaaatctcataccctttggtccaatggagtattggaaagtgagatgatcattccaaagaacttcgcaggccccgtcagccagcacaactacagacctggttatcatactcaaaccgctggcccatggcacctcgggaaactggaaatggattttgacctatgtgagggaacaactgtggttgtgaccgaagattgcggcaatagggggccctctctgcgcacaacgaccgcctccggaaagctcatcactgagtggtgctgtcggtcatgcacactgccgcctcttagatacaggggcgaggacggttgttggtacgggatggaaattcgcccattgaaagagaaggaagagaacctggtcaatagtttagtgaccgcgggacatggccagatagataacttcagcctcggtgttctgggcatggccctttttctggaagagatgttgcgaactcggatcgggacaaagcacgctattctcctggtggcagtatcgttcgtcaccctaatcacgggaaatatgtcctttaaagacctgggccgtgtgatggtgatgatgggggccactatgaccgatgacattggaatgggcgtcacatatctcgctctgcttgccgcattcaaggttagacccacctttgcggccggtttgctgttaaggaaactcacttctaaggagctgatgatggctacaatcgggatagcccttctgagccagtcaaccatccctgaaacaattctagagctcactgatgcactggctttgggaatgatggtgctgaaaatcgtacgcaacatggaaaagtaccaattagccgtgaccattatggcaatcagttgcgtccccaatgccgtgatactccagaacgcttggaaggtttcctgtacgattctggcggccgtgtctgtcagcccacttctgttgacatcctcacagcagaaagcagactggatccctctcgctctgaccatcaagggcctaaatcccactgccattttcctgaccacacttagccggacaagtaaaaagagatcttggccactcaacgaggccataatggctgtgggcatggtttccatcctggcaagctcgttgctgaaaaatgacattccgatgaccgggcctttagtggccggaggtctcctgacggtctgctatgtacttacaggcaggtcagcggatctggaattggagcgagctgccgacgtgaagtgggaggatcaagcagaaatctctgggagttcccccattctcagcatcaccatatctgaggacggaagcatgtccatcaaaaacgaagaggaggaacagactctgacaattctaatccgcaccggcctgcttgttatttcaggtgtgtttccagtcagtatccccataactgccgctgcatggtacctctgggaggtgaagaagcagcgggccggggtactgtgggatgtgcctagcccaccccctgtcgaaaaagcggagttggaagacggagcttatagaattaagcagaggggcatcttaggctactctcaaatcggggccggagtttataaagagggtacattccacaccatgtggcatgtgacgcgtggcgcagtgctgatgcaccgcgggaagcggattgagccgtcctgggccgatgtcaaaaaggacctcatctcatacggaggcggttggaagctggaaggggagtggaaagaaggagaggaagtgcaggttcttgctctggagccaggcaagaatcccagagccgtacagactaaacctggcatatttaagaccaacacagggaccattggagcagtgagtttggatttcagcccaggtacatccggctctcccatcgtcgacaggaaagggaaggtggttggactatacggcaatggtgtggtcactcgatcgggggcttatgtgagcgccattgcgcagaccgagaagtcaatcgaagataaccctgagatagaagacgatatttttcggaaaaagcgcctgacgatcatggacctccatccgggagccggcaaaacaaagagatacctgcccgcaatcgtaagggaggctattaaacggggccttcgaactttaatcctggccccaaccagagtcgtggctgcagaaatggaggaggccctccgcgggttgcctattaggtatcaaacaaccgccataaagactgaacacaccggacgtgagatcgttgacctgatgtgtcatgctacattcacgatgcggctcctgtcccccgtgagagtcccaaactacaatcttattatcatggatgaagcgcacttcactgaccctgcaagtatcgccgctaggggttatatttctacccgcgtggagatgggcgaggccgcagggatatttatgacagccacacccccaggaagccgagatccgttccctcagtccaacgctcccatcatggacgaagagagagaaattccagagcggtcatggaactctggccacgaatgggttactgattttaagggtaaaacagtgtggttcgtccccagcatcaaggcggggaacgacattgccgcatgcctgaggaaaaatggaaagaaagtgatccagttgagtcgcaagacctttgattccgagtacgtaaagacgcgtgctaacgactgggatttcgtggttactacagacataagcgagatgggcgccaattttaaagcagaaagagtcatcgatcctcggaggtgtatgaagccagtgattctaaccgacggcgaggaacgcgtgatcctggccgggcccatgcctgtcacccattcttcagctgcccaacgaagaggacggattggtaggaacccgaaaaatgagaacgaccagtatatctacatgggcgaaccactcgagaatgatgaggactgcgcgcactggaaggaagcaaaaatgttactggataacataaatactcccgaggggattatcccttccatgttcgaacccgagcgcgaaaaggtagacgccattgatggagagtacagacttaggggcgaggctcggaaaacatttgtggacctgatgcgtcgcggtgatctcccagtttggttggcctataaggtggctgcagaagggatcaactacgccgaccgaaagtggtgtttcgatggcatcaagaataaccagatcctggaggaaaacatggaggtcgagatttggaccaaggaaggagagaggaaaaagctcaaacctagatggctggacgctcggatctatagtgatccccttgccctaaaggaatttaaggagttcgcagcgggccgcaaaagcctgacattgaatttaattactgaaatggggagactgccaacgttcatgacccagaaggccaggaacgctctcgacaatctggccgtgcttcatacagcagaggctggaggtcgggcctacaaccacgcactgtcggagctccctgaaactttggagaccctgctactgctcacacttctggccaccgttactggcgggatctttttattcttgatgtctggaaaaggcataggtaagatgacgctggggatgtgctgcattatcaccgcttccatcctcctgtggtatgcgcaaattcagccgcactggatcgccgcaagcataattcttgaatttttcctgatcgtgctcttgattcccgagccagaaaaacagcgaacacctcaggataatcaactgacttacgtcgtgatcgctatattaaccgtagtggccgccacaatggcaaacgagatgggctttctagagaagaccaagaaagacctgggactcggctcaatcactacacaggaaagtgagtctaatattcttgacatcgatctgagacccgcttccgcctggacgttgtatgcggttgctaccactttcattacaccaatgctgcgccatagcatcgaaaactcaagtgtcaatgtgagcctcaccgccattgcaaaccaggccaccgtgctgatggggcttggaaagggttggcctctctccaaaatggacatcggcgtccccctgttggctatagggtgttactctcaggttaatccgattacactgactgcagccttactactgctcgtggcgcactacgctatcatcggaccaggccttcaagccaaggcaacgagggaggcccagaaacgggctgccgcaggtattatgaagaaccctaccgtagatgggataacagtgatcgacctggaacccattccatatgatcccaagtttgagaaacagttgggccaggtcatgctgctcatcctgtgcgtgactcaagttcttatgatgcgtaccacatgggctttatgtgaggccctgaccctcgcgactggacctattagcacgttgtgggaaggcaatccggggagattctggaacacaaccatcgccgtgtccatggcaaatatatttaggggatcatacctggctggcgccggtctactgttctctatcatgaagaacactaccaatacacgccgggggactggaaacattggcgagaccctcggtgaaaaatggaagagtcgacttaacgcactgggcaaatcggagtttcagatctataagaaaagcgggattcaggaggtcgacagaacattggctaaggaaggaatcaagaggggcgagacggatcatcacgccgtatcccgcgggtctgccaaactgcggtggttcgtggaaagaaatatggttacccccgagggaaaggtggtcgacctcggctgcggtcgtgggggatggtcatactattgtggcggtctgaaaaacgtgagggaagtcaagggcttaactaaagggggaccaggccatgaggagcctatacccatgagcacatacgggtggaatcttgtgcggctgcaatccggagttgatgtgtttttcacccctccagaaaagtgcgacactctcctatgtgatattggcgagagttctcccaaccctacaatcgaagcgggtcgcaccctgcgagtattgaatctggtggagaactggctcaataacaatacgcagttctgcatcaaggtccttaacccatatatgcccagcgttattgagaaaatggaggctctgcagagaaagtacgggggagcattggtgaggaatccgctgtcacggaactccacccacgagatgtactgggtcagtaatgccacaggcaacatagtgagctctgtaaatatgatctcccgcatgctcattaacagatttactatgaaacacaagaaagctacctatgaacctgacgtggatttaggctcagggacaaggaacatcggaattgagagcgaaatcccaaatctggacataatcggtaagcgaattgagaagatcaaacaggaacatgagacttcgtggcactacgaccaagatcatccctataagacctgggcctaccacggctcttatgagacaaaacagaccgggagtgcatccagcatggttaacggagtggtccggcttctgactaagccttgggacgtggtcccaatggtgacgcagatggccatgacagataccactcccttcggccagcaacgtgtttttaaagaaaaggtagacaccagaacacaggagccgaaggaaggtacgaaaaagctaatgaaaattaccgctgagtggctctggaaggagctggggaaaaagaaaactcctcgcatgtgtacaagggaagagttcacccggaaggtgagatcaaatgcggccttgggagcaatctttactgatgaaaacaagtggaaatccgctcgcgaggccgtcgaagacggcaggttctgggagctggtggatcgagagcggaatctccaccttgaaggcaagtgcgagacatgtgtttacaacatgatggggaaaagagaaaagaaactgggagagtttggtaaggcaaagggctctagggccatttggtatatgtggttaggggctcgcttcctggaatttgaggccttgggattcctcaatgaggaccattggtttagccgtggcaacagtctgtccggtgtggaaggggagggactacaccggcttggctacatactgagagatgtcggcaaaaaggaagggggagcgatgtacgcagacgataccgccggttgggacacaaggatcactctcgaggacctgaaaaatgaagagatggtgaccaaccatatgaagggcgagcacaaaaagttggctgaagccattttcaagctgacgtatcagaataaagtagtgcgcgttcagcgacccaccccacgggggacagtcatggatatcatcagcagaagggaccaacgcggatctggccaggtgggtacttacgggctcaacacctttacaaatatggaggcacagcttattagacaaatggaaggagagggcatattcaagtcaatccagcatctgactgctaccgaggaaattgccgtgcagaactggttagctcgggtcggcagggagcgtctgagtcgaatggccatctccggggatgactgcgttgtgaaacctattgatgaccgcttcgcaagcgcgttgacggccctcaatgatatgggaaagatcagaaaagacatacagcaatgggaaccctctcggggttggaacgattggacacaggtaccattttgctcgcaccacttccatgagctggtgatgaaggacggcagggtcctagtggttccctgtcgcaaccaggatgaacttatcgggagagctcggatttcacagggagccggctggagcctgaaggagaccgcatgcctcggtaaatcctatgctcaaatgtggactctgatgtactttcacaggcgagacttgcgtttagccgcaaatgccatctgtagtgcggtgccttctcattgggtcccaacaagcagaaccacttggtccattcacgctaagcacgagtggatgaccacagaagatatgctggccgtgtggaaccgcgtatggatccaggagaatccgtggatggaagacaaaacgcccgttgagtcatgggaagaggtgccttatctcgggaagcgggaggaccagtggtgcggaagtcttataggcctgacctctagggcaacttgggccaaaaacattcagacagctatcaatcaagtcagaagcctaattggcaacgaagagtacaccgattatatgccatccatgaagcgcttccggagggaagaggaagaggccggggtgctgtggtga

SEQ ID NO: 14485 - RNA, 9876 nt, synthetic construct
  misc_feature 1..9876: note = derived and/or modified CDS sequence (opt3) from DENV-2__FJ390390__SS-prME
  source 1..9876: mol_type = other RNA
accgccggcgtgatcgtcatgctgattcccaccgctatggcattccacctcactacgcgtaacggggaacctcatatgatagttggaaggcaggaaaagggtaaaagccttctgtttaagaccgaggacggcgtgaatatgtgcacattgatggccatcgatttaggggaactgtgtgaggacactattacctacaaatgcccattactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccaaatttacatgcaagaaaaatatggaaggaaaggtggtccagcctgagaacctcgaatacaccattgttataactccacacagcggtgaggagcatgctgtgggcaatgacacggggaaacacggaaaggaaatcaaaattacaccgcagtcctcaatcaccgaggccgaactgactggctatggtaccgtaacaatggagtgtagtcccaggaccgggcttgatttcaacgaaatggtgctgttgcaaatggaggacaaggcatggctcgtccaccggcagtggtttctggatttacctctgccatggctccccggcgctgacactcagggaagcaattggatacagaaggagacacttgtgacgttcaaaaaccctcatgccaagaaacaagacgttgtggtcctgggctctcaggaaggggcgatgcacaccgccttgactggagcaacagagattcagatgtcctcaggtaatctactgtttaccggccatctcaagtgccgtctgcgcatggataaacttcaactgaaggggatgagctacagtatgtgtacaggaaagttcaaaatcgtgaaggaaatcgctgagactcagcacggcaccattgtaatcagagttcagtatgagggtgacgggtctccatgcaaaattcccttcgaaataacggatttggagaagaggcatgtgctcggccggctgatcaccgtcaacccgattgtgacagaaaaagactcccctgtcaacatcgaggccgaacccccatttggagatagctacatcattataggcgtggagcctgggcagttaaagctgaattggttcaagaaaggatcgtctatcggtcaaatgtttgagactaccatgcgaggcgctaagcgcatggccattctaggggacacagcatgggatttcggatccctcggcggtgtttttacttcaatcgggaaagccctgcaccaggtgttcggcgctatttacggagcggcatttagtggcgtaagctggaccatgaagatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaaaaataaggaactgaagtgcggatctggcattttcatcactgataacgtccacacatggaccgagcagtacaaatttcaacccgaatcaccaagtaagttggccagcgcaatacagaaagcccatgaggaaggtatttgtggcatcaggtccgtgactcggctcgagaatctgatgtggaagcagattacccccgagttaaaccacatcctgtctgaaaatgaggtgaaactaacaataatgacgggggacatccgcggaattatgcaggctggcaagagatcgctcaggcctcaaccaaccgaactgaaatatagctggaagacttgggggaaggccaaaatgctttccacagagtcacataaccagaccttcttgatcgatggaccggaaacagcagagtgccccaatactaaccgtgcgtggaatagtctggaggtcgaagactacggctttggtgttttcaccacgaacatttggctcaagctgcgggacaaacaggatgtgttttgtgactctaagttaatgagcgctgccatcaaagataatcgagcagtgcacgccgacatggggtattggatagagtccgctctgaacgatacatggaagatggaaaaggcctcattcattgaggtaaaaagctgccactggcctaagtctcataccctttggtccaatggagtcttggagagtgaaatgatcatccccaagaatttcgcaggccccgtgagccagcacaactacagacctggttatcatactcaaaccgctggcccatggcacctcgggaagctggagatggactttgatctatgtgaaggaacaactgttgtggtcaccgaggactgcggcaatagggggccctctctgcgcacaacgaccgcctccggaaaactcattactgaatggtgctgtcggtcatgcacactgccgcctcttagatacaggggcgaggatggttgttggtacgggatggagatccgcccattgaaggaaaaggaggaaaacctggtgaatagtttagttaccgcgggacatggccagattgacaacttcagcctcggtgtgctgggcatggcccttctgttggaggaaatgctccgaactcggatagggacaaaacacgctatcctgctagtagcagtctcgtttgtgaccctgattacgggaaatatgtccttccgtgatctcggcagagtgatggtcatggttggggccactatgaccgacgatatcggaatgggcgtgacatatctggctcttttggccgcatttaaggtaaggcccaccttcgcggccggtctgttactccgcaaactgacttctaaggagcttatgatggctacaattgggatcgccctgctaagccagtcaaccatacctgagacaatcctcgaactgactgacgcattggctctgggaatgatggtgttaaaaattgtccggaacatggagaagtaccaactcgccgtgaccgttatggcaatcagttgcgtgcccaatgccgtcattctgcagaacgcttggaaggtgtcctgtacgatccttgcggccgtttctgtgagcccactgttgctcacatcctcacagcagaaagcagactggatacctctggctctaaccattaagggcctgaatcccactgccatctttcttaccacactcagcagaacaagtaaaaagaggtcttggccactgaacgaagccatcatggctgtcggcatggtatccattttggcaagctcgctgctcaaaaatgatataccgatgaccgggcctctagtggccggaggtctgcttacggtttgctatgtgctgacaggccgatcagcggacttggagctcgaacgcgctgccgatgtcaagtgggaggaccaagcagagatctctgggagttcccccattctgagcatcaccatttctgaagatggaagcatgtccatcaaaaacgaggaagaggagcagactctaacaatactgatccggaccggccttctcgtgatttcaggtgtattcccagtgagtatccccattactgccgctgcatggtacctgtgggaagtcaagaagcagagagccggggttttgtgggacgtgcctagcccaccccctgtggagaaagcggaattagaggatggagcttataggatcaagcagcgtggcatactgggctactctcaaattggggccggagtctataaagaaggtacatttcacaccatgtggcatgtgacgcgcggcgcagttctcatgcaccgggggaagagaatcgagccgtcctgggccgacgtcaagaaagatctgatctcatacggaggcggttggaaacttgagggggaatggaaagagggagaagaggtgcaggtcctggctttggaaccaggcaaaaatcccagggccgtgcagactaaacctggcattttcaagaccaacacagggaccatcggagcagttagtctagactttagcccaggtacatccggctctcccatagtggatcgaaaagggaaggtcgtgggactgtacggcaatggtgtagtcactcggtcgggggcttatgtgagcgccattgcgcagaccgagaagtcaatcgaggacaaccctgaaattgaggatgacatcttccgcaaaaagagactcacgataatggacctgcatccgggagccggcaaaacaaagaggtaccttcccgcaattgttcgggaagctatcaaacgaggcttaagaactctgatcctcgccccaacccgcgtggtcgctgcagagatggaagaggccttgagggggctgcctattcgttatcaaacaaccgccatcaagactgagcacaccggacgggaaattgtggatctcatgtgtcatgctacatttacgatgagactgctttcccccgttagggtgccaaactacaatctgataatcatggacgaggcgcacttcactgatcctgcaagtattgccgctcgcggttatatctctacccgagtcgaaatgggcgaggccgcagggatcttcatgacagccacaccaccaggaagcagagacccgtttcctcagtccaacgctcccattatggatgaggaacgggagataccagaaaggtcatggaactctggccacgagtgggtgactgacttcaagggtaaaacagtatggtttgtgcccagcatcaaggcggggaacgatattgccgcatgcttgcgcaaaaatggaaagaaagttatccagctaagtcgtaagaccttcgactccgaatacgtcaagacgagagctaacgattgggactttgtggtgactacagatattagcgagatgggcgccaatttcaaagcagagcgggtcatcgaccctaggcgctgtatgaagccagtaatactgaccgacggcgaagaacgagtgatcctcgccgggcccatgcctgttacccattcttcagctgcccaaagacggggaaggattggtcgcaacccgaaaaatgaaaacgatcagtatatctacatgggcgagccattagaaaatgacgaggattgcgcgcactggaaggaggcaaaaatgctgcttgacaacattaatactcccgaagggatcataccttccatgtttgagcccgaaagagagaaggtggatgccattgacggagaatacaggctgcggggcgaggctcgtaaaacattcgtcgatctcatgcgccgaggtgacttgccagtgtggctggcctataaggttgctgcagaggggatcaactacgccgatagaaagtggtgttttgacggcattaaaaataaccagatcctcgaagagaacatggaagtggagatatggaccaaggagggagaaaggaaaaagctgaaacctcggtggcttgatgctcgcatctatagtgaccccctagccctgaaggagttcaaggaatttgcagcgggcagaaagagcttgacattaaatctgattactgagatggggaggctcccaacgttcatgacccagaaggcccggaacgctctggataatcttgccgtcctgcatacagcagaagctggaggtcgagcctacaaccacgcactctcggagttgcctgagactctggaaaccctactgctccttacactgttagccaccgtgactggcgggatcttcttgtttctgatgtctggaaaaggcattggtaagatgacgctcgggatgtgctgcatcataaccgcttccattctgctttggtatgcgcaaatccagccgcactggatcgccgcaagcattatcctggagttctttctcatagtattgctgattcccgaaccagagaaacagagaacacctcaggacaatcaattaacttacgtggttatcgctattctaaccgtcgtggccgccacaatggcaaacgaaatgggcttcctggagaagaccaagaaagacctcggacttggctcaatcactacacaggagagtgaatctaatatactggatatcgacttgcgccccgcttccgcctggacgctgtatgcggtggctaccacttttgtcacaccaatgctcaggcatagcattgagaactcaagtgttaatgtgagcctgaccgccatcgcaaaccaggccaccgtacttatggggctcggaaagggttggcctctgtccaaaatggatattggcgtgcccttgctggctatcgggtgttactctcaggtcaatccgattacattaactgcagccctactgctccttgtggcgcactacgctatcataggaccaggcctgcaagccaaggcaacgcgggaagcccagaaacgtgctgccgcaggtattatgaagaaccctaccgttgacgggatcacagtgatcgatttggagcccattccatatgaccccaagttcgaaaaacagctgggccaggtcatgctcctgatactttgcgtaactcaagtgttaatgatgagaaccacatgggctctgtgtgaggccctcaccttggcgactggacctatcagcacgctgtgggagggcaatccggggaggttttggaacacaaccattgccgtttccatggcaaatatcttccgcggatcatacctagctggcgccggtctgctcttttctattatgaagaacactaccaatacacggcgagggactggaaacatcggcgaaacccttggtgagaaatggaagagtagactgaacgcattgggcaaatcggagttccagatatataagaaaagcgggatccaggaggtggataggacactggctaaggagggaattaagcgcggcgaaacggaccatcacgccgtctcccgggggtctgccaaactcagatggtttgtggagcgtaatatggtcacccccgaaggaaaggtggttgatctgggctgcggtagagggggatggtcatactattgtggcggtcttaaaaacgtgcgggaggtaaagggcctaactaaagggggaccaggccatgaagaacctatccccatgagcacatacgggtggaatctggtgcgcctccaatccggagtcgacgttttctttacccctccagagaagtgcgatactctactgtgtgacattggcgaaagttctcccaaccctacaatcgaggcgggtcgaaccttgagagtgctgaatctcgtcgaaaactggcttaataacaatacgcagttctgcataaaggtgctgaacccatatatgcccagcgtaattgagaaaatggaggctttgcagaggaagtacgggggagcactggtgcggaatccgctctcacgcaactccacccacgagatgtactgggttagtaatgccacaggcaacatcgtgagctctgtcaatatgatctccagaatgttaattaacaggttcactatgaaacacaagaaagctacctatgagcctgatgtggacctgggctcagggacacgaaacataggaatcgaaagcgagattccaaatcttgacatcattggtaagcggatcgaaaagataaaacaggagcatgaaacttcgtggcactacgatcaagaccatccctataagacctgggcctaccacggctcttatgagacaaaacagaccgggagtgcatccagcatggtcaacggagtggttcgtctgctaactaagccttgggatgtagtgccaatggtcacgcagatggccatgacagacaccactccctttggccagcaaagagtgttcaaagagaaggttgatacccgcacacaggaaccgaaggagggtacgaaaaagctcatgaaaatcaccgctgaatggctgtggaaggagttggggaaaaagaaaactcctaggatgtgtacacgggaggaatttaccagaaaggtgcgctcaaatgcggccctgggagcaattttcactgacgagaacaagtggaaatccgctagggaagccgtcgaggatggccgattttgggaactcgtggaccgggagagaaatcttcacctggagggcaagtgcgaaacatgtgtatacaacatgatggggaaaagggagaagaaattaggagagttcggtaaggcaaagggctctcgcgccatctggtatatgtggctgggggctagatttttggagttcgaagccctcggatttctgaatgaggatcattggttcagccggggcaacagtctatccggtgtggagggggaaggacttcacagactgggctacattctcagggacgttggcaaaaaggaagggggagcgatgtacgcagatgacaccgccggttgggacacacgcatcactctggaagatttgaaaaatgaggaaatggtcaccaaccatatgaagggcgagcacaaaaagctggctgaggccatttttaagctcacgtatcagaataaagtggtgcgagtccagcggcccaccccaagagggacagttatggacataatcagcaggcgcgatcaaagaggatctggccaggtgggtacttacgggcttaacaccttcacaaatatggaagcacagctgattcggcaaatggagggagaaggcatctttaagtcaatccagcatttaactgctaccgaggagattgccgtacagaactggctggctagggtgggccgtgaacgattgagtcgcatggccatatccggggacgattgcgtcgtgaaacctatcgacgatagattcgcaagcgcgctcacggccctgaatgacatgggaaaggttcggaaagatattcagcaatgggagccctctaggggttggaacgactggacacaggtgccattctgctcgcaccactttcatgagttagtaatgaaggatggccgcgtgcttgtagttccctgtagaaaccaggacgagctgatcgggcgggctaggatttcacagggagccggctggagcctcaaggaaaccgcatgcctgggtaaatcctatgctcaaatgtggactttgatgtacttccaccgacgtgatttaagactggccgcaaatgccatctgtagtgcggtgccttctcattgggtcccaacaagccgcaccacttggtccatacacgctaagcacgagtggatgaccacagaggacatgctcgccgtgtggaaccgggtgtggatccaggaaaatccgtggatggaggacaaaacgcccgtcgaatcatgggaggaagttccttatcttgggaagagggaggatcagtggtgcggaagtctgattggcctaacctctagagcaacttgggccaaaaacatccagacagctattaatcaagtgcgcagcctgatcggcaacgaggaatacaccgactatatgccatccatgaagcggtttaggcgagaggaagaggaagccggggtactctggtga

SEQ ID NO: 14486 - RNA, 9876 nt, synthetic construct
  misc_feature 1..9876: note = derived and/or modified CDS sequence (opt3) from DENV-2__FJ390391__SS-prME
  source 1..9876: mol_type = other RNA
accgccggcgtgatagtaatgctgattccaactgctatggcattccacctcactacgagaaacggggaacctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatagaatccgctctgaacgacacatggaagatggagaaggcctcattcattgaggtcaaaagctgccactggcctaagtctcataccctttggtccaatggagtgttggaaagtgagatgatcatccccaagaatttcgcaggccccgttagccagcacaactaccgacctggttatcatactcaaaccgctggcccatggcacctcgggaagctggaaatggattttgacttctgtgagggaacaactgtggtcgtgaccgaagattgcggcaatagagggccctctctaaggacaacgaccgcctccggaaaactgattactgagtggtgctgtcgctcatgcacactcccgcctctgcggtacagaggcgaggacggttgttggtacgggatggaaatcaggccacttaaggagaaggaagagaacttggttaatagtctggtgaccgcgggacatggccagattgataactttagcttaggtgtactcggcatggccctgttccttgaagagatgctgcgcactcgaatagggacaaaacacgctatcttgctcgtcgcagtgtcgtttgtgaccctgattacgggaaatatgtccttccgggacctaggccgtgtcatggttatggtgggggccactatgaccgatgacatcggaatgggcgtaacatatctggctctcctggccgcatttaaggtgagacccaccttcgcggccggtcttttgctgaggaaattaacttctaaggagctcatgatggctacaattgggatcgccctgcttagccagtcaaccatacctgaaacaatctttgagctgactgatgcactagctctcggaatgatggtcctgaaaattgtgcgcaacatggaaaagtaccaattggccgttaccatcatggcaattagttgcgtgcccaatgccgtcatcctgcagaacgcttggaaggtgtcctgtacgatattagcggccgtttctgtgagcccactcctgcttacatcctcacagcagaaagcagactggattcctctggctttgaccatcaagggcctcaatcccactgccatcttcctgaccacactaagccggacaagtaaaaagagatcttggccactgaacgaggccattatggctgtcggcatggtatccatacttgcaagctcgctcctgaaaaatgacatcccgatgaccgggcctttggtggccggaggtctgttaacggtttgctatgtgctcacaggcaggtcagcggatctggaacttgagcgagctgccgacgtcaagtgggaggatcaagcagaaatttctgggagttcccccatcctgagcattaccatctctgaggacggaagcatgtccatcaaaaacgaagaggaggaacagactttgacaatcctcattcgcaccggcctgctagtgatctcaggtgtatttccagtgagtattcccatcactgccgctgcatggtacctgtgggaggtcaagaagcagcgggccggggttctttgggatgtgcctagcccaccccctgtggaaaaagcggagctcgaagacggagcttatagaataaagcagaggggcattctgggctactctcaaatcggggccggagtctataaagagggtacattccacaccatgtggcatgtgacgcgtggcgcagttttgatgcaccgcgggaagcggatcgagccgtcctgggccgatgtcaaaaaggacttaatttcatacggaggcggttggaagctggaaggggagtggaaagaaggagaggaagtgcaggtcctcgctctggagccaggcaagaatcccagagccgtgcagactaaacctggcatctttaagaccaacacagggaccataggagcagttagtcttgatttcagcccaggtacatccggctctcccattgtggacaggaaagggaaggtcgtgggactgtacggcaatggtgtagtcactcgatcgggggcttatgtgagcgccatcgcgcagaccgagaagtcaattgaagataaccctgagatcgaagacgatatattccggaaaaagcgcttgacgattatggacctacatccgggagccggcaaaacaaagagatacctgcccgcaatcgttagggaggctatcaaacggggcctccgaactctgattcttgccccaaccagagtggtcgctgcagaaatggaggaggccttacgcgggctgcctatcaggtatcaaacacccgccattaagaccgaacacactggacgtgagatagtggacctcatgtgtcatgctacctttacaatgcggttgctgtccccagttagagtgcctaactacaatctcatcattatggatgaagcgcacttcacggaccccgcaagtatcgccgctaggggttatatctctactcgcgtcgagatgggcgaggccgcagggatttttatgaccgccacaccaccgggaagccgagatcctttcccccagtccaacgctccaataatggacgaagagagagaaatccccgagcggtcatggaactctggccacgaatgggtgaccgattttaagggtaaaactgtatggttcgtgcctagcattaaggcggggaacgacatcgccgcatgcctgaggaaaaatggaaagaaagttattcagcttagtcgcaagacatttgattccgagtacgtcaagacccgtgctaacgactgggatttcgtggtgacgactgacatcagcgagatgggcgccaattttaaagcagaaagagtcatagatccacggaggtgtatgaagcccgtaatcctgacagacggcgaggaacgcgtgattttggccgggcctatgccggttacccattcttcagctgcccaacgaagaggacggatcggtaggaaccccaaaaatgagaacgaccagtatatttacatgggcgaacccctagagaatgatgaggactgcgcgcactggaaggaagcaaaaatgctgctcgataacatcaatacccctgaggggataattccctccatgttcgaaccagagcgcgaaaaggtggacgccatcgatggagagtacagattaaggggcgaggctcggaaaacttttgtcgacctgatgcgtcgcggtgatcttcctgtgtggctggcctataaggttgctgcagaagggattaactacgccgaccgaaagtggtgtttcgatggcatcaaaaataaccagatactcgaggaaaacatggaggtggagatctggacaaaggaaggagagaggaaaaagttgaaacccagatggctggacgctcggatttatagtgatccactcgccctgaaggagttcaaggagtttgcagcgggccgcaaaagccttaccctaaatctgatcacagaaatggggagattgcctactttcatgacgcagaaggccaggaacgctttagacaatctggccgtcctccataccgcagaggctggaggtcgggcctacaaccacgcactgtcggagcttccggaaacactggagactctcttgctgctaaccctgctcgccacagtgaccggcgggatttttcttttcctgatgtctggaaaaggcatcggtaagatgactttagggatgtgctgcataattacggcttccatcttgctgtggtatgcgcaaatccagccccactggattgccgcaagcatcatactcgaatttttcctgattgtacttctgatcccagagcctgaaaaacagcgaaccccacaggataatcaactcacatacgtggttattgctatcttgactgtcgtggccgccaccatggcaaacgagatgggctttctggagaagacaaagaaagacttaggactaggctcaataaccactcaggaaagtgagtctaatatcctggacattgatctcagaccagcttccgcctggacactttatgcggtggctacgaccttcgtcactcctatgctgcgccatagcatcgaaaactcaagtgttaatgtgagcttgacagccattgcaaaccaggccaccgtactgatggggctcggaaagggttggcccctgtccaaaatggacatcggcgtgccgcttctcgctattgggtgttactctcaggtcaatccaatcaccctgacagcagccttgctgctattagtggcgcactacgctataattggacctggcctgcaagccaaggcaactagggaggcccagaaacgggctgccgcaggtatcatgaagaaccccacggttgatgggatcaccgtgattgacctcgaaccaataccctatgatcctaagtttgagaaacagcttggccaggtcatgctgttgatcctgtgcgtaacacaagtgctcatgatgcgtactacctgggctctgtgtgaggcccttacattagcgaccggaccgattagcactctgtgggaaggcaatcccgggagattctggaacacgacaatcgccgtttccatggcaaatatttttaggggatcatacctcgctggcgccggtttgctgttctctatcatgaagaacaccacaagtacccgccgggggacaggaaatataggcgagactctaggtgaaaaatggaagtcgcgactgaacgcactcggcaaaagcgagtttcagatctataagaaatccgggattcaggaggtggacagaacccttgctaaggaaggaatcaagaggggcgagacagatcatcacgccgtctctcgcgggtcagccaaactgcggtggttcgtggaaagaaacatggtcacgccagagggaaaggtggttgacttgggctgcggtcgtgggggatggagctactattgtggcggtctgaaaaatgtgagggaagtaaagggcctcaccaaagggggacctggccatgaggagcccattcctatgtccacttacgggtggaacctggtgcggttacaaagtggagtcgatgttttctttacaccacccgaaaagtgcgacacccttctgtgtgatatcggcgagtctagccctaatccaactatagaagcgggtcgcacactccgagtgctaaacctggtcgagaattggttgaacaataacacccagttctgcattaaggtgctgaatccctatatgccgtcagtaatcgagaaaatggaggctctccagagacagtacgggggagcacttgtgaggaaccctctgtcccggaatagtacgcacgagatgtactgggttagcaacgccaccggcaatatcgtgtcttccgtcaacatgatttcacgcatgttgataaatagatttacaatgaagcacaaaaaggctacttatgaaccagacgtggatctgggcagcgggaccaggaacatcggaattgagaacgaaatccccaatctcgacattatcggtaaacgaatagagaagatcaagcaagaacatgagatttcgtggcactacgaccaggatcatccttataaaacatgggcctaccacggctcttatgagactaagcagaccgggagtgcatccagcatggtcaacggagtggttcggttactgacaaaaccatgggacgtagtgcccatggtcacccagatggccatgactgatacgacaccgttcggccaacagcgtgtgtttaaggaaaaagttgacaccagaactcaggagcctaaggaaggtaccaagaaacttatgaagatcacagctgagtggctgtggaaagagctagggaagaaaaagacgccccgcatgtgtaccagggaagagttcactaaaaaggtgcggtcaaatgcggccctcggagcaatttttacagatgaaaacaagtggaaatccgctagagaggccgtcgaagacggccgcttctgggagctggtggatagggagcgaaatttgcacctggaaggcaagtgcgagacctgtgtatacaacatgatggggaaacgggaaaagaaactcggagagtttggtaaggcaaagggctctagagccatctggtatatgtggcttggggctaggttcctggaatttgaggccttaggattcctgaatgaggaccattggtttagccgcggcaacagtttgtccggtgtggaaggggagggactccaccgtctgggctacattctacgggatgttggcaaaaaggaagggggagcgatgtacgcagacgatactgccggttgggacacaagaataacccttgaggacctgaaaaatgaagagatggtcacaaaccatatgaagggcgagcacaaaaagctcgctgaagccatcttcaagctgacttatcagaataaagtggtgagggtccaacgcccaacccctcgagggacggttatggatattatcagccggagagaccagaggggatctggccaggtgggtacctacgggttgaacacattcactaatatggaggcacaactgatccgccagatggaaggagagggcatttttaagtcaatacagcatctcaccgctacagaggaaatcgccgtacagaactggcttgctagagtgggccgggagaggctgagtcgtatggccatttccggggatgactgcgtcgtgaaacccatcgatgaccgattcgcaagcgcgttaactgccctgaatgatatgggaaaggttcgcaaagacattcaacagtgggaaccatctagaggttggaacgattggacccaggtgcccttttgctcgcaccacttccatgagttggtcatgaaggacggccgggtgctcgtagttccttgtaggaaccaggatgaactgatcgggcgcgctagaatatcacaaggagccggctggagcctaaaggagacggcatgccttggtaaatcctatgctcagatgtggacactgatgtactttcaccggagggacctccgactggccgcaaatgccatctgtagtgcggtgccatctcattgggtcccgaccagccgtactacatggtccattcacgctaagcacgagtggatgaccactgaagatatgttggccgtgtggaacagagtgtggatccaggagaatccctggatggaagacaaaacccctgtcgagtcatgggaagaggttccatatttagggaagcgcgaggaccagtggtgcggaagtctgattggcctcacatctcgggcaacgtgggccaaaaacatccaaaccgctataaatcaggtgaggagccttattggcaacgaagagtacactgattatatgccctccatgaagagattccgccgggaagaggaagaggccggggtactgtggtga

SEQ ID NO: 14487 - RNA, 9876 nt, synthetic construct
  misc_feature 1..9876: note = derived and/or modified CDS sequence (opt3) from DENV-2__FJ882593__SS-prME
  source 1..9876: mol_type = other RNA
accgccggcgtgatagtaatgctgattccaactgctatggctttccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcaggagagcaattggatacagaaggaaacacttgtgacgttcaagaaccctcatgccaaaaagcaagacgttgtggtcctgggatctcaggagggcgcgatgcacaccgccttgactggggcaacagaaattcagatgtcctcaggaaatctactgtttaccggtcatctcaaatgccgtctgcgcatggataaacttcaactgaaaggcatgagctacagtatgtgtacagggaagttcaagatcgtgaaagagatcgctgagactcagcacggaaccattgtaatcagagttcagtatgaaggcgacggttctccatgcaagattcccttcgagataacggatttggagaagaggcatgtgctcgggcggctgatcaccgtcaacccgattgtgacagagaaggactcccctgtcaacatcgaagccgagcccccatttggcgatagctacatcattataggagtggagcctggccagttaaaactgaattggttcaagaaggggtcgtctatcggacaaatgtttgaaactaccatgcgaggtgctaaacgcatggccattctaggcgacacagcatgggatttcgggtccctcggaggcgtttttacttcaatcggtaaggccctgcaccaggtgttcggggctatttacggcgcggcatttagtggagtaagctggaccatgaaaatccttataggcgtcatcattacgtggatcgggatgaactccagatctactagcttgtcagtgagtctggttctcgtgggagtcgtgaccctgtatcttggcgccgtagtgcaggctgactccggttgtgttgtcagctggaagaataaagagctgaagtgcgggtctggaattttcatcactgataacgtgcacacatggaccgaacagtacaagtttcaacccgagtcaccaagtaaattggccagcgcaatacagaaggcccatgaagagggcatttgtggtatcaggtccgtgactcggctcgagaatctgatgtggaaacagattacccccgaattaaaccacatcctgtctgagaatgaagtcaagctaacaataatgacgggcgacatcaaagggattatgcaggctggaaagcgctcgctcagacctcaaccaaccgagctgaaatatagctggaagacttggggcaaggccaaaatgctttccacagaatcacataaccagaccttcttgatcgatgggccggagacagcagagtgccccaatactaacagggcgtggaatagtctggaagttgaggactacggatttggcgtgttcaccacgaacatttggctcaagctgcgtgaaaaacaggacgtgttttgtgattctaagttaatgagcgctgccatcaaagacaatcgggcagtacacgccgatatgggttattggatagagtccgctctgaacgacacatggaagatggagaaggcctcattcattgaagtcaaaagctgccactggcctaagtctcataccctttggtccaatggggtgttggagagtgaaatgatcatccccaaaaatttcgcaggacccgttagccagcacaactaccgacctggctatcatactcaaaccgctggtccatggcacctcggcaagctggagatggattttgacttctgtgaagggacaactgtggtcgtgaccgaggattgcggaaatagaggcccctctctaaggacaacgaccgcctccgggaaactgattactgagtggtgctgtcgctcatgcacactcccgcctctgcggtacagaggagaagacggctgttggtacggtatggagatcaggccacttaaggaaaaggaggaaaacttggttaatagtctggtgaccgcggggcatggacagattgataactttagcttaggcgtactcggtatggccctgttccttgaggagatgctgcgcactcgaataggcacaaaacacgctatcttgctcgtcgcagtgtcgtttgtgaccctgattacggggaatatgtccttccgggacctaggacgtgtcatggttatggtgggcgccactatgaccgatgacatcgggatgggagtaacatatctggctctcctggccgcatttaaggtgagacccaccttcgcggccggccttttgctgaggaaattaacttctaaggaactcatgatggctacaattggtatcgccctgcttagccagtcaaccatacctgagacaatcctggaactaactgatgcactcgctctggggatgatggtcttgaaaattgtgcgcaacatggagaagtaccaactggccgttaccatcatggcaattagttgcgtgcccaatgccgtcatcttacagaacgcttggaaggtgtcctgtacgatactcgcggccgtttctgtgagcccactgcttctgacatcctcacagcagaaagcagactggattcctttggctctcaccatcaagggactgaatcccactgccatctttctaaccacactgagccggacaagtaaaaagagatcttggccacttaacgaagccattatggctgtcggcatggtatccatactcgcaagctcgctgttgaaaaatgacatcccgatgaccggccctctggtggccgggggattactcacggtttgctatgtgctgacaggtaggtcagcggatcttgagctggagcgagctgccgacgtcaagtgggaagatcaagcagagatttctggcagttcccccatcttgagcattaccatctctgaagacgggagcatgtccatcaaaaacgaggaggaagaacagactctcacaatcctgattcgcaccggactactggtgatctcaggcgtattcccagtgagtattcccatcactgccgctgcatggtacctttgggaagtcaagaagcagcgggccggtgttctctgggatgtgcctagcccaccccctgtggagaaagcggaactggaggacggggcttatagaataaagcagaggggaattttgggctactctcaaatcggcgccggggtctataaagagggaacatttcacaccatgtggcatgtgacgcgtggtgcagttttaatgcaccgcggcaagcggatcgaaccgtcctgggccgatgtcaaaaaggacctgatttcatacgggggaggctggaagctcgagggtgaatggaaagagggggaagaggtgcaggtcctggctcttgagccaggaaagaatcccagagccgtgcagactaaacctggcatcttcaagaccaacacaggcaccataggggcagttagtctggattttagcccaggaacatccggttctcccattgtggacaggaaaggcaaggtcgtggggttgtacggaaatggcgtagtcactcgatcgggtgcttatgtgagcgccatcgcgcagaccgaaaagtcaattgaggataaccctgaaatcgaggacgatatattccggaaaaagcgcctaacgattatggacctgcatccgggggccggaaaaacaaagagatacctccccgcaatcgttagggaagctatcaaacggggcctgcgaactcttattttagccccaaccagagtggtcgctgcagagatggaggaagccctgcgcggcctccctatcaggtatcaaacacccgccattaagaccgagcacactgggcgtgaaatagtggacttgatgtgtcatgctaccttcacaatgcggctgctctccccagttagagtgcctaactacaatctgatcattatggatgaggcgcactttacggaccccgcaagtatcgccgctaggggatatatctctactcgcgtcgagatgggtgaagccgcaggcattttcatgaccgccacaccaccggggagccgagatccttttccccagtccaacgctccaataatggacgaggaaagagagatccccgaacggtcatggaactctggacacgagtgggtgaccgatttcaagggcaaaactgtatggtttgtgcctagcattaaggcgggtaacgacatcgccgcatgccttaggaaaaatgggaagaaagttattcagctgagtcgcaagacattcgattccgagtacgtcaagacccgtgctaacgactgggattttgtggtgacgactgacatcagcgaaatgggagccaatttcaaagcagagagagtcatagatccacggaggtgtatgaagcccgtaatcttgacagacggcgaagaacgcgtgattctagccggccctatgccggttacccattcttcagctgcccaacgaagagggcggatcggaaggaaccccaaaaatgaaaacgaccagtatatttacatgggtgagcccctggagaatgatgaagactgcgcgcactggaaggaggcaaaaatgctcttagataacatcaatacccctgaaggcataattccctccatgtttgagccagaacgcgagaaggtggacgccatcgatggggagtacagactgaggggagaagctcggaaaactttcgtcgaccttatgcgtcgcggcgatctgcctgtgtggctcgcctataaggttgctgcagagggtattaactacgccgaccgaaagtggtgttttgatgggatcaaaaataaccagatattggaagagaacatggaggtggaaatctggacaaaggagggcgaaaggaaaaagctgaaacccagatggctcgacgctcggatttatagtgatccactggcccttaaggagttcaaggagttcgcagcgggacgcaaaagcctaaccctgaatttgatcacagagatgggcagattacctacttttatgacgcagaaggccaggaacgctctggacaatctcgccgtcctgcataccgcagaggctgggggacgggcctacaaccacgcactttcggaactgccggagacactcgaaactttgctgctactgaccctccttgccacagtgaccggtggcattttcctgtttttaatgtctgggaaaggaatcggcaagatgactttgggtatgtgctgcataattacggcttccatcctgctctggtatgcgcaaatccagccccactggattgccgcaagcatcatactggagttctttcttattgtactgctcatcccagaacctgagaaacagcgaaccccacaggataatcaattgacatacgtggttattgctatcctgactgtcgtggccgccaccatggcaaacgagatggggttcttagaaaagacaaagaaagacctaggcctgggatcaataaccactcaggagagtgaatctaatatcctcgacattgatcttagaccagcttccgcctggacactgtatgcggtggctacgacctttgtcactcctatgttgcgccatagcatcgagaactcaagtgttaatgtgagcctgacagccattgcaaaccaggccaccgtactcatgggcctggggaagggatggcccctttccaaaatggacatcggtgtgccgctcctggctattggctgttactctcaggtcaatccaatcaccttgacagcagccctgttactactggtggcgcactacgctataattgggcctggactccaagccaaggcaactagggaagcccagaaacgggctgccgcaggcatcatgaagaaccccacggttgatggtatcaccgtgattgaccttgagccaataccctatgatcctaagttcgagaaacagctggggcaggtcatgttgctgatcctctgcgtaacacaagtgctgatgatgcgtactacctgggctctttgtgaagccttaacactggcgaccggcccgattagcactctctgggagggaaatcccggcagattttggaacacgacaatcgccgtttccatggcaaatattttcagggggtcatacttggctggagccggcctgctattttctatcatgaagaacaccacaagtacccgccggggtacagggaatataggagaaactctgggcgagaaatggaagtcgcgactcaacgcacttggtaaaagcgagttccagatctataagaaatccggcattcaggaagtggacagaaccctggctaaggaggggatcaagaggggagaaacagatcatcacgccgtctctcgcggctcagccaaattgcggtggtttgtggagagaaacatggtcacgccagaagggaaggtggttgacctgggatgcggccgtggtgggtggagctactattgtggaggcctcaaaaatgtgagggaggtaaagggtctgaccaaaggcgggcctggacatgaggaacccattcctatgtccacttacggctggaacttagtgcggcttcaaagtggggtcgatgttttcttcacaccacccgagaagtgcgacaccctgctctgtgatatcggagaatctagccctaatccaactatagaggcgggccgcacactacgagtgctgaacttggtcgaaaattggctgaacaataacacccagttttgcattaaggtgctcaatccctatatgccgtcagtaatcgagaaaatggaggcacttcagagacagtacggtggggcactggtgaggaaccctttgtcccggaatagtacgcacgaaatgtactgggttagcaacgccaccggaaatatcgtgtcttccgtcaacatgatttcacgcatgctgataaatagattcacaatgaagcacaaaaaggctacttatgagccagacgtggatctcggcagcggcaccaggaacatcgggattgaatcggagatccccaacttagacattatcggaaaacgaatagaaaagatcaagcaagagcatgagatttcttggcactacgaccaggatcatccttataaaacatgggcctaccacggtagttatgaaactaagcagaccggctccgcaagctcaatggtcaatggggtggttcggctgcttacaaaaccatgggacgtagtgcccatggtcacccagatggccatgactgatacgacaccgtttggacaacagcgtgtgttcaaggagaaagttgacaccagaactcaggaacctaaggagggcaccaagaaactgatgaagatcacagctgagtggctatggaaagaactcggtaagaaaaagacgccccgcatgtgtaccagggaggaatttactaaaaaggtgcggtccaacgcggccctgggggcaattttcacagatgagaataagtggaaatctgctagagaagccgtcgaggacggacgcttttgggagttggtggatagggaacgaaacctgcacctcgagggcaagtgcgaaacctgtgtatacaatatgatgggcaaacgggagaagaaacttggggagttcggaaaggcaaagggtagcagagccatctggtatatgtggctgggcgctaggtttttagagttcgaggccctggggtttttgaacgaagaccattggttcagtcgcggaaattccctcagcggcgtggagggtgaagggctgcaccgtctaggatacattcttcgggatgttggcaaaaaggagggcggggcgatgtacgcagacgatactgccggatgggacacaagaataaccctggaagacctcaaaaacgaggagatggtcacaaatcatatgaagggtgaacacaaaaagctggctgaggccatctttaagttgacttatcagaacaaagtggtgagggtccaacgcccaacccctcgaggcacggttatggatattatctctcggagagaccagagggggtcaggacaggtgggcacctacggtctgaatacattcactaacatggaagcacaactcatccgccagatggagggggagggaattttcaagagtatacagcatcttaccgctacagaagagatcgccgtacagaattggctggctagagtgggccgggaaaggttatcccgtatggccattagcggcgatgactgcgtcgtgaaacccatcgatgaccgatttgcatctgcgctgactgccttgaacgatatggggaaggttcgcaaagacattcaacagtgggagccatcgagaggatggaatgattggacccaggtgcccttctgctcacaccactttcatgaactcgtcatgaaggacggtcgggtgctggtagttccttgtaggaaccaggatgagctaatcggccgcgctagaataagccaaggggccggatggtcccttaaggagacggcatgcctgggcaaaagttatgctcagatgtggacactcatgtacttccaccggagggacctgcgattggccgcaaacgccatctgttctgcggtgccaagccattgggtcccgacctcccgtactacatggtcaattcacgctaagcacgaatggatgaccactgaggatatgttagccgtgtggaatagagtgtggatccaggaaaacccctggatggaggacaaaacccctgtcgaaagttgggaggaggttccatatctgggtaagcgcgaagaccagtggtgcgggtctctcattggacttacaagccgggcaacgtgggccaaaaatatccaaaccgctataaaccaggtgaggtccctgattggcaatgaggaatacactgattatatgccctcaatgaagagatttcgccgggaggaagaggaggccggcgtactatggtga

SEQ ID NO: 14488 - RNA, 9876 nt, synthetic construct
  misc_feature 1..9876: note = derived and/or modified CDS sequence (opt3) from DENV-2__FJ182014__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccattcctacggcaaaacgaaccggaggatatcgactgttggtgcaattccacatctacctgggtaacttatggaacatgtaccacgactggcgagcaccgccgagaaaagcgttcagtggcgctcgtcccccatgtgggtatggggctggagaccagaacagaaacttggatgagtagcgagggagcttggaaacacgttcagaggattgagacctggatccttcggcatcctggctttacaataatggccgcaatcctggcctacaccattggcacgactcacttccagcgcgctttgatctttattctcctgacagcagtggccccatccatgaccatgagatgcatcgggatatctaacagggatttcgtcgaaggagtgtcgggtggctcatgggtagacattgttctggagcacgggagctgtgtgactacaatggctaagaataagcccaccctcgattttgaattaatcaaaacggaggccaagcagcctgcgaccctgcggaaatattgcattgaagcaaagcttacaaacactaccacagagagtcgctgtccaactcaaggagagccctccttgaatgaagagcaggacaaacgattcatctgcaagcattctatggtcgatagaggctggggtaacgggtgtggactgtttggcaagggcgggatcgtgacctgcgccatgttcacatgcaaaaagaatatggaaggaaaagtggtccagcctgagaacctagaatacaccattgttataactccacacagcggtgaggagcatgctgtgggcaatgacacggggaagcacggaaaagaaatcaagattacaccgcagtcctcaatcaccgaggccgaactcactggctatggtaccgtaacaatggagtgtagtcccaggaccgggctggattttaacgaaatggtgcttctgcaaatggaggacaaagcatggttggtccaccggcagtggttcctcgatctgcctttaccatggctgcccggcgctgacactcagggaagcaattggatacagaaggagacactcgtgacgtttaagaaccctcatgccaaaaagcaagacgttgtggtccttggctctcaggaaggggcgatgcacaccgccctgactggagcaacagagattcagatgtcctcaggtaatttgctattcaccggccatctgaaatgccgtctccgcatggataagctgcaacttaaagggatgagctacagtatgtgtacaggaaagttcaagatcgtgaaagaaatcgctgagactcagcacggcaccattgtaatcagagttcagtatgagggtgacgggtctccatgcaagattccctttgaaataacggatctggagaaaaggcatgtgttgggccggctcatcaccgtcaacccgattgtgacagaaaaggactcccctgtcaacatcgaggccgaacccccattcggagatagctacatcattataggcgtggagcctgggcagctgaaattaaattggtttaagaagggatcgtctatcggtcaaatgttcgagactaccatgcgaggcgctaaacgcatggccattctgggggacacagcatgggattttggatccctaggcggtgttttcacttcaatcgggaaggccctccaccaggtgtttggcgctatttacggagcggcattcagtggcgtaagctggaccatgaaaatcctgataggggtcatcattacgtggatcggaatgaactccagatctacaagcctttcagtgagtttggttctggtgggcgtcgtgaccctctatctgggtgccgtagtgcaggctgactccgggtgtgttgtcagctggaagaataaagaacttaagtgcggatctggcatttttatcactgataacgtgcacacatggaccgagcagtacaagttccaacccgaatcaccaagtaaactggccagcgcaatacagaaggcccatgaggaaggtatttgtggcatcaggtccgtgactcggttggagaatctcatgtggaaacagattacccccgagctgaaccacatcttatctgaaaatgaggtcaagctgacaataatgacgggggacatcaaaggaattatgcaggctggcaagcgctcgctaagacctcaaccaaccgaactcaaatatagctggaagacttgggggaaggccaaaatgctgtccacagagtcacataaccagacctttcttatcgatggaccggaaacagcagagtgccccaatactaacagggcgtggaatagtttggaggttgaagactacggcttcggtgtgtttaccacgaacatttggctgaagctccgtgagaaacaggacgtgttctgtgattctaagctgatgagcgctgccatcaaagacaatcgggcagtacacgccgatatggggtattggatagaatccgctttaaacgacacatggaagatggagaaggcctcattcattgaggtcaaaagctgccactggcctaagtctcataccctgtggtccaatggagtgcttgaaagtgagatgatcatcccaaaaaactttgcaggccccgttagccagcacaactaccgacctggttatcatactcaaaccgctggcccatggcacttggggaagctcgaaatggatttcgacttttgtgagggaacaactgtggtcgtgaccgaagattgcggcaatagagggccctctctgaggacaacgaccgcctccggaaaactaattactgagtggtgctgtcgctcatgcacactgccgcctctccggtacagaggcgaggacggttgttggtacgggatggaaatcaggccactgaaggagaaggaagagaaccttgttaatagtttggtgaccgcgggacatggccagattgataacttcagcctgggtgtattaggcatggccctctttctggaagagatgcttcgcactcgaatagggacaaaacacgctatcctgttggtcgcagtgtcgttcgtgaccctcattacgggaaatatgtcctttcgggacctgggccgtgtcatggttatggtgggggccactatgaccgatgacatcggaatgggcgtaacatatctagctctgctcgccgcattcaaggtgagacccacctttgcggccggtctgcttttgaggaaactgacttctaaggagttaatgatggctacaattgggatcgccctcctgagccagtcaaccatacctgaaacaatccttgagctgactgatgcactagctctcggaatgatggtcctgaaaattgtgcgcaacatggaaaagtaccaattggccgttaccatcatggcaattagttgcgtgcccaatgccgtcatcctgcagaacgcttggaaggtgtcctgtacgatattagcggccgtttctgtgagcccactcctgcttacatcctcacagcagaaagcagactggattcctctggctttgaccatcaagggcctcaatcccactgccatcttcctgaccacactaagccggactagtaaaaagagatcttggccactgaacgaggccattatggctgtcggcatggtatccatacttgcaagctcgctcctgaaaaatgacatcccgatgaccgggcctttggtggccggaggtctgttaacggtttgctatgtgctcacaggcaggtcagcggatctggaacttgagcgagctgccgacgtcaagtgggaggatcaagcagaaatttctgggagttcccccatcctgagcattatcatatctgaggacggaagcatgtccatcaaaaacgaagaggaggaacagaccttgactattctcatccgcacaggcctgctagtgatttcaggtgtatttccagtgagtatccccataaccgccgctgcatggtacctgtgggaggtcaagaagcagcgggccggggttctttgggatgtgcctagcccaccccctgtggaaaaagcggagctcgaagacggagcttatagaattaagcagaggggcatcctgggctactctcaaatcggggccggagtctataaagagggtactttccacacaatgtggcatgtgacccgtggcgcagttttgatgcaccgcgggaagcggattgagccgtcctgggccgatgtaaaaaaggacttaatctcatacggaggcggttggaagctggaaggggagtggaaagaaggagaggaagtgcaggtcctcgctctggagccaggcaagaatcccagagccgtgcagacgaaacctggcatatttaagactaacaccgggacaattggagcagttagtcttgatttcagcccaggtacctccggctctcccatcgtggacaggaaagggaaggtcgtgggactgtacggcaatggtgtagtcacacgatcgggggcttatgtgagcgccattgcgcagactgagaagtcaatcgaagataaccctgagatagaagacgatattttccggaaaaagcgcttgaccatcatggacctacatccgggagccggcaaaacgaagagatacctgcccgcaatcgttagggaggctattaaacggggcctccgaacactgatccttgccccaactagagtggtcgctgcagaaatggaggaggccttacgcgggctgcctattaggtatcaaacccccgccataaagacagaacacaccggacgtgagatcgtggacctcatgtgtcatgctacttttaccatgcggttgctgtccccagttagagtgcctaactacaatctcattatcatggatgaagcgcacttcacagaccccgcaagtatcgccgctaggggttatatttctacgcgcgtcgagatgggcgaggccgcagggatatttatgactgccaccccaccgggaagccgagatcctttcccccagtccaacgctccaatcatggacgaagagagagaaattcccgagcggtcatggaattctggccacgaatgggtgacagattttaagggtaaaaccgtatggttcgtgcctagcatcaaggcggggaacgacattgccgcatgcctgaggaaaaatggaaagaaagttatccagcttagtcgcaagacttttgattccgagtacgtcaagacacgtgctaacgactgggatttcgtggtgaccacggacataagcgagatgggcgccaattttaaagcagaaagagtcatcgatccacggaggtgtatgaagcccgtaattctgactgacggcgaggaacgcgtgatcttggccgggcctatgccggttacacattcttcagctgcccaacgaagaggacggattggtaggaacccaaaaaatgagaacgaccagtatatctacatgggcgaacccctagagaatgatgaggactgcgcgcactggaaggaagcaaaaatgctgctcgataacataaatacccctgaggggattatcccctccatgttcgaaccagagcgcgaaaaggtggacgccattgatggagagtacagattaaggggcgaggctcggaaaacctttgtcgacctgatgcgtcgcggtgatcttcctgtgtggctggcctataaggttgctgcagaagggatcaactacgccgaccgaaagtggtgtttcgatggcataaaaaataaccagatcctcgaggaaaacatggaggtggagatttggactaaggaaggagagagaaaaaagttgaaacccaggtggctggacgctcggatctatagtgatccactcgccctgaaggaattcaaggagtttgcagcgggccgcaaaagccttacactaaatctgattaccgaaatggggagattgcctacattcatgactcagaaggccaggaacgctttagacaatctggccgtcctccatacggcagaggctggaggtcgggcctacaaccacgcactgtcggagcttccggaaaccctggagacactcttgctgctaactctgctcgccaccgtgacaggcgggatctttcttttcctgatgtctggaaaaggcataggtaagatgaccttagggatgtgctgcattatcactgcttccatcttgctgtggtatgcgcaaattcagccccactggatcgccgcaagcataattctcgaatttttcctgatcgtacttctgattccagagcctgaaaaacagcgaacgccccaggataatcaactcacctacgtggttatcgctatattgacagtcgtggccgccactatggcaaacgagatgggctttctggagaagaccaagaaagacttaggactaggctcaatcacaacccaggaaagtgagtctaatattctggacatcgatctcagaccagcttccgcctggactctttatgcggtggctacaacgttcgtcacccctatgctgcgccatagcattgaaaactcaagtgttaatgtgagcttgactgccatcgcaaaccaggccacagtactgatggggctcggaaagggttggcccctgtccaaaatggacattggcgtgccgcttctcgctatcgggtgttactctcaggtcaatccaataaccctgaccgcagccttgctgttactagtggcgcactacgctattatcggacctggcctgcaagccaaggcaacaagggaggcccagaaacgggctgccgcaggtatcatgaagaaccccactgttgatgggattacggtgatagacctcgaaccaatcccctatgatcctaagtttgagaaacagcttggccaggtcatgctgttgattctgtgcgtaacccaagtgctcatgatgcgtacaacttgggctctgtgtgaggcccttaccttagcgacaggaccgatcagcaccctgtgggaaggcaatcccgggagattctggaacactacgattgccgtttccatggcaaatatctttaggggatcatacctcgctggcgccggtttgctgttctctataatgaagaacacaaccagtactcgccgggggaccggaaatatcggcgagacactaggtgaaaaatggaagtcgcgactgaacgcactcggcaaaagcgagtttcagatttataagaaatccgggatccaggaggtggacagaactcttgctaaggaaggaattaagaggggcgagaccgatcatcacgccgtctctcgcgggtcagccaaactgcggtggttcgtggaaagaaacatggtcacaccagagggaaaggtggttgacttgggctgcggtcgtgggggatggagctactattgtggcggtctgaaaaatgtgagggaagtaaagggcctcacgaaagggggacctggccatgaggagcccatccctatgtccacctacgggtggaacctggtgcggttacaaagtggagtcgatgttttctttactccacccgaaaagtgcgacacacttctgtgtgatataggcgagtctagccctaatccaaccattgaagcgggtcgcactctccgagtgctaaacctggtcgagaattggttgaacaataacacacagttctgcatcaaggtgctgaatccctatatgccgtcagtaatcgaaaaaatggaggctctccagagacagtacgggggagcacttgtgaggaaccctctgtcccggaatagtacccacgagatgtactgggttagcaacgccacgggcaatattgtgtcttccgtcaacatgatatcacgcatgttgatcaatagatttaccatgaagcacaaaaaggctacatatgaaccagacgtggatctgggcagcgggactaggaacattggaatcgagtcggaaattcccaacctcgacatcataggtaaacgaatcgagaagattaagcaagaacatgagatctcttggcactacgaccaggatcatccttataaaacctgggcctaccacggcagttatgagacaaagcagactgggtccgcaagctcaatggtcaatggagtggttcggttactgaccaaaccatgggacgtagtgcccatggtcacacagatggccatgaccgatactacgccgttcggccaacagcgtgtgtttaaggaaaaagttgacacaagaacccaggagcctaaggaaggtactaagaaacttatgaagattaccgctgagtggctgtggaaagagctagggaagaaaaagacaccccgcatgtgtacgagggaagagttcaccaaaaaggtgcggtccaacgcggccctcggagcaatctttactgatgaaaataagtggaaatctgctagagaggccgtcgaagacggccgcttctgggagctggtggatagggagcgaaacttgcacctggaaggcaagtgcgagacatgtgtatacaatatgatggggaaacgggaaaagaaactcggagagtttggtaaggcaaagggcagcagagccatttggtatatgtggcttggggctaggttcctggaatttgaggccttaggattcctgaacgaggaccattggtttagtcgcggcaattccttgagcggtgtggaaggggagggactccaccgtctgggctacatactacgggatgttggcaaaaaggaagggggagcgatgtacgcagacgataccgccggttgggacactagaatcacacttgaggacctgaaaaacgaagagatggtcaccaatcatatgaagggcgagcacaaaaagctcgctgaagccattttcaagctgacatatcagaacaaagtggtgagggtccaacgcccaactcctcgagggaccgttatggatatcatctctcggagagaccagaggggatcaggccaggtgggtacgtacgggttgaataccttcacaaacatggaggcacaactgattcgccagatggaaggagagggcatatttaagagtatccagcatctcactgctaccgaggaaattgccgtacagaattggcttgctagagtgggccgggagaggctgtcccgtatggccatcagcggggatgactgcgtcgtgaaacccattgatgaccgattcgcatctgcgttaacagccctgaacgatatgggaaaggttcgcaaagacatccaacagtgggaaccatcgagaggttggaatgattggactcaggtgcccttttgctcacaccacttccatgagttggtcatgaaggacggccgggtgctcgtagttccttgtaggaaccaggatgaactgatagggcgcgctagaatcagccaaggagccggctggtccctaaaggagaccgcatgccttggtaaaagttatgctcagatgtggacgctgatgtactttcaccggagggacctccgactggccgcaaacgccatttgttctgcggtgccaagccattgggtcccgacatcccgtaccacttggtcaatccacgctaagcacgagtggatgacaaccgaagatatgttggccgtgtggaatagagtgtggattcaggagaacccctggatggaagacaaaactcctgtcgagagttgggaagaggttccatatttagggaagcgcgaggaccagtggtgcggatctctgatcggcctcaccagccgggcaacatgggccaaaaatatacaaacggctattaaccaggtgaggtcccttatcggcaatgaagagtacaccgattatatgccctcaatgaagagattccgccgggaagaggaagaggccggggtactgtggtga

SEQ ID NO: 14489 - RNA, 9876 nt, synthetic construct
  misc_feature 1..9876: note = derived and/or modified CDS sequence (opt3) from DENV-2__FJ547090__SS-prME
  source 1..9876: mol_type = other RNA
accgcaggcgtgatagtaatgctgattcccacggctatggctttccacctcactacgagaaacggggaacctcatatgatagttggaaggcaggaaaagggtaaaagccttctgtttaagaccgaagacggcgtgaatatgtgcacattgatggccatcgatttaggggaactgtgtgaagacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctaccagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctacaatcaaagacaatcgggccgtacacgcagatatggggtattggatagaatccgccctgaacgacacctggaagatggagaaggcttcattcattgaggtcaaaagctgccactggcctaagtctcatactctttggtccaatggagtgttggaaagtgagatgatcatccccaagaatttcgccggccccgttagccagcacaactaccgactcggttatcatacccaaacagcaggcccttggcacctggggaagctagaaatggattttgacttctgtgagggaactaccgtggtcgtgacagaagattgcggcaatagagggccatctctgaggacgaccactgcttccggaaaactcattacagagtggtgctgtcgctcatgcaccctgcccccgcttcggtacagaggcgaggacggttgttggtacgggatggaaatcaggcctttgaaggagaaggaagagaacctggttaatagtttagtgactgccggacatggccagattgataactttagcctcggtgtactgggcatggcgcttttcctggaagagatgttgcgcacacgaatagggaccaaacacgccatcctcctggtcgctgtgtcgtttgtgacgctaattactggaaatatgtccttccgggacctgggccgtgtcatggttatggtgggggcaaccatgacagatgacatcggaatgggcgtaacctatctcgccctgcttgctgcctttaaggtgagaccaactttcgcagcgggtttgctgttaaggaaactcacatctaaggagctgatgatggccaccattgggatcgcacttctgagccagtcaacaatacccgaaactatcctagagctcaccgatgccctggcattgggaatgatggtcctgaaaattgtgcgcaacatggaaaagtaccaattagctgttacgatcatggccattagttgcgtgcctaatgcagtcatcctccagaacgcctggaaggtgtcctgtacaatactggctgcggtttctgtgagcccccttctgttgacctcctcacagcagaaagccgactggattccactcgcactgactatcaagggcctaaatcctaccgctatctttctgacaactcttagccggaccagtaaaaagagatcttggcccctcaacgaggccattatggccgtcggcatggtatccatactggctagctcgttgctgaaaaatgacatcccaatgacggggccgttagtggcaggaggtctcctgacagtttgctatgtgcttaccggcaggtcagccgatctggaattggagcgagcggctgacgtcaagtgggaggatcaagccgaaatttctgggagttcccctatcctcagcattactatctctgaggacggaagcatgtccatcaaaaacgaagaggaggaacagacactgaccatcctaattcgcactggcctgcttgtgatctcaggtgtattccccgtgagtattccaatcacagcagccgcttggtacctctgggaggtcaagaagcagcgggcaggggttctgtgggatgtgcccagccctccacccgtggaaaaagccgagttggaagacggagcgtatagaataaagcagaggggcattttaggctactctcaaatcggggctggagtctataaagagggtacctttcacacgatgtggcatgtgactcgtggcgccgttctgatgcaccgcgggaagcggatcgagccttcctgggcagatgtcaaaaaggacctcatttcatacggaggcggttggaagctggaaggggagtggaaagaaggagaggaagtgcaggtccttgccctggagccgggcaagaatccaagagctgtgcagaccaaacccggcatcttcaagacaaacaccgggacaataggagccgttagtttggattttagccctggtacttccggctctccaattgtggacaggaaagggaaggtcgtgggactatacggcaatggtgtagtcacccgatcgggggcatatgtgagcgctatcgcccagacggagaagtcaattgaagataaccccgagatcgaagacgatatattccggaaaaagcgcctgacaattatggacctccatcctggagcgggcaaaactaagagatacctgccggccatcgttagggaggcaatcaaacggggccttcgaaccttaattctggctcccacaagagtggtcgccgctgaaatggaggaggcactccgcgggttgccaatcaggtatcaaacccctgccattaagactgaacacaccggacgtgagatagtggacctgatgtgtcatgccacattcacgatgcggctcctgtcccccgttagagtgccaaactacaatcttatcattatggatgaagctcactttactgaccctgcgagtatcgcagccaggggttatatctctacccgcgtcgagatgggcgaggctgccgggattttcatgacagcaacaccaccaggaagccgagatccgtttcctcagtccaacgcccccataatggacgaagagagagaaatcccagagcggtcatggaactctggccacgaatgggtgactgatttcaagggtaaaacagtatggtttgtgcccagcattaaggctgggaacgacatcgcggcctgcctgaggaaaaatggaaagaaagttattcagttgagtcgcaagaccttcgattccgagtacgtcaagacgcgtgcaaacgactgggattttgtggtgactacagacatcagcgagatgggcgctaatttcaaagccgaaagagtcatagatcctcggaggtgtatgaagccagtaatcctaaccgacggcgaggaacgcgtgattctggcagggcccatgcctgttacccattcttcagccgctcaacgaagaggacggatcggtaggaacccgaaaaatgagaacgaccagtatatttacatgggcgaaccactcgagaatgatgaggactgcgcccactggaaggaagcgaaaatgttactggataacatcaatactcccgaggggataattccttccatgtttgaacccgagcgcgaaaaggtggacgcaatcgatggagagtacagacttaggggcgaggcccggaaaacattcgtcgacctgatgcgtcgcggtgatctcccagtgtggttggcttataaggttgccgctgaagggattaactacgcagaccgaaagtggtgttttgatggcatcaaaaataaccagatactggaggaaaacatggaggtggagatctggaccaaggaaggagagaggaaaaagctcaaacctagatggctggacgcccggatttatagtgatccccttgctctaaaggagttcaaggagttcgccgcaggccgcaaaagcctgacattgaatttaatcactgaaatggggagactgccaacgtttatgacccagaaggcgaggaacgccctcgacaatctggctgtccttcatacagccgaggcaggaggtcgggcttacaaccacgccctgtcggagctccctgaaactttggagaccctgctactgctcacacttctggcaaccgtgactggcgggattttcttatttttgatgtctggaaaaggcatcggtaagatgacgctggggatgtgctgcataattaccgcctccatcctcctgtggtatgctcaaatccagccgcactggattgcggccagcatcatacttgagttctttctgattgtactcttgatccccgagccagaaaaacagcgaacacctcaggataatcaactgacttacgtggttattgcaatcttaaccgtcgtggctgccacaatggccaacgagatgggcttcctagagaagaccaagaaagacctgggactcggctcaataactacacaggaaagtgagtctaatatccttgacattgatctgagacccgcatccgcttggacgttgtatgccgtggcgaccacttttgtcacaccaatgctgcgccatagcatcgaaaactcaagtgttaatgtgagcctcaccgctattgccaaccaggcaaccgtactgatggggcttggaaagggttggcctctctccaaaatggacatcggcgtgcccctgttggccattgggtgttactctcaggtcaatccgatcacactgactgctgcattactactgctcgtggcccactacgcgataattggaccaggccttcaagctaaggccacgagggaggcacagaaacgggccgctgccggtatcatgaagaaccctaccgttgatgggatcacagtgattgacctggaacccataccatatgatcccaagttcgagaaacagttgggccaggtcatgctgctcatcctgtgcgtaactcaagtgcttatgatgcgtaccacatgggcattatgtgaggctctgaccctcgccactggacctattagcacgttgtgggaaggcaatccggggagattttggaacacaaccatcgcggtttccatggccaatattttcaggggatcatacctggcaggcgctggtctactgttttctatcatgaagaacactaccagtacacgccgggggactggaaatataggcgagaccctcggtgaaaaatggaagtcgcgacttaacgccctgggcaaaagcgagttccagatctataagaaatccgggattcaggaggtggacagaacattggcaaaggaaggaatcaagaggggcgagacggatcatcacgctgtctctcgcgggtcagccaaactgcggtggtttgtggaaagaaacatggtcacccccgagggaaaggtggttgacctcggctgcggtcgtgggggatggagctactattgtggcggtctgaaaaatgtgagggaagtaaagggcttaactaaagggggaccaggccatgaggagcctattcccatgtccacatacgggtggaaccttgtgcggctgcaaagtggagtcgatgttttcttcacccctccagaaaagtgcgacactctcctatgtgatatcggcgagtctagccccaatcctacaatagaagccggtcgcaccctgcgagtgttgaacctggtcgagaattggctcaacaataacacgcagttttgcattaaggtgcttaatccatatatgccctcagtaatcgagaaaatggaggcgctgcagagacagtacgggggagctttggtgaggaacccgctgtcccggaatagtacccacgagatgtactgggttagcaacgcaacaggcaatatcgtgtcttccgtcaacatgatttcacgcatgctcataaatagattcactatgaagcacaaaaaggccacctatgaacctgacgtggatttaggcagcgggacaaggaacatcggaattgagtcggaaatcccaaacctggacattatcggtaaacgaatagagaagatcaagcaagaacatgagatttcttggcactacgaccaggatcatccctataaaacttgggcttaccacggcagttatgagaccaagcagacagggtccgccagctcaatggtcaatggagtggttcggcttctgaccaaaccttgggacgtagtgccaatggtcactcagatggcaatgacggatacaaccccctttggccaacagcgtgtgttcaaggaaaaagttgacactagaacccaggagccgaaggaaggtacaaagaaactaatgaagatcacggccgagtggctctggaaagagctggggaagaaaaagacccctcgcatgtgtactagggaagagtttaccaaaaaggtgcggtccaacgctgcgttgggagccattttcaccgatgaaaataagtggaaatctgcaagagaggctgtcgaagacggccgcttttgggagctggtggatagggagcgaaacctccaccttgaaggcaagtgcgagacttgtgtatacaatatgatggggaaacgggaaaagaaactgggagagttcggtaaggccaagggcagcagagcaatctggtatatgtggttaggggccaggtttctggagttcgaggctttgggatttctcaacgaggaccattggttcagtcgcggcaattccctgagcggtgtggaaggggagggactacaccgtcttggctacattctgcgggatgttggcaaaaaggaagggggagccatgtacgcggacgatacagcaggttgggacaccagaataacactcgaggacctgaaaaacgaagagatggtcactaatcatatgaagggcgagcacaaaaagttggccgaagctatctttaagctgacctatcagaacaaagtggtgagggtccaacgccccacgccacgagggaccgttatggatattatctctcggagagaccagaggggatcaggccaggtgggtacatacgggctcaatactttcaccaacatggaggcccaacttatccgccagatggaaggagagggcattttcaagagtatacagcatctgacagcaactgaggaaatcgctgtacagaattggttagccagagtgggccgggagaggctgtcccgtatggctattagcggggatgactgcgtcgtgaaacctatcgatgaccgatttgcctctgcattgaccgcgctcaacgatatgggaaaggttcgcaaagacattcaacagtgggaaccctcgagaggttggaatgattggacacaggtgccattctgctcacaccactttcatgagctggtcatgaaggacggccgggtgctagtagttccctgtaggaaccaggatgaacttatcgggcgcgccagaataagccaaggagctggctggtccctgaaggagacagcctgcctcggtaaaagttatgcacagatgtggaccctgatgtacttccaccggagggacttgcgattagctgccaacgcaatctgttctgccgtgcctagccattgggtcccaacttcccgtacaacctggtcaattcacgcgaagcacgagtggatgactaccgaagatatgctggctgtgtggaatagagtgtggatccaggagaacccgtggatggaagacaaaacacccgtcgagagttgggaagaggttccttatctcgggaagcgcgaggaccagtggtgcggatctcttattggcctgacgagccgggccacctgggccaaaaatatccaaactgccataaaccaggtgaggtccctaattggcaatgaagagtacacagattatatgccatcaatgaagagatttcgccgggaagaggaagaggctggggtactgtggtga

SEQ ID NO: 14490 - RNA, 9876 nt, synthetic construct
  misc_feature 1..9876: note = derived and/or modified CDS sequence (opt3) from DENV-2__EU482630__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccattcctacggcaaaacgaaccggaggatatcgactgttggtgcaattccacatctacctgggtaacttatggaacatgtaccacgactggcgagcaccgccgagaaaagcgttcagtggcgctcgtcccccatgtgggtatggggctggagaccagaacagaaacttggatgagtagcgagggagcttggaaacacgttcagaggattgagacctggatccttcggcatcctggctttacaataatggccgcaatcctggcctacaccattggcacgactcacttccagcgcgctttgatctttattctcctgacagcagtggccccatccatgaccatgagatgcatcgggatatctaacagggatttcgtcgaaggagtgtcgggtggctcatgggtagacattgttctggagcacgggagctgtgtgactacaatggctaagaataagcccaccctcgattttgaattaatcaaaacggaggccaagcagcctgcgaccctgcggaaatattgcattgaagcaaagcttacaaacactaccacagagagtcgctgtccaactcaaggagagccctccttgaatgaagagcaggacaaacgattcatctgcaagcattctatggtcgatagaggctggggtaacgggtgtggactgtttggcaagggcgggatcgtgacctgcgccatgttcacatgcaaaaagaatatggaaggaaaagtggtccagcctgagaacctagaatacaccattgttataactccacacagcggtgaggagcatgctgtgggcaatgacacggggaagcacggaaaagaaatcaagattacaccgcagtcctcaatcaccgaggccgaactcactggctatggtaccgtaacaatggagtgtagtcccaggaccgggctggattttaacgaaatggtgcttctgcaaatggaggacaaagcatggttggtccaccggcagtggttcctcgatctgcctttaccatggctgcccggcgctgacactcagggaagcaattggatacagaaggagacactcgtgacgtttaagaaccctcatgccaaaaagcaagacgttgtggtccttggctctcaggaaggggcgatgcacaccgccctgactggagcaacagagattcagatgtcctcaggtaatttgctattcaccggccatctgaaatgccgtctccgcatggataagctgcaacttaaagggatgagctacagtatgtgtacaggaaagttcaagatcgtgaaagaaatcgctgagactcagcacggcaccattgtaatcagagttcagtatgagggtgacgggtctccatgcaagattccctttgaaataacggatctggagaaaaggcatgtgttgggccggctcatcaccgtcaacccgattgtgacagaaaaggactcccctgtcaacatcgaggccgaacccccattcggagatagctacatcattataggcgtggagcctgggcagctgaaattaaattggtttaagaagggatcgtctatcggtcaaatgttcgagactaccatgcgaggcgctaaacgcatggccattctgggggacacagcatgggattttggatccctaggcggtgttttcacttcaatcgggaaggccctccaccaggtgtttggcgctatttacggagcggcattcagtggcgtaagctggaccatgaaaatcctgataggggtcatcattacgtggatcggaatgaactccagatctacaagcctttcagtgagtttggttctggtgggcgtcgtgaccctctatctgggtgccgtagtgcaggctgactccgggtgtgttgtcagctggaagaataaagaacttaagtgcggatctggcatttttatcactgataacgtgcacacatggaccgagcagtacaagttccaacccgaatcaccaagtaaactggccagcgcaatacagaaggcccatgaggaaggtatttgtggcatcaggtccgtgactcggttggagaatctcatgtggaaacagattacccccgagctgaaccacatcttatctgaaaatgaggtcaagctgacaataatgacgggggacatcaaaggaattatgcaggctggcaagcgctcgctaagacctcaaccaaccgaactcaaatatagctggaagacttgggggaaggccaaaatgctgtccacagagtcacataaccagacctttcttatcgatggaccggaaacagcagagtgccccaatactaacagggcgtggaatagtttggaggttgaagactacggcttcggtgtgtttaccacgaacatttggctgaagctccgtgagaaacaggacgtgttctgtgattctaagctgatgagcgctgccatcaaagacaatcgggcagtacacgccgatatggggtattggatagaatccgctttaaacgacacatggaagatggagaaggcctcattcattgaggtcaaaagctgccactggcctaagtctcataccctgtggtccaatggagtgcttgaaagtgagatgatcatcccaaaaaactttgcaggccccgttagccagcacaactaccgacctggttatcatactcaaaccgctggcccatggcacttggggaagctcgaaatggatttcgacttttgtgagggaacaactgtggtcgtgaccgaagattgcggcaatagagggccctctctgaggacaacgaccgcctccggaaaactaattactgagtggtgctgtcgctcatgcacactgccgcctctccggtacagaggcgaggacggttgttggtacgggatggaaatcaggccactgaaggagaaggaagagaaccttgttaatagtttggtgaccgcgggacatggccagattgataacttcagcctgggtgtattaggcatggccctctttctggaagagatgcttcgcactcgaatagggacaaaacacgctatcctgttggtcgcagtgtcgttcgtgaccctcattacgggaaatatgtcctttcgggacctgggccgtgtcatggttatggtgggggccactatgaccgatgacatcggaatgggcgtaacatatctagctctgctcgccgcattcaaggtgagacccacctttgcggccggtctgcttttgaggaaactgacttctaaggagttaatgatggctacaattgggatcgccctcctgagccagtcaaccatacctgaaacaatccttgagctgactgatgcactagctctcggaatgatggtcctgaaaattgtgcgcaacatggaaaagtaccaattggccgttaccatcatggcaattagttgcgtgcccaatgccgtcatcctgcagaacgcttggaaggtgtcctgtacgatattagcggccgtttctgtgagcccactcctgcttacatcctcacagcagaaagcagactggattcctctggctttgaccatcaagggcctcaatcccactgccatcttcctgaccacactaagccggactagtaaaaagagatcttggccactgaacgaggccattatggctgtcggcatggtatccatacttgcaagctcgctcctgaaaaatgacatcccgatgaccgggcctttggtggccggaggtctgttaacggtttgctatgtgctcacaggcaggtcagcggatctggaacttgagcgagctgccgacgtcaagtgggaggatcaagcagaaatttctgggagttcccccatcctgagcattaccatctctgaggacggaagcatgtccataaaaaacgaagaggaggaacagactttgacaatcctcattcgcaccggcctgctagtgatctcaggtgtatttccagtgagtattcccatcactgccgctgcatggtacctgtgggaggtcaagaagcagcgggccggggttctttgggatgtgcctagcccaccccctgtggaaaaagcggagctcgaagacggagcttatagaataaagcagaggggcattctgggctactctcaaatcggggccggagtctataaagagggtacattccacaccatgtggcatgtgacgcgtggcgcagttttgatgcaccgcgggaagcggatcgagccgtcctgggccgatgtaaaaaaggacttaatttcatacggaggcggttggaagctggaaggggagtggaaagaaggagaggaagtgcaggtcctcgctctggagccaggcaagaatcccagagccgtgcagactaaacctggcatctttaagaccaacacagggaccataggagcagttagtcttgatttcagcccaggtacatccggctctcccattgtggacaggaaagggaaggtcgtgggactgtacggcaatggtgtagtcactcgatcgggggcttatgtgagcgccatcgcgcagaccgagaagtcaattgaagataaccctgagatcgaagacgatatattccggaaaaagcgcttgacgattatggacctacatccgggagccggcaaaacaaagagatacctgcccgcaatcgttagggaggctatcaaacggggcctccgaactctgattcttgccccaaccagagtggtcgctgcagaaatggaggaggccttacgcgggctgcctatcaggtatcaaacacccgccattaagaccgaacacactggacgtgagatagtggacctcatgtgtcatgctacctttacaatgcggttgctgtccccagttagagtgcctaactacaatctcatcattatggatgaagcgcacttcacggaccccgcaagtatcgccgctaggggttatatctctactcgcgtcgagatgggcgaggccgcagggatttttatgaccgccacaccaccgggaagccgagatcctttcccccagtccaacgctccaataatggacgaagagagagaaatccccgagcggtcatggaattctggccacgaatgggtgaccgattttaagggtaaaactgtatggttcgtgcctagcattaaggcggggaacgacatcgccgcatgcctgaggaaaaatggaaagaaagttattcagcttagtcgcaagacatttgattccgagtacgtcaagacccgtgctaacgactgggatttcgtggtgacgactgacatcagcgagatgggcgccaattttaaagcagaaagagtcatagatccacggaggtgtatgaagcccgtaatcctgacagacggcgaggaacgcgtgattttggccgggcctatgccggttacccattcttcagctgcccaacgaagaggacggatcggtaggaacccaaaaaatgagaacgaccagtatatttacatgggcgaacccctagagaatgatgaggactgcgcgcactggaaggaagcaaaaatgctgctcgataacatcaatacccctgaggggataattccctccatgttcgaaccagagcgcgaaaaggtggacgccatcgatggagagtacagattaaggggcgaggctcggaaaacttttgtcgacctgatgcgtcgcggtgatcttcctgtgtggctggcctataaggttgctgcagaagggattaactacgccgaccgaaagtggtgtttcgatggcatcaaaaataaccagatactcgaggaaaacatggaggtggagatctggacaaaggaaggagagagaaaaaagttgaaacccaggtggctggacgctcggatttatagtgatccactcgccctgaaggaattcaaggagtttgcagcgggccgcaaaagccttaccctaaatctgatcacagaaatggggagattgcctactttcatgacgcagaaggccaggaacgctttagacaatctggccgtcctccataccgcagaggctggaggtcgggcctacaaccacgcactgtcggagcttccggaaacactggagactctcttgctgctaaccctgctcgccacagtgaccggcgggatttttcttttcctgatgtctggaaaaggcatcggtaagatgactttagggatgtgctgcataattacggcttccatcttgctgtggtatgcgcaaatccagccccactggattgccgcaagcatcatactcgaatttttcctgattgtacttctgatcccagagcctgaaaaacagcgaaccccccaggataatcaactcacatacgtggttattgctatcttgactgtcgtggccgccaccatggcaaacgagatgggctttctggagaagacaaagaaagacttaggactaggctcaataaccactcaggaaagtgagtctaatatcctggacattgatctcagaccagcttccgcctggacactttatgcggtggctacgaccttcgtcactcctatgctgcgccatagcatcgaaaactcaagtgttaatgtgagcttgacagccattgcaaaccaggccaccgtactgatggggctcggaaagggttggcccctgtccaaaatggacatcggcgtgccgcttctcgctattgggtgttactctcaggtcaatccaatcaccctgacagcagccttgctgttactagtggcgcactacgctataattggacctggcctgcaagccaaggcaactagggaggcccagaaacgggctgccgcaggtatcatgaagaaccccacggttgatgggatcaccgtgattgacctcgaaccaataccctatgatcctaagtttgagaaacagcttggccaggtcatgctgttgatcctgtgcgtaacacaagtgctcatgatgcgtactacctgggctctgtgtgaggcccttacattagcgaccggaccgattagcactctgtgggaaggcaatcccgggagattctggaacacgacaatcgccgtttccatggcaaatatttttaggggatcatacctcgctggcgccggtttgctgttctctatcatgaagaacaccactagtacccgccgggggacaggaaatataggcgagactctaggtgaaaaatggaagtcgcgactgaacgcactcggcaaaagcgagtttcagatctataagaaatccgggattcaggaggtggacagaacccttgctaaggaaggaatcaagaggggcgagacagatcatcacgccgtctctcgcgggtcagccaaactgcggtggttcgtggaaagaaacatggtcacgccagagggaaaggtggttgacttgggctgcggtcgtgggggatggagctactattgtggcggtctgaaaaatgtgagggaagtaaagggcctcaccaaagggggacctggccatgaggagcccattcctatgtccacttacgggtggaacctggtgcggttacaaagtggagtcgatgttttctttacaccacccgaaaagtgcgacacccttctgtgtgatatcggcgagtctagccctaatccaactatagaagcgggtcgcacactccgagtgctaaacctggtcgagaattggttgaacaataacacccagttctgcattaaggtgctgaatccctatatgccgtcagtaatcgaaaaaatggaggctctccagagacagtacgggggagcacttgtgaggaaccctctgtcccggaatagtacgcacgagatgtactgggttagcaacgccaccggcaatatcgtgtcttccgtcaacatgatttcacgcatgttgataaatagatttacaatgaagcacaaaaaggctacttatgaaccagacgtggatctgggcagcgggaccaggaacatcggaattgagtcggaaatccccaacctcgacattatcggtaaacgaatagagaagatcaagcaagaacatgagatttcttggcactacgaccaggatcatccttataaaacatgggcctaccacggcagttatgagactaagcagaccgggtccgcaagctcaatggtcaatggagtggttcggttactgacaaaaccatgggacgtagtgcccatggtcacccagatggccatgactgatacgacaccgttcggccaacagcgtgtgtttaaggaaaaagttgacaccagaactcaggagcctaaggaaggtaccaagaaacttatgaagatcacagctgagtggctgtggaaagagctagggaagaaaaagacgccccgcatgtgtaccagggaagagttcactaaaaaggtgcggtccaacgcggccctcggagcaatttttacagatgaaaataagtggaaatctgctagagaggccgtcgaagacggccgcttctgggagctggtggatagggagcgaaacttgcacctggaaggcaagtgcgagacctgtgtatacaatatgatggggaaacgggaaaagaaactcggagagtttggtaaggcaaagggcagcagagccatctggtatatgtggcttggggctaggttcctggaatttgaggccttaggattcctgaacgaggaccattggtttagtcgcggcaattccttgagcggtgtggaaggggagggactccaccgtctgggctacattctacgggatgttggcaaaaaggaagggggagcgatgtacgcagacgatactgccggttgggacacaagaataacccttgaggacctgaaaaacgaagagatggtcacaaatcatatgaagggcgagcacaaaaagctcgctgaagccatcttcaagctgacttatcagaacaaagtggtgagggtccaacgcccaacccctcgagggacggttatggatattatctctcggagagaccagaggggatcaggccaggtgggtacctacgggttgaatacattcactaacatggaggcacaactgatccgccagatggaaggagagggcatttttaagagtatacagcatctcaccgctacagaggaaatcgccgtacagaattggcttgctagagtgggccgggagaggctgtcccgtatggccattagcggggatgactgcgtcgtgaaacccatcgatgaccgattcgcatctgcgttaactgccctgaacgatatgggaaaggttcgcaaagacattcaacagtgggaaccatcgagaggttggaatgattggacccaggtgcccttttgctcacaccacttccatgagttggtcatgaaggacggccgggtgctcgtagttccttgtaggaaccaggatgaactgatcgggcgcgctagaataagccaaggagccggctggtccctaaaggagacggcatgccttggtaaaagttatgctcagatgtggacactgatgtactttcaccggagggacctccgactggccgcaaacgccatctgttctgcggtgccaagccattgggtcccgacctcccgtactacatggtcaattcacgctaagcacgagtggatgaccactgaagatatgttggccgtgtggaatagagtgtggatccaggagaacccctggatggaagacaaaacccctgtcgagagttgggaagaggttccatatttagggaagcgcgaggaccagtggtgcggatctctgattggcctcacaagccgggcaacgtgggccaaaaatatccaaaccgctataaaccaggtgaggtcccttattggcaatgaagagtacactgattatatgccctcaatgaagagattccgccgggaagaggaagaggccggggtactgtggtga

SEQ ID NO: 14491 - RNA, 9876 nt, synthetic construct
  misc_feature 1..9876: note = derived and/or modified CDS sequence (opt3) from DENV-2__FJ882594__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctacaagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatccgcggaattatgcaggctggcaaaagatcgctcaggcctcaaccaaccgaactgaagtatagctggaaaacttgggggaaggccaagatgctttccacagagtcacataaccagaccttcttgatcgatggaccggaaacagcagagtgccccaatactaaccgtgcgtggaatagtctggaggtcgaagactacggctttggtgttttcaccacgaacatttggctcaaactgcgggagaagcaggacgtgttttgtgattctaaattaatgagcgctgccatcaaggacaatcgagcagtgcacgccgatatggggtattggatagaatccgctctgaacgacacatggaaaatggagaaggcctcattcattgaggtaaagagctgccactggcctaaatctcataccctttggtccaatggagtcttggaaagtgagatgatcatcccaaagaacttcgcaggccccgtgagccagcacaactacagacctggttatcatactcaaaccgctggcccatggcacctcgggaaactggaaatggattttgacctatgtgagggaacaactgttgtggtcaccgaagattgcggcaatagggggccctctctgcgcacaacgaccgcctccggaaagctcattactgagtggtgctgtcggtcatgcacactgccgcctcttagatacaggggcgaggacggttgttggtacgggatggaaatccgcccattgaaagagaaggaagagaacctggtgaatagtttagttaccgcgggacatggccagattgataacttcagcctcggtgtgctgggcatggccctttttctggaagagatgttgcgaactcggatagggacaaagcacgctatcctcctggtagcagtctcgttcgtgaccctaattacgggaaatatgtcctttcgtgacctgggcagagtgatggtcatggttggggccactatgaccgatgacatcggaatgggcgtgacatatctcgctctgcttgccgcattcaaagtaaggcccacctttgcggccggtttgctgttacgcaagctcacttctaaagagctgatgatggctacaattgggatcgcccttctgagccagtcaaccatacctgaaaacatcctagagctcacagatgcactggctttgggaatgatggtgctgaagattgtccggaatatggaaaaataccaattagccgtgactatcatggcaattagttgcgttcccaacgccgtgatcctccagaatgcttggaaggtctcctgtaccatactggcggccgtgtctgttagcccacttctgttgacgtcctcacagcagaaggcagactggattcctctcgctctgacaatcaaaggcctaaaccccaccgccatcttcctgactacccttagcagaacaagtaagaaaaggtcttggccactcaatgaggccattatggctgtgggcatggtctccatactggcaagctcgttgctgaagaacgacatcccgatgactgggcctttagtagccggaggtctcctgaccgtgtgctatgttcttacgggccgatcagcggatctggaattggagcgcgctgccgacgtgaaatgggaggatcaagcagaaatttctgggagttcccccatcctcagcattacaatctctgaggacggaagcatgtccataaagaatgaagaggaggaacagaccctgactatcctaattcggacaggcctgcttgtcatctcaggtgtgtttccagtaagtattcccatcaccgccgctgcatggtacctctgggaggtgaaaaagcagagagccggggtcctgtgggatgttcctagcccaccccctgtggaaaaggcggagttggaagacggagcttataggataaaacagcgtggcattttaggctactctcaaatcggggccggagtgtataaggagggtactttccacacaatgtggcatgtcacccgcggcgcagtgctgatgcaccgggggaaaagaatcgagccgtcctgggccgatgttaagaaagacctcatttcatacggaggcggttggaagctggaaggggagtggaaggaaggagaggaagtacaggtgcttgctctggagccaggcaaaaaccccagggccgtccagacgaagcctggcatctttaaaactaataccgggacaataggagcagtgagtttggatttcagcccaggtacctccggctctcccattgttgaccgaaaggggaaagtggtcggactatacggcaacggtgtggtaacacggtcgggggcttatgtcagcgccatcgcgcagactgagaagtcaattgaagataaccctgagatcgaagacgatatatttcgcaagaaaagactgaccattatggacctccatccgggagccggcaagacgaaaaggtacctgcccgcaatcgtgcgggaggctatcaagcgaggccttagaacattaattctggccccaactcgcgttgtggctgcagaaatggaggaggccctcagggggttgcctatccgttatcaaaccacagccattaaaaccgaacacactggacgggagatagtcgacctgatgtgtcatgctaccttcacaatgagactcctgtcccccgtgagggttccaaattacaaccttatcattatggatgaagcgcacttcacggaccctgcaagtatcgccgctcgcggttatatctctactcgagtggagatgggcgaggccgcagggatttttatgaccgccacacccccaggaagcagagatccgttccctcagtccaatgctcccataatggacgaagagcgggaaatcccagagaggtcatggaactctggccacgaatgggtcaccgattttaagggtaagactgtgtggttcgtacccagcattaaagcggggaatgacatcgccgcatgcctgcgcaagaacggaaaaaaggtgattcagttgagtcgtaaaacatttgattccgagtacgttaagaccagagctaatgactgggatttcgtcgtgacgactgacatcagcgagatgggcgccaactttaaggcagaacgggtgatagatcctaggcgctgtatgaaaccagtcatcctaacagacggcgaggaacgagtaattctggccgggcccatgcctgtgacccattcttcagctgcccaaagacggggaaggatcggtcgcaatccgaagaacgagaatgaccagtatatttacatgggcgaaccactcgagaacgatgaggactgcgcgcactggaaagaagcaaagatgttactggataatatcaacacccccgaggggataattccttccatgttcgaacccgagagagaaaaagttgacgccatcgatggagagtacaggcttcggggcgaggctcgtaagacttttgtggacctgatgcgccgaggtgatctcccagtctggttggcctataaagtggctgcagaagggattaattacgccgacagaaagtggtgtttcgatggcatcaagaacaaccagatactggaggaaaatatggaggttgagatctggacaaaagaaggagagaggaagaaactcaagcctcggtggctggacgctcgcatttatagtgatccccttgccctaaaagaatttaaggagttcgcagcgggcagaaagagcctgaccttgaacttaatcacagaaatggggaggctgccaactttcatgacgcagaaagcccggaatgctctcgacaacctggccgtgcttcataccgcagaggctggaggtcgagcctacaatcacgcactgtcggagctccctgaaacattggagactctgctactgctcacccttctggccacagtcaccggcgggatttttttattcttgatgtctggaaagggcatcggtaaaatgactctggggatgtgctgcataattacggcttccatcctcctgtggtatgcgcaaatccagccgcactggattgccgcaagcatcatacttgaatttttcctgattgtgctcttgatccccgagccagaaaagcagagaacccctcaggataaccaactgacatacgtagtgattgctatcttaactgttgtcgccgccaccatggcaaatgagatgggctttctagagaaaacaaagaaggacctgggactcggctcaataaccactcaggaaagtgagtctaacatccttgacattgatctgcgccccgcttccgcctggacattgtatgcggtggctacgaccttcgtgactccaatgctgaggcatagcatcgaaaattcaagtgtcaacgttagcctcacagccattgcaaatcaggccaccgtgctgatggggcttggaaaaggttggcctctctccaagatggacatcggcgtacccctgttggctattgggtgttactctcaggtgaacccgatcaccctgacagcagccttactactgctcgtcgcgcactacgctataattggaccaggccttcaagccaaagcaactcgggaggcccagaagcgtgctgccgcaggtatcatgaaaaatcctacggtggatgggatcaccgttattgacctggaacccataccatatgatcccaagtttgagaagcagttgggccaggtgatgctgctcatcctgtgcgtcacacaagtacttatgatgagaactacctgggctttatgtgaggccctgacactcgcgaccggacctattagcactttgtgggaaggcaacccggggaggttctggaatacgacaatcgccgtgtccatggcaaacatttttcgcggatcatacctggctggcgccggtctactgttctctatcatgaaaaataccactaacacccggcgagggacaggaaacataggcgagactctcggtgaaaagtggaaaagtagacttaatgcactgggcaagtcggagtttcagatctataaaaagagcgggattcaggaggttgacaggaccttggctaaagaaggaatcaagcgcggcgagacagatcatcacgccgtgtcccgggggtctgccaagctgagatggttcgtcgaacgtaacatggtgacgcccgagggaaaagtcgtggacctcggctgcggtagggggggatggtcatactattgtggcggtctgaagaatgttcgggaagtgaaaggcttaaccaaggggggaccaggccatgaggagcctattcccatgagcacttacgggtggaaccttgtacgcctgcaatccggagtggatgtctttttcacacctccagaaaaatgcgacaccctcctatgtgatatcggcgagagttctcccaatcctactatagaagcgggtcgaacactgagagttttgaacctggtggagaattggctcaacaataacacccagttctgcattaaggtccttaatccatatatgcccagcgtgatcgaaaagatggaggctctgcagaggaaatacgggggagcattggtacggaacccgctgtcacgcaattccacgcacgagatgtactgggtgagtaacgccaccggcaatatcgttagctctgtgaacatgatttccagaatgctcataaacaggtttacaatgaagcacaaaaaggctacttatgaacctgacgtcgatttaggctcagggacccgaaatatcggaattgagagcgaaatcccaaacctggacattatcggtaaacggatagagaagatcaagcaggaacatgaggcctcgtggcactacgaccaagatcatccctataaaacatgggcataccacggctcttatgagactaagcagaccgggagtgcctccagcatggtgaatggagtcgtgcgtcttctgacaaaaccttgggacgttgtaccaatggtgacccagatggctatgactgatacgacacccttcggccagcaaagagtctttaaggaaaaagtggacacccgcactcaggagccgaaggaaggtaccaagaaactaatgaagattacagcggagtggctctggaaagagctggggaagaaaaagacgcctaggatgtgtacccgggaagagttcactaaaaaggttagatcaaacgccgcattgggagctatctttacagatgaaaataagtggaaatccgcccgcgaggcagtggaagacggcaggttctgggagctggtcgatcgagagcggaacctccaccttgaaggcaagtgcgagacctgtgtgtacaatatgatggggaaaagagaaaagaaactgggagagtttggtagggccaagggctctcgcgctatttggtatatgtggttaggggcccgtttcctggaatttgaggcgttgggattcctcaacgaggaccattggtttagccggggcaatagtctgtccggtgtagaaggggagggactacacagacttggctacatcctgagggatgtgggcaagaaagaagggggagcaatgtacgccgacgatactgctggttgggacacacgcattaccctcgaggacctgaagaacgaagagatggttacaaatcatatgaaaggcgagcacaagaaattggccgaagcaatattcaagctgacttatcagaacaaggtcgtgcgagtgcagcggcccaccccaagagggacggtcatggatatcattagcaggcgcgaccaaagaggatctggccaggttggtacctacgggctcaatacatttactaacatggaggctcagcttatccggcaaatggaaggagagggcatcttcaaatcaattcagcatctgaccgccacagaggaaatagctgtgcagaattggttagccagggtaggccgtgagcgactgagtcgcatggcaatctccggggatgactgcgtggtcaagcctattgatgacagattcgcgagcgccttgactgctctcaacgatatgggaaaagtgcggaaggacatccagcaatgggaaccctctaggggttggaacgattggacccaggttccattttgctcgcaccacttccatgagctggtgatgaaagacggccgcgtcctagtggtaccctgtagaaatcaggatgaacttattgggcgggccaggatctcacagggagcaggctggagcctgaaggagacggcttgcctcggtaagtcctatgcccaaatgtggacactgatgtactttcaccgacgtgacttgagattagcagccaacgcgatatgtagtgctgttccttctcattgggtgccaaccagccgcactacatggtccatccacgccaaacacgagtggatgaccactgaagatatgctggcagtctggaatcgggtgtggattcaggagaacccgtggatggaagacaagacccccgtggagtcatgggaagaggtcccttatctcgggaaaagggaggaccagtggtgcggaagtcttatcggcctgacatctagagccacgtgggctaagaatattcagaccgccatcaaccaagttcgcagcctaataggcaatgaagagtacactgattatatgccatccatgaaacggttcaggcgagaagaggaagaggcaggggtgctgtggtga

SEQ ID NO: 14492 - RNA, 9876 nt, synthetic construct
  misc_feature 1..9876: note = derived and/or modified CDS sequence (opt3) from DENV-2__FJ205885__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgttctgacttcaatcgggaaggcccttcaccaggtgtttggcgctatttacggagcggcattcagtggcgtaagctggaccatgaaaatcttgataggggtcatcattacgtggatcggaatgaactccagatctacaagcctgtcagtgagtctcgttctggtgggcgtcgtgaccctttatctgggtgccgtagtgcaggctgactccgggtgtgttgtcagctggaagaataaagaattgaagtgcggatctggcatttttatcactgataacgtgcacacatggaccgagcagtacaagttccaacccgaatcaccaagtaaactcgccagcgcaatacagaaggcccatgaggaaggtatttgtggcatcaggtccgtgactcggctggagaatttaatgtggaaacagattacccccgagctgaaccacatcctatctgaaaatgaggtcaagctcacaataatgacgggggacatcaaaggaattatgcaggctggcaagcgctcgctgagacctcaaccaaccgaacttaaatatagctggaagacttgggggaaggccaaaatgttgtccacagagtcacataaccagacctttctgatcgatggaccggaaacagcagagtgccccaatactaacagggcgtggaatagtctcgaggttgaagactacggcttcggtgtgtttaccacgaacatttggctgaagttacgtgagaaacaggacgtgttctgtgattctaagctgatgagcgctgccatcaaagacaatcgggcagtacacgccgatatggggtattggatagaatccgctcttaacgacacatggaagatggagaaggcctcatttattgaggtcaaaagctgccactggcctaagtctcataccttgtggtccaatggagtgctcgaaagtgagatgatcatcccaaaaaacttcgcaggccccgttagccagcacaactaccgacctggttatcatactcaaaccgctggcccatggcacctggggaagctagaaatggatttcgacttttgtgagggaacaactgtggtcgtgaccgaagattgcggcaatagagggccctctctgaggacaacgaccgcctccggaaaactcattactgagtggtgctgtcgctcatgcacactgccgcctcttcggtacagaggcgaggacggttgttggtacgggatggaaatcaggccattgaaggagaaggaagagaacctggttaatagtttagtgaccgcgggacatggccagattgataacttcagcctcggtgtactgggcatggccctttttctggaagagatgttgcgcactcgaatagggacaaaacacgctatcctcctggtcgcagtgtcgttcgtgaccctaattacgggaaatatgtcctttcgggacctgggccgtgtcatggttatggtgggggccactatgaccgatgacatcggaatgggcgtaacatatctcgctctgcttgccgcattcaaggtgagacccacctttgcggccggtttgctgttaaggaaactcacttctaaggagctgatgatggctacaattgggatcgcccttctgagccagtcaaccatacctgaaacaatcctagagctcactgatgcactggctttgggaatgatggtcctgaaaattgtgcgcaacatggaaaagtaccaattagccgttaccatcatggcaattagttgcgtgcccaatgccgtcatcctccagaacgcttggaaggtgtcctgtacgatactggcggccgtttctgtgagcccacttctgttgacatcctcacagcagaaagcagactggattcctctcgctctgaccatcaagggcctaaatcccactgccatcttcctgaccacacttagccggactagtaaaaagagatcttggccactcaacgaggccattatggctgtcggcatggtatccatactggcaagctcgttgctgaaaaatgacatcccgatgaccgggcctttagtggccggaggtctcctgacggtttgctatgtgcttacaggcaggtcagcggatctggaattggagcgagctgccgacgtcaagtgggaggatcaagcagaaatttctgggagttcccccatcctcagcattaccatctctgaggacggaagcatgtccataaaaaacgaagaggaggaacagactctgacaatcctaattcgcaccggcctgcttgtgatctcaggtgtatttccagtgagtattcccatcactgccgctgcatggtacctctgggaggtcaagaagcagcgggccggggttctgtgggatgtgcctagcccaccccctgtggaaaaagcggagttggaagacggagcttatagaataaagcagaggggcattttaggctactctcaaatcggggccggagtctataaagagggtacattccacaccatgtggcatgtgacgcgtggcgcagttctgatgcaccgcgggaagcggatcgagccgtcctgggccgatgtaaaaaaggacctcatttcatacggaggcggttggaagctggaaggggagtggaaagaaggagaggaagtgcaggtccttgctctggagccaggcaagaatcccagagccgtgcagactaaacctggcatctttaagaccaacacagggaccataggagcagttagtttggatttcagcccaggtacatccggctctcccattgtggacaggaaagggaaggtcgtgggactatacggcaatggtgtagtcactcgatcgggggcttatgtgagcgccatcgcgcagaccgagaagtcaattgaagataaccctgagatcgaagacgatatatttcggaaaaagcgcctgacgattatggacctccatccgggagccggcaaaacaaagagatacctgcccgcaatcgttagggaggctatcaaacggggccttcgaactttaattctggccccaaccagagtggtcgctgcagaaatggaggaggccctccgcgggttgcctatcaggtatcaaacacccgccattaagaccgaacacactggacgtgagatagtggacctgatgtgtcatgctaccttcacaatgcggctcctgtccccagttagagtgcctaactacaatcttatcattatggatgaagcgcacttcacggaccccgcaagtatcgccgctaggggttatatctctactcgcgtcgagatgggcgaggccgcagggatttttatgaccgccacaccaccgggaagccgagatcctttcccccagtccaacgctccaataatggacgaagagagagaaatccccgagcggtcatggaattctggccacgaatgggtgaccgattttaagggtaaaactgtatggttcgtgcctagcattaaggcggggaacgacatcgccgcatgcctgaggaaaaatggaaagaaagttattcagttgagtcgcaagacatttgattccgagtacgtcaagacccgtgctaacgactgggatttcgtggtgacgactgacatcagcgagatgggcgccaattttaaagcagaaagagtcatagatccacggaggtgtatgaagcccgtaatcctaacagacggcgaggaacgcgtgattctggccgggcctatgccggttacccattcttcagctgcccaacgaagaggacggatcggtaggaacccaaaaaatgagaacgaccagtatatttacatgggcgaacccctcgagaatgatgaggactgcgcgcactggaaggaagcaaaaatgttactggataacatcaatacccctgaggggataattccctccatgttcgaaccagagcgcgaaaaggtggacgccatcgatggagagtacagacttaggggcgaggctcggaaaacttttgtcgacctgatgcgtcgcggtgatctccctgtgtggttggcctataaggttgctgcagaagggattaactacacagaccgaaagtggtgtttcgatggcatcaaaaataaccagatactggaggaaaacatggaggtggagatctggaccaaggaaggagagagaaaaaagctcaaacccaggtggctggacgcccggatttatagtgatccacttgctctaaaggaatttaaggagttcgccgcaggccgcaaaagcctgacattgaatttaatcactgaaatggggagactgcctacgttcatgacccagaaggcgaggaacgccctcgacaatctggctgtccttcatacagccgaggcaggaggtcgggcttacaaccacgccctgtcggagctcccggaaactttggagaccctgctactgctcacacttctggcaaccgtgactggcgggatttttttattcttgatgtctggaaaaggcatcggtaagatgacgctggggatgtgctgcataattaccgcctccatcctcctgtggtatgctcaaatccagccccactggattgcggccagcatcatacttgaatttttcctgattgtactcttgatcccagagcctgaaaaacagcgaacaccccaggataatcaactgacttacgtggttattgcaatcttaaccgtcgtggctgccacaatggccaacgagatgggctttctagagaagaccaagaaagacctgggactcggctcaataactacacaggaaagtgagtctaatatccttgacattgatctgagaccagcatccgcttggacgttgtatgccgtggcgaccactttcgtcacacctatgctgcgccatagcatcgaaaactcaagtgttaatgtgagcctcaccgctattgccaaccaggcaaccgtactgatggggcttggaaagggttggcccctctccaaaatggacatcggcgtgccgctgttggccattgggtgttactctcaggtcaatccaatcacactgactgctgcattactactgctcgtggcccactacgcgataattggacctggccttcaagctaaggccacgagggaggcacagaaacgggccgctgccggtatcatgaagaaccccaccgttgatgggatcacagtgattgacctggaaccaataccctatgatcctaagtttgagaaacagttgggccaggtcatgctgctcatcctgtgcgtaactcaagtgcttatgatgcgtaccacatgggcattatgtgaggctctgaccctcgccactggaccgattagcacgttgtgggaaggcaatcccgggagattctggaacacaaccatcgcggtttccatggccaatatttttaggggatcatacctggcaggcgctggtctactgttctctatcatgaagaacactaccagtacacgccgggggactggaaatataggcgagaccctcggtgaaaaatggaagtcgcgacttaacgccctgggcaaaagcgagtttcagatctataagaaatccgggattcaggaggtggacagaacattggcaaaggaaggaatcaagaggggcgagacggatcatcacgctgtctctcgcgggtcagccaaactgcggtggttcgtggaaagaaacatggtcaccccagagggaaaggtggttgacctcggctgcggtcgtgggggatggagctactattgtggcggtctgaaaaatgtgagggaagtaaagggcttaactaaagggggacctggccatgaggagcccattcctatgtccacatacgggtggaaccttgtgcggctgcaaagtggagtcgatgtttttttcaccccacccgaaaagtgcgacactctcctatgtgatatcggcgagtctagccctaatccaacaatagaagccggtcgcaccctgcgagtgttgaacctggtcgagaattggctcaacaataacacgcagttctgcattaaggtgcttaatccctatatgccgtcagtaatcgaaaaaatggaggcgctgcagagacagtacgggggagctttggtgaggaaccctctgtcccggaatagtacccacgagatgtactgggttagcaacgcaacaggcaatatcgtgtcttccgtcaacatgatttcacgcatgctcataaatagatttactatgaagcacaaaaaggccacctatgaaccagacgtggatttaggcagcgggacaaggaacatcggaattgagtcggaaatccccaacctggacattatcggtaaacgaatagagaagatcaagcaagaacatgagatttcttggcactacgaccaggatcatccttataaaacttgggcttaccacggcagttatgagaccaagcagacagggtccgccagctcaatggtcaatggagtggttcggcttctgaccaaaccatgggacgtagtgcccatggtcactcagatggcaatgacggatacaaccccgttcggccaacagcgtgtgtttaaggaaaaagttgacactagaacccaggagcctaaggaaggtacaaagaaactaatgaagatcacggccgagtggctctggaaagagctggggaagaaaaagaccccccgcatgtgtactagggaagagttcacacggaaagtgagatccaacgctgcgttgggagccatttttaccgatgaaaataagtggaagtctgcacgcgaggctgtcgaagacggcaggttctgggagctggtggatcgagagcggaacctccaccttgaaggcaaatgcgagacttgtgtatacaatatgatggggaagagagaaaaaaagctgggagagtttggtaaagccaagggcagcagggcaatctggtatatgtggttaggggcccgcttcctggaatttgaggctttgggattcctcaacgaggaccattggtttagtcgtggcaattccctgagcggtgtggaaggggagggactacaccggcttggctacattctgagagatgttggcaagaaagaagggggagccatgtacgcggacgatacagcaggttgggacaccaggataacactcgaggacctgaagaacgaagagatggtcactaatcatatgaaaggcgagcacaagaaattggccgaagctatcttcaagctgacctatcagaacaaggtggtgcgcgtccaacgaccaacgcctcgggggaccgttatggatattatctctagaagggaccagcgcggatcaggccaggtgggtacatacgggctcaatacttttaccaacatggaggcccaacttatcagacagatggaaggagagggcattttcaaaagtatacagcatctgacagcaactgaggaaatcgctgtacagaattggttagcccgggtgggcagggagcgtctgtcccgaatggctattagcggggatgactgcgtcgtgaagcccatcgatgaccgcttcgcctctgcattgaccgcgctcaacgatatgggaaaagttagaaaggacattcaacagtgggaaccatcgcggggttggaatgattggacgcaggtgcccttttgctcacaccacttccatgagctggtcatgaaagacggcagggtgctagtagttccttgtcgcaaccaggatgaacttatcgggagagcccggataagccaaggagctggctggtccctgaaggagacagcctgcctcggtaagagttatgcacagatgtggaccctgatgtactttcacaggcgagacttgcgtttagctgccaacgcaatctgttctgccgtgccaagccattgggtcccgacttccagaacaacctggtcaattcacgcgaaacacgagtggatgactaccgaagatatgctggctgtgtggaatcgcgtgtggatccaggagaacccctggatggaagacaagacacctgtcgagagttgggaagaggttccatatctcgggaaacgggaggaccagtggtgcggatctcttattggcctgacgagcagggccacctgggcaaagaatatccaaactgccataaaccaggtgagatccctaattggcaatgaagagtacacagattatatgccctcaatgaaacgcttccggagggaagaggaagaggctggggtactgtggtga

SEQ ID NO: 14493 - RNA, 9876 nt, synthetic construct
  misc_feature 1..9876: note = derived and/or modified CDS sequence (opt3) from DENV-2__FJ744743__SS-prME
  source 1..9876: mol_type = other RNA
accgcaggcgtgatagtaatgctgattcccaccgctatggcattccacctcactacgcgaaacggggagcctcatatgatagttggaaggcaggaaaagggtaaaagccttctgtttaagaccgaggacggcgtgaatatgtgcacattgatggcaatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgaggtgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacaggaaaggactcccctgtcaacatcgaagccgagcccccatttggcgatagctacatcattataggggtggaacctggacagttaaaactgaattggttcaagaagggttcgtctatcggccaaatgtttgagactaccatgcgaggggctaaacgcatggccattctaggagacacagcatgggatttcggctccctcggtggggtttttacttcaatcggcaaggccctgcaccaggtgttcggagctatttacggcgcggcatttagtggggtaagctggaccatgaaaatccttataggagtcatcattacgtggatcggcatgaactccagatctactagcttgtcagtgagtctggttctcgtgggtgtcgtgaccctgtatcttggggccgtagtgcaggctgactccggatgtgttgtcagctggaagaataaagagctgaagtgcggctctggtattttcatcactgataacgtgcacacatggaccgaacagtacaagtttcaacccgagtcaccaagtaaattggccagcgcaatacagaaggcccatgaagagggcatttgtgggatcaggtccgtgactcggctcgaaaatctgatgtggaaacagattacccccgagttaaaccacatcctgtctgagaatgaagtcaagctaacaataatgacgggagacatcaaaggcattatgcaggctgggaagcgctcgctctggcctcaaccaaccgagctgaaatatagctggaagacttggggaaaggccaaaatgctttccacagaatcacataaccagaccttcttgatcgatggcccggagacagcagaatgccccaatactaacagagcgtggaatagtctggaggttgaggactacggttttggggtgttcaccacgaacatttggctcaagctgagggaaaaacaggacgtgttttgtgattctaagttaatgagcgctgccatcaaagacaatcgtgcagtacacgccgatatgggatattggatagagtccgctctgaacgacacatggaagatggaaaaggcctcattcattgaggtcaaaagctgccactggcctaagtctcataccctttggtccaatggcgtgttggagagtgaaatgatcatccccaagaatttcgcaggtcccgttagccagcacaactaccggcctggctatcatactcaaaccgctgggccatggcacctcggaaagctggagatggattttgacttctgtgaaggcacaactgtggtcgtgaccgaggattgcgggaatcgaggaccctctctaagaacaacgaccgcctccggcaaactgattactgaatggtgctgtaggtcatgcacactcccgcctctgcgctaccggggtgaggacgggtgttggtacggaatggagatcagaccacttaaggaaaaggaggaaaacttggttaatagtctggtgaccgcgggccatggtcagattgataactttagcttaggcgtactcgggatggccctgttccttgaggaaatgctgaggactcgcataggaacaaaacacgctatcttgctcgtcgcagtgtcgtttgtgaccctgattacgggcaatatgtccttccgagacctagggcgggtcatggttatggtgggagccactatgaccgatgacatcggcatgggtgtaacatatctggctctcctggccgcatttaaggtgcgtcccaccttcgcggccgggcttttgctgagaaaattaacttctaaggagctcatgatggctacaattggaatcgccctgcttagccagtcaaccatacctgagacaatcctggaactaactgatgcactcgctctgggcatgatggtcttgaaaattgtgaggaacatggagaagtaccaactggccgttaccatcatggcaattagttgcgtgcccaatgccgtcatcttacagaacgcttggaaggtgtcctgtacgatactcgcggccgtttctgtgagcccactgcttctgacatcctcacagcagaaagcagactggattcctttggctctcaccatcaagggcctgaatcccactgccatctttctaaccacactgagccgcacaagtaaaaagcggtcttggccacttaacgaagccattatggctgtcgggatggtatccatactcgcaagctcgctgttgaaaaatgacatcccgatgaccggacctctggtggccggtggcttactcacggtttgctatgtgctgacagggagatcagcggatcttgagctggaaagggctgccgacgtcaagtgggaggatcaagcagagatttctggaagttcccccatcttgagcattaccatctctgaagacggcagcatgtccatcaaaaacgaggaagaggagcagactctcacaatcctgattcgaaccggtctactggtgatctcaggggtattcccagtgagtattcccatcactgccgctgcatggtacctttgggaagtcaagaagcagcgcgccggagttctctgggatgtgcctagcccaccccctgtggagaaagcggaactggaggacggcgcttatcggataaagcagagaggcattttggggtactctcaaatcggagccggtgtctataaagaaggcacatttcacaccatgtggcatgtgacgagaggggcagttttaatgcaccgtggaaagcgcatcgagccgtcctgggccgatgtcaaaaaggacctgatttcatacggcggtgggtggaagctcgagggagaatggaaagagggcgaagaggtgcaggtcctggctcttgaaccaggcaagaatccccgggccgtgcagactaaacctgggatcttcaagaccaacacaggaaccataggtgcagttagtctggattttagcccaggcacatccgggtctcccattgtggacagaaaaggaaaggtcgtgggcttgtacggtaatggggtagtcactaggtcgggagcttatgtgagcgccatcgcgcagaccgagaagtcaattgaggataaccctgaaatcgaggacgatatattccggaaaaagagactaacgattatggacctgcatccgggcgccggcaaaacaaagcgctacctccccgcaatcgttagagaagctatcaaaagggggctgcggactcttattttagccccaacccgagtggtcgctgcagagatggaagaggccctgagaggactccctatccgctatcaaacacccgccattaagaccgagcacactggtagggaaatagtggacttgatgtgtcatgctaccttcacaatgcgtctgctctccccagttcgggtgcctaactacaatctgatcattatggatgaggcgcactttacggaccccgcaagtatcgccgctagaggctatatctctactagggtcgaaatgggggaggccgcaggaattttcatgaccgccacaccaccgggcagccgcgatccttttccccagtccaacgctccaataatggacgaggaacgagagatccccgaaagatcatggaactctggtcacgagtgggtgaccgatttcaaggggaaaactgtatggtttgtgcctagcattaaggcgggaaacgacatcgccgcatgccttcggaaaaatggcaagaaagttattcagctgagtaggaagacattcgattccgaatacgtcaagacccgcgctaacgactgggattttgtggtgacgactgacatcagcgagatgggcgccaatttcaaagcagagcgtgtcatagatccaagacggtgtatgaagcccgtaatcttgacagacggggaagagagggtgattctagccggacctatgccggttacccattcttcagctgcccaacgccgaggtagaatcggccggaaccccaaaaatgaaaacgaccagtatatttacatgggggagcccctggaaaatgatgaggactgcgcgcactggaaggaggcaaaaatgctcttagataacatcaatacccctgaaggaataattccctccatgtttgagccagaaagggagaaggtggacgccatcgatggcgaataccgcctgagaggtgaggctaggaaaactttcgtcgaccttatgcggcgtggggatctgcctgtgtggctcgcctataaggttgctgcagagggcattaactacgccgaccgcaagtggtgttttgatggaatcaaaaataaccagatattggaagagaacatggaagtggagatctggacaaaggagggcgaacgaaagaaactgaaacccagatggctcgacgctaggatttatagtgatccactggcccttaaggagttcaaggagttcgcagcggggcggaaaagcctaaccctgaatttgatcacagagatgggacgcttacctacttttatgacgcagaaggccagaaacgctctggacaatctcgccgtcctgcataccgcagaagctggtggcagggcctacaaccacgcactttcggagctgccggagacactcgaaactttgctgctactgaccctccttgccacagtgaccgggggaattttcctgtttttaatgtctggcaaaggtatcgggaagatgactttgggcatgtgctgcataattacggcttccatcctgctctggtatgcgcaaatccagccccactggattgccgcaagcatcatactggagttctttcttattgtactgctcatcccagaacctgagaaacagcggacaccacaggataatcaattgacatacgtggttattgctatcctgactgtcgtggccgccaccatggcaaacgaaatgggattcttagagaagacaaagaaagacctaggcctggggtcagtgaccactcaggagagtgaatctaatatactcgacatcgatcttcgaccagcttccgcctggacactgtatgcggtcgctacgacctttgttactcctatgttgagacatagcattgagaactcaagtgtgaatgtaagcctgacagccatcgcaaaccaggccaccgtgctcatgggactgggtaagggctggcccctttccaaaatggacattggggtcccgctcctggctatcggatgttactctcaggtgaatccaattaccttgacagcaactctgttacgcttcgttgcccaatacgcgatcataggccctggtctacaggctaaggccacgagggaagcacagaaacgggccgctgccgggattatgaagaaccccaccgtggatggcatcacagtcatcgacctggagccaattccctatgatcctaagtttgaaaaacagctcggacaagtaatgcttctgatattgtgcgtgactcaggttctgatgatgcgtaccacatgggcactctgtgaggctctgacccttgccactggcccgatcagcacgttatgggaggggaatcccggaagattctggaacacaaccattgcggtgtccatggccaatatctttaggggctcatacctggccggtgctgggctcttgttctctattatgaagaacactaccagtacacgccggggaactggcaatatcggtgaaaccctgggcgagaaatggaagtcgcgactaaacgccctggggaaaagcgaatttcagatatataagaaatccggaatccaagaggtcgacagaacactcgcaaaggagggcattaagagaggggaaacggatcaccatgctgtgtctcgcggatcagccaaacttcggtggttcgtcgagagaaacatggtgaccccagaaggcaaggttgtggacctgggttgcgggcgtggaggctggagctactattgtggtggcttgaaaaatgtaagggaggtgaaggggctgactaaaggaggccctgggcacgaagaaccaatccctatgtccacatacggatggaacctcgtccggctgcagagtggcgttgatgtgttctttaccccacccgagaagtgcgacactttactttgtgatattggtgaatctagccctaatccaacaatcgaggccgggcgcaccctgcgagtcctcaacctagtggaaaattggctgaacaataacacgcagttctgcataaaggtattgaatccctatatgccgtcagtgattgagaaaatggaagcgctgcagagacaatacggaggcgctctcgttaggaaccctctttcccggaatagtacccatgagatgtactgggtgagcaacgcaacaggcaatatcgtctcttccgtgaacatgatctcacgcatgctgattaatagatttactatgaagcacaaaaaggccacctatgagccagacgtcgatttggggagcggaacaaggaacataggtatcgaatcggagattcccaacctggacatcattggcaaacgaatcgaaaagataaagcaggagcacgaaatctcttggcattacgaccaggatcacccttataaaacttgggcttaccatgggagttatgagaccaagcagacaggatccgccagctcaatggtgaatggcgttgtacggctcttaaccaaaccatgggacgtggtccccatggtgactcaaatggcaatgacggatacaaccccgttcggtcagcagcgtgtttttaaggagaaagtggacactagaacccaggaacctaaggaggggacaaagaaactgatgaagattacggccgaatggctttggaaagagctgggaaagaaaaagacaccccgcatgtgtactagggaggagttcaccaaaaaggtccggtccaacgctgcgctaggcgccatctttaccgatgagaataagtggaaatctgcaagagaagctgtggaggacggccgcttctgggaactcgtagatagggagcgaaacctgcacttggaggggaagtgcgaaacttgtgtgtacaatatgatgggaaaacgggagaagaaactgggtgaatttggcaaggccaaggggagcagagcaatttggtatatgtggctcggagccaggttccttgagtttgaagctctgggcttcttaaacgaggaccactggtttagtcgcggtaattccctgagcggggttgagggagaaggcttgcatcgtctcggctacatcctgcgggatgtcgggaaaaaggagggaggtgccatgtacgcggacgatacagcaggctgggacaccagaattacactagaagaccttaaaaacgaggaaatggtgactaatcacatgaagggggagcataaaaagctggccgaggctatattcaagctcacctatcaaaacaaagtggtcagggttcagcgcccaacgcctcgaggaaccgtgatggatatcatttctcggagagaccagaggggctcaggtcaagtagggacatacggactgaatactttcaccaacatggaagcccagttgatccgccagatggagggcgaaggcatctttaagagtattcagcacctgacagcaatagaggagatcgctgtgcaaaattggctcgccagagtcgggcgggaaaggctttcccgtatggctattagcggagatgactgcgtggttaaacccatcgatgaccgattcgcctctgcactgactgcgttaaacgatatgggtaaggtgcgcaaagacattcagcagtgggagccatcgagaggctggaatgattggacccaggtccccttttgctcacatcacttccacgaactggtgatgaaggacgggcgggtattggttgtgccttgtaggaaccaagatgagctcatcggacgcgccagaataagccagggcgctggttggtccctgaaggaaacggcctgcctagggaaaagttatgcacagatgtggacacttatgtactttcatcggagggacctgcgactcgctgccaacgcaatctgttctgccgtcccaagccactgggtgccgacctcccgtactacatggtcaattcatgcgaagcacgagtggatgaccactgaggatatgctggctgtgtggaatagagtctggatccaggaaaacccctggatggaggacaaaacccctgttgaaagttgggaggaagtgccatatttgggaaagcgcgaggaccaatggtgcggctctttaattggcctgacaagccgggccacgtgggccaaaaatatccagaccgccataaaccaggtaaggtccctcattgggaatgaggaatacactgattatatgccctcaatgaagagattccgccgggaggaagaggaagctggagtgctttggtga

SEQ ID NO: 14494 - RNA, 9876 nt, synthetic construct
  misc_feature 1..9876: note = derived and/or modified CDS sequence (opt3) from DENV-2__JN819424__SS-prME
  source 1..9876: mol_type = other RNA
accgcaggcgtgatcgtcatgctgattcccaccgctatggcattccacctcactacgagaaacggggagcctcatatgatagttggaaggcaggaaaagggtaagagccttctgtttaagaccgaggacggcgtgaatatgtgcacattgatggccatcgatttaggggaactgtgtgaggacactattacctacaagtgcccactactccggcaaaacgaaccggaggatatcgactgttggtgcaattccacatctacctgggtgacttatggaacatgtaccacgactggcgagcaccgccgagaaaagcgttcagtggcgctggtcccccatgtgggtatggggcttgagaccaggacagaaacttggatgagtagcgagggagcttggaagcacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctaccagcttgtcagtgagtctggttctcgtgggcgtcgtgacactgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgcttcctcaatcgacaatcgggccgtacacgcagatatggggtattggatggaaagcgccccttctgactcctgcaaaatggagaaggctagtttcatagaggataagagctgttactggccaaactctcagcacctgtggtccaatggagtccttgaatcagagatgattttccccaaaaactttgccggccctgtgagtcaacatatctatcgaccaggttaccacacacagaccgcaggcccctgcaacttggggaagctcgaaatggacttcgatttttgcgagggaactaccgttgtggtcacagaagactgtggcaatagagggccgagcctgaggactaccacagcttcgggaaaactaatcacggagtggtgctgtcgctcctgcaccctgcctccactccggtacagaggcgaggatggttgttggtatgggatggaaattaggcccctgaaggagaaagaagagaaccttgtaaattctttggttactgccggacatggccagatcgacaacttcagcctgggtgtgttaggcatggcgctctttctggaagagatgcttcgcacacgaattgggaccaagcacgccatactgttggtagctgtctcattcgtgactctcatcacaggaaatatgagttttcgggatctgggccgtgtgatggtcatggttggggcaaccatgacggacgatattggaatgggcgtgacttacctagccctgctcgctgccttcaaggtaagacctacctttgcagcgggtctgcttttgaggaaactgacatccaaggagttaatgatggccaccatcgggattgctctcctgtctcaaagcactatccccgaaacaatacttgagctgaccgacgccctagcactcggaatgatggtgctgaaaatcgtccgcaacatggaaaagtatcagttggctgtgacaattatggccatctcctgcgttccaaatgcagtgattctgcagaacgcctggaaagtctcatgtactatcttagctgcggtgagcgttagtcctctcctgcttacctcttcccagcaaaaggccgactggatacccctggcattgacgattaagggcctcaatccaacagctatcttcctgaccactctaagccggacctcgaaaaagagatcatggccgctgaacgaggccatcatggccgtgggcatggtctctattcttgctagttccctcctgaaaaatgatatacctatgacagggcccttggtagcaggaggtctgttaactgtgtgctacgttctcaccggcaggagcgccgacctggaacttgagcgagcggctgatgtgaagtgggaggaccaggccgaaatctctgggagctccccaattctgtcaatcacgattagtgaggatggaagcatgtctatcaaaaacgaagaggaggaacagacattgaccatactcatccgcactggcctgctagtcatttccggtgtgtttcccgtatcaatccctattacagcagccgcttggtatctgtgggaggtgaagaaacagcgggcaggggtcctttgggacgttccaagtccccctccggtggaaaaggccgagctcgaagatggagcgtacagaatcaagcaaaggggcatactgggctatagccagattggggctggagtgtacaaagagggtaccttccatactatgtggcacgtcacacgtggcgccgtgttgatgcaccgcgggaagcggatcgagccatcctgggcagacgttaaaaaggatttaatctcttacggaggcggttggaaactggaaggggagtggaaggaaggagaggaagtacaggtgctcgccctggagcccggcaagaatcctagagctgtccagaccaaaccaggcatttttaagacgaacactgggaccatcggagccgtgtcgcttgacttcagccccggtacatcaggctcccctatagttgataggaaagggaaggtggtcggactgtatggcaatggtgtggtaacccgaagtggggcatacgtctctgctattgcccaaacagagaaaagcatcgaagacaacccggagattgaagatgacatcttccggaagaagcgcttgactataatggacctacatcccggagcgggcaaaaccaagagatatctgccagccattgtgagggaggcaatcaaacggggcctccgaacgctgatccttgctcctacaagagttgtggccgctgaaatggaggaggcattacgcgggctgcccattaggtaccagactccagccatcaagaccgaacacacaggacgtgagattgtcgatctcatgtgtcatgccacctttactatgcggttgctgtcccctgtgagagttcccaactataatctcataatcatggacgaagctcacttcaccgatccagcgtcaattgcagccaggggttacatctctacacgcgtggagatgggcgaggctgccgggatctttatgacggcaactccgcctggaagccgagaccccttcccacagagtaacgcccccattatggatgaagagagagaaatacctgagcggtcctggaatagcggccatgaatgggtcaccgactttaaaggtaagacagtgtggttcgtaccatctatcaaggctgggaacgatattgcggcctgcctgaggaaaaatggaaagaaagtgatccaactttcacgcaagacctttgactccgagtatgttaaaactcgtgcaaacgattgggacttcgtcgtgacaaccgatattagtgagatgggcgctaattttaaggccgaaagagtgatcgacccccggaggtgtatgaagcctgtcatactgacggacggcgaggaacgcgtaatcttggcagggccgatgccagtgactcacagctcggccgctcagcgaagaggacggattggtaggaaccccaaaaatgagaacgatcagtacatctacatgggcgaacctctagagaatgacgaggattgcgcccactggaaggaagcgaaaatgctgctcgacaacattaatacacccgaggggatcataccatctatgttcgaacctgagcgcgaaaaggttgaggcaattgatggagagtatagattaaggggcgaagcccggaaaacctttgtggacctgatgcgtcgcggtgatcttcccgtccgactggcttacaaggtggccgctgaggggatcaactatgcagacagaaaatggtgcttcgatggcattaaaaattcccagatcctcgaagagaacatggaggttgaaatatggaccaaggagggagaaaggaaaaagttgaaaccacggtggctggacgcccgcatctacagcgatcctctcgctctgaaggagttcaaagaatttgccgcaggcagaaagtcacttactctaaacctgattacagagatggggaggttgccgaccttcatgacacaaaaggcgcggaatgccttagacaacctggctgtgctccatactgccgaggcaggaggtcgagcttataatcacgccctgagtgaacttcccgagacgctggaaaccctcttgctgctaacactgctcgcaactgtcaccggcgggatctttcttttcctgatgtctggaaaaggcattggtaagatgacattagggatgtgttgcatcataaccgcctccattttgctgtggtacgctcagatccagccacattggatcgcggccagcattatcctcgagtttttcctgatagtgcttctgattcctgaacccgagaaacagagaactccacaagataaccagctcacgtatgtagtgatcgcaattttgaccgttgtcgctgccacaatggccaatgagatgggctttctggaaaagactaaaaaggacttaggactaggctcaatcaccacacaggagagtgaaagcaacatactggacatcgatctccgccctgcatccgcttggaccctttacgccgtggcgactacattcgtgacgcccatgctgaggcactctattgagaatagctccgtcaacgtttcattgaccgctatcgccaatcaggcaactgtgctgatggggctcggaaagggttggccgctgtctaaaatggacattggcgtaccacttctcgccatcgggtgttacagtcaagtgaaccctattacactgaccgctgcattgctgctattagtcgcccactatgcgatcataggacccggcctgcaggctaaggccacccgggaagcacagaaacgtgccgctgccggtattatgaagaatccaacagtggatgggatcactgttatcgacctcgagcccattccttacgatccgaaatttgagaagcagcttggccaagtgatgctgttgatactgtgcgtcacgcaggtactcatgatgagaaccacatgggcactgtgtgaagctcttactttagccaccggacccatctcgacactgtgggagggcaacccagggaggttctggaataccactattgcggtgagcatggccaacatctttcgcggatcctatctcgcaggcgctggtttgctgttctctattatgaagaatacgacatcaacccggcgagggactggaaacatcggcgaaaccctaggtgagaaatggaaaagcagactgaatgccctcggcaaatccgagtttcagatatacaagaaaagtgggatccaagaagttgacaggacacttgcaaaggagggaattaaacgcggcgaaactgatcatcacgctgtgtctcgggggagcgccaagctgagatggttcgtcgagcgtaacatggtgacccctgaaggaaaggtcgtggacttgggctgcggtagagggggatggtcatattactgtggcggtctgaaaaacgttcgggaggtgaagggcctcacaaaagggggacccggccatgaggaacctatcccaatgtccacgtatgggtggaatctggtacgcttacagagtggagtggatgtcttctttacaccccctgagaagtgcgacactcttctgtgtgatattggcgaaagctctccaaaccccacaatcgaggccggtcgaaccctcagagttctaaatctggtggaaaactggttgaataacaatactcagttctgcataaaagtcctgaacccgtacatgccttccgtgattgagaagatggaggcgctccagaggcaatacgggggagctcttgtacggaatccactgtcacgcaacagcacacacgaaatgtattgggtgtcgaatgcaaccggcaacatcgtttctagtgtgaatatgatctccagaatgttgattaacaggtttacgatgaagcataaaaaggccacctacgagcccgacgtcgatctgggcagcgggacacgaaatataggaatcgaatcagagattcctaacctcgacatcattggtaaacggatcgaaaagataaaacaggagcacgagatctcctggcactatgaccaggatcatccatacaagacttgggcttatcacggctcttacgaaaccaagcagacagggagcgccagttccatggtgaacggagtcgtgcgtttactgactaaaccctgggacgttgtaccgatggtgacccaaatggcaatgacagataccactcctttcggccagcagagagtctttaaggagaaagtggacacgcgcacacaggaacccaaggagggtaccaagaaacttatgaaaattactgccgagtggctgtggaaagaactagggaagaaaaagaccccaaggatgtgtacacgggaggagttcacgaaaaaggttagaagcaatgctgcgctcggagccatctttaccgatgagaacaaatggaagtctgcacgcgaagctgtggaggacggcaggttctgggagctggtcgatcgagaacggaatttgcatctggagggcaagtgcgaaacttgcgtgtataacatgatggggaaaagagagaagaaactcggagaatttggtaaggccaaaggctcaagggcaatttggtacatgtggcttggggcccgcttcctggagtttgaggctttaggattcctgaatgaagaccactggtttagtcgtggcaactccttgagcggtgtagagggggaaggactccaccggctgggctacatcctaagagatgtgggcaagaaggaagggggagccatgtatgcggacgatacagcaggttgggacaccaggattactcttgaagacctgaaaaatgaggagatggttacaaaccatatgaagggcgaacacaaaaagctcgccgaggctatattcaaactgacctaccaaaataaggtcgtgcgcgtgcagcgacctacaccccgggggactgtcatggatatcatttctagaagggaccagcgcggatcgggccaagttggtacctatgggttgaacacgttcaccaatatggaagcccagctgatcagacagatggagggagagggcatctttaagtcaattcagcatctcacagcaactgaagagatagctgtgcaaaactggcttgcccgggtaggcagggaacgtctgagccgaatggctatctccggggatgactgtgtggtcaaaccaattgatgaccgcttcgccagtgcattaaccgcgctgaatgatatgggaaaggtgagaaaagacatccagcagtgggagccctctcggggttggaacgattggacacaggttcctttttgcagccaccatttccacgaattggtgatgaaggacggcagggtcctcgtggtaccatgtcgcaatcaagatgagctgattgggagagcccggatctcccagggagctggctggtcactaaaagagactgcctgccttggtaagagttacgcacagatgtggaccctgatgtattttcacaggcgagacctccgtctggctgccaacgcaatatgttctgccgttccgagccattgggtgcccacgtccagaacaacctggtcaatccacgcgaagcatgaatggatgactacagaggatatgttggctgtctggaaccgcgtgtggattcaggaaaatccttggatggaggacaaaaccccagtggaaagctgggaggaggtcccctacttagggaagcgggaagaccaatggtgcggatctctgatcggcctcacttccagggccacctgggccaagaacattcagacagccatcaatcaggttagaagtcttataggcaacgaggaatatacggattacatgcctagcatgaagcgcttccggagggaggaagaggaggctggggtgctgtggtga

SEQ ID NO: 14495 - RNA, 9876 nt, synthetic construct
  misc_feature 1..9876: note = derived and/or modified CDS sequence (opt3) from DENV-2__FJ744741__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctacaagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatccgcggaattatgcaggctggcaaaagatcgctcaggcctcaaccaaccgaactgaagtatagctggaaaacttgggggaaggccaagatgctttccacagagtcacataaccagaccttcttgatcgatggaccggaaacagcagagtgccccaatactaaccgtgcgtggaatagtctggaggtcgaagactacggctttggtgttttcaccacgaacatttggctcaaactgcgggagaagcaggacgtgttttgtgattctaaattaatgagcgctgccatcaaggacaatcgagcagtgcacgccgatatggggtattggatagaatccgctctgaacgacacatggaaaatggagaaggcctcattcattgaggtaaagagctgccactggcctaaatctcataccctttggtccaatggagtcttggaaagtgagatgatcatcccaaagaacttcgcaggccccgtgagccagcacaactacagacctggttatcatactcaaaccgctggcccatggcacctcgggaaactggaaatggattttgacctatgtgagggaacaactgttgtggtcaccgaagattgcggcaatagggggccctctctgcgcacaacgaccgcctccggaaagctcattactgagtggtgctgtcggtcatgcacactgccgcctcttagatacaggggcgaggacggttgttggtacgggatggaaatccgcccattgaaagagaaggaagagaacctggtgaatagtttagttaccgcgggacatggccagattgataacttcagcctcggtgtgctgggcatggccctttttctggaagagatgttgcgaactcggatagggacaaagcacgctatcctcctggtagcagtctcgttcgtgaccctaattacgggaaatatgtcctttcgtgacctgggcagagtgatggtcatggttggggccactatgaccgatgacatcggaatgggcgtgacatatctcgctctgcttgccgcattcaaagtaaggcccacctttgcggccggtttgctgttacgcaagctcacttctaaagagctgatgatggctacaattgggatcgcccttctgagccagtcaaccatacctgaaacaatcctagagctcactgatgcactggctttgggaatgatggtgctgaagattgtccggaacatggaaaaataccaattagccgtgaccatcatggcaattagttgcgttcccaatgccgtgatcctccagaacgcttggagagtctcctgtacgatactggcggccgtgtctgttagcccacttctgttgacatcctcacagcagaaggcagactggattcctctcgctctgaccatcaagggcctaaatcccactgccatcttcctgaccacacttagcaggactagtaaaaagcgatcttggccactcaacgaggccattatggctgtgggcatggtctccatactggcaagctcgttgctgaaaaatgacatcccgatgaccgggcctttagtagccggaggtctcctgacggtgtgctatgttcttacaggccgctcagcggatctggaattggagcgggctgccgacgtgaagtgggaggatcaagcagaaatttctgggagttcccccatcctcagcattaccatctctgaggacggaagcatgtccataaaaaacgaagaggaggaacagactctgacaatcctaattagaaccggcctgcttgtcatctcaggtgtgtttccagtaagtattcccatcactgccgctgcatggtacctctgggaggtgaagaaacagagggccggggtcctgtgggatgttcctagcccaccccctgtggaaaaggcggagttggaagacggagcttatcgtataaagcagcgcggcattttaggctactctcaaatcggggccggagtgtataaagagggtacattccacaccatgtggcatgtcacgcggggcgcagtgctgatgcacagagggaagaggatcgagccgtcctgggccgatgttaaaaaggacctcatttcatacggaggcggttggaaactggaaggggagtggaaggaaggagaggaagtacaggtgcttgctctggagccaggcaagaatccccgagccgtccagactaaacctggcatctttaagaccaacacagggaccataggagcagtgagtttggatttcagcccaggtacatccggctctcccattgttgaccggaaagggaaggtggtcggactatacggcaatggtgtggtaactcgctcgggggcttatgtcagcgccatcgcgcagaccgagaaatcaattgaagataaccctgagatcgaagacgatatatttagaaagaagaggctgacgattatggacctccatccgggagccggcaaaacaaagcggtacctgcccgcaatcgtgcgagaggctatcaaaagaggccttcgcactttaattctggccccaaccagggttgtggctgcagaaatggaggaggccctccgtgggttgcctatccggtatcaaacaaccgccattaagactgaacacaccggaagagagatagtcgacctgatgtgtcatgctacattcacgatgaggctcctgtcccccgtgcgcgttccaaactacaatcttatcattatggatgaagcgcacttcactgaccctgcaagtatcgccgctcgaggttatatctctaccagagtggagatgggcgaggccgcagggatttttatgacagccacccccccaggaagccgggatccgttccctcagtccaacgctcccataatggacgaagagagggaaatcccagagcgctcatggaattctggccacgaatgggtcactgattttaaaggtaagacagtgtggttcgtacccagcattaaggcggggaacgacatcgccgcatgcctgcgtaaaaatggaaagaaagtgattcagttgagtagaaagacctttgattccgagtacgttaaaacgcgggctaacgactgggatttcgtcgtgactacagacatcagcgagatgggcgccaattttaaggcagaaagggtgatagatcctcgccgatgtatgaagccagtcatcctaaccgacggcgaggaaagagtaattctggccgggcccatgcctgtgacccattcttcagctgcccaacggaggggacgcatcggtagaaacccgaaaaatgagaacgaccagtatatttacatgggcgaaccactcgagaatgatgaggactgcgcgcactggaaggaagcaaaaatgttactggataacatcaatactcccgaggggataattccttccatgttcgaacccgagagggaaaaggttgacgccatcgatggagagtaccggcttcgtggcgaggctcgcaaaacatttgtggacctgatgcgaagaggtgatctcccagtctggttggcctataaggtggctgcagaagggattaactacgccgacaggaaatggtgtttcgatggcatcaagaataaccagatactggaggaaaacatggaggttgagatctggaccaaggaaggagagcggaaaaagctcaaacctcgctggctggacgctagaatttatagtgatccccttgccctaaaggaatttaaagagttcgcagcgggcaggaagagcctgacattgaatttaatcactgaaatggggcggctgccaacgttcatgacccagaaggcccgaaacgctctcgacaatctggccgtgcttcatacagcagaggctggaggtagagcctacaaccacgcactgtcggagctccctgaaactttggagaccctgctactgctcacacttctggccaccgtcactggcgggatttttttattcttgatgtctggaaaaggcatcggtaagatgacgctggggatgtgctgcataattaccgcttccatcctcctgtggtatgcgcaaatccagccgcactggattgccgcaagcatcatacttgaatttttcctgattgtgctcttgatccccgagccagaaaaacagcgcacacctcaggataatcaactgacttacgtagtgattgctatcttaaccgttgtcgccgccacaatggcaaacgagatgggctttctagagaagaccaaaaaggacctgggactcggctcaataactacacaggaaagtgagtctaatatccttgacattgatctgaggcccgcttccgcctggacgttgtatgcggtggctaccactttcgtgacaccaatgctgcggcatagcatcgaaaactcaagtgtcaatgttagcctcaccgccattgcaaaccaggccaccgtgctgatggggcttggaaagggttggcctctctccaaaatggacatcggcgtacccctgttggctattgggtgttactctcaggtgaatccgatcacactgactgcagccttactactgctcgtcgcgcactacgctataattggaccaggccttcaagccaaggcaacgcgtgaggcccagaaaagagctgccgcaggtatcatgaagaaccctaccgtggatgggatcacagttattgacctggaacccataccatatgatcccaaatttgagaagcagttgggccaggtgatgctgctcatcctgtgcgtcactcaagtacttatgatgaggaccacatgggctttatgtgaggccctgaccctcgcgactggacctattagcacgttgtgggaaggcaatccggggcgcttctggaacacaaccatcgccgtgtccatggcaaatatttttcggggatcatacctggctggcgccggtctactgttctctatcatgaagaacactaccaatacacgaagagggactggaaacataggcgagaccctcggtgaaaaatggaagagtaggcttaacgcactgggcaaatcggagtttcagatctataagaaaagcgggattcaggaggttgaccgcacattggctaaggaaggaatcaaacggggcgagacggatcatcacgccgtgtccagagggtctgccaagctgcgttggttcgtcgaaaggaatatggtgacccccgagggaaaggtcgtggacctcggctgcggtcgggggggatggtcatactattgtggcggtctgaaaaacgttcgcgaagtgaagggcttaactaaagggggaccaggccatgaggagcctattcccatgagcacatacgggtggaatcttgtacgactgcaatccggagtggatgtctttttcacccctccagaaaagtgcgacactctcctatgtgatatcggcgagagttctcccaaccctacaatagaagcgggtagaaccctgagggttttgaatctggtggagaactggctcaataacaatacgcagttctgcattaaagtccttaacccatatatgcccagcgtgatcgaaaagatggaggctctgcagcggaagtacgggggagcattggtacgcaatccgctgtcaagaaactccacccacgagatgtactgggtgagtaatgccacaggcaacatcgttagctctgtgaatatgatttccaggatgctcataaaccgatttactatgaaacacaagaaagctacctatgaacctgacgtcgatttaggctcagggacacggaacatcggaattgagagcgaaatcccaaatctggacattatcggtaagcgtatagagaaaatcaagcaggaacatgagacttcgtggcactacgaccaagatcatccctataagacctgggcctaccacggctcttatgagacaaaacagaccgggagtgcatccagcatggtgaacggagtcgtgagacttctgactaagccttgggacgttgtaccaatggtgacgcagatggccatgacagataccactcccttcggccagcaacgcgtctttaaagaaaaggtggacaccaggacacaggagccgaaagaaggtacgaagaagctaatgaaaattaccgctgagtggctctggaaggagctggggaaaaagaaaactcctcggatgtgtacaagagaagagttcacccgcaaggttaggtcaaatgcggccttgggagcaatctttactgatgaaaacaaatggaagtccgctcgagaggccgtggaagacggccggttctgggagctggtcgatagagagaggaatctccaccttgaaggcaagtgcgagacatgtgtgtacaacatgatggggaaacgcgaaaagaaactgggagagtttggtaaggcaaaaggctctcgtgccatttggtatatgtggttaggggctcggttcctggaatttgaggccttgggattcctcaatgaggaccattggtttagcagaggcaacagtctgtccggtgtagaaggggagggactacacaggcttggctacatcctgcgcgatgtgggcaagaaggaagggggagcgatgtacgcagacgataccgccggttgggacacacgaattactctcgaggacctgaaaaatgaagagatggttaccaaccatatgaagggcgagcacaaaaagttggctgaagccatattcaaactgacgtatcagaataaggtcgtgcgggtgcagagacccaccccaagggggacagtcatggatatcattagccgcagagaccaacggggatctggccaggttggtacttacgggctcaacacctttacaaatatggaggcacagcttatcaggcaaatggaaggagagggcatcttcaagtcaattcagcatctgactgctaccgaggaaatagccgtgcagaactggttagctcgtgtaggccgagagcgcctgagtagaatggccatctccggggatgactgcgtggtcaaacctattgatgaccggttcgcaagcgcgttgacggccctcaatgatatgggaaaggtgaggaaagacatccagcaatgggaaccctctcgcggttggaacgattggacacaggttccattttgctcgcaccacttccatgagctggtgatgaaggacggcagagtcctagtggtaccctgtcggaaccaggatgaacttattgggagggctcgaatctcacagggagccggctggagcctgaaagagaccgcatgcctcggtaagtcctatgctcaaatgtggactctgatgtactttcaccgtagagacttgcgcttagccgcaaatgccatatgtagtgcggttccttctcattgggtgccaacaagccggaccacttggtccatccacgctaagcacgagtggatgaccacagaagatatgctggccgtctggaacagggtgtggattcaggagaatccgtggatggaagacaaaacgcccgtggagtcatgggaagaggtcccttatctcgggaagagagaggaccagtggtgcggaagtcttatcggcctgacctctcgcgcaacttgggccaaaaacattcagacagctatcaatcaagttcggagcctaataggcaacgaagagtacaccgattatatgccatccatgaagaggttccgaagagaagaggaagaggccggggtgctgtggtga

SEQ ID NO: 14496 - RNA, 9876 nt, synthetic construct
  misc_feature 1..9876: note = derived and/or modified CDS sequence (opt3) from DENV-2__FJ744703__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcacagataagcttcaactgaaagggatgagctacagtatgtgtactggaaagttcaagatcgtgaaagaaatcgctgagacccagcacggcacgattgtaatcagagttcagtatgagggtgacgggtctccatgcaagattcccttcgaaataaccgatttggagaaaaggcatgtgctcggccggctgatcacagtcaacccgattgtgactgaaaaggactcccctgtcaacatcgaggccgaacccccatttggagatagctacatcattataggcgtggagcctgggcagttaaaactgaattggttcaagaagggatcgtctatcggtcaaatgtttgagaccacaatgcgaggcgctaaacgcatggccattctaggggacactgcatgggatttcggatccctcggcggtgtttttacctcaatcgggaaggccctgcaccaggtgttcggcgctatttacggagcggcatttagtggcgtaagctggacgatgaaaatccttataggggtcatcattacatggatcggaatgaactccagatctaccagcttgtcagtgagtctggttctcgtgggcgtcgtgactctgtatcttggtgccgtagtgcaggctgactccgggtgtgttgtcagctggaagaataaagaactgaagtgcggatctggcattttcatcacagataacgtgcacacctggactgagcagtacaagtttcaacccgaatcaccaagtaaattggccagcgcaatacagaaggcccatgaggaaggtatttgtggcatcaggtccgtgacccggctcgagaatctgatgtggaaacagattacacccgagttaaaccacatcccttctgaaaatgaggtcaagctgacgataatgaccggggacatcaaaggaattatgcaggctggcaagcgctcgctaagaccacaaccgactgaactcaaatatagctggaagacatgggggaaggccaaaatgctgtccaccgagtcacataaccagacattccttatcgatggacccgaaactgcagagtgccctaataccaacagggcgtggaatagtttggaggttgaagactacggctttggtgtgttcacgacaaacatttggctgaagctccgtgagaaacaggacgtgttttgtgattctaagctgatgagcgctgccatcaaagacaatcgggcagtacacgccgatatggggtattggatagaatccgctttaaacgacacctggaagatggagaaggcctcattcattgaggtcaaaagctgccactggccaaagtctcatactctgtggtccaatggagtgcttgaaagtgagatgatcatccccaaaaacttcgcaggccctgttagccagcacaactaccgaccaggttatcatacccaaacagctggcccctggcacttggggaagctcgaaatggattttgacttctgtgagggaactaccgtggtcgtgacagaagattgcggcaatagagggccgtctctgaggacgaccactgcctccggaaaactaattacagagtggtgctgtcgctcatgcaccctgcctccactccggtacagaggcgaggacggttgttggtacgggatggaaatcaggcccctgaaggagaaggaagagaaccttgttaatagtttggtgactgcgggacatggccagattgataactttagcctgggtgtattaggcatggccctcttcctggaagagatgcttcgcacacgaatagggaccaaacacgctatcctgttggtcgcagtgtcgtttgtgacgctcattactggaaatatgtccttccgggacctgggccgtgtcatggttatggtgggggccaccatgacagatgacatcggaatgggcgtaacctatctagctctgctcgccgcatttaaggtgagacctactttcgcggccggtctgcttttgaggaaactgacatctaaggagttaatgatggctaccattgggatcgccctcctgagccagtcaacaatacccgaaactatccttgagctgaccgatgcactagctctcggaatgatggtcctgaaaattgtgcgcaacatggaaaagtaccaattggccgttacgatcatggcaattagttgcgtgccaaatgccgtcatcctgcagaacgcttggaaggtgtcctgtacaatattagcggccgtttctgtgagccctctcctgcttacctcctcacagcagaaagcagactggattcccctggctttgactatcaagggcctcaatccaaccgccatctttctgacaactctaagccggaccagtaaaaagagatcttggccgctgaacgaggccattatggctgtcggcatggtatccatacttgcaagctcgctcctgaaaaatgacatccctatgacggggcccttggtggccggaggtctgttaacagtttgctatgtgctcaccggcaggtcagcggatctggaacttgagcgagctgccgacgtcaagtgggaggatcaagcagaaatttctgggagttccccaatcctgagcattactatctctgaggacggaagcatgtccataaaaaacgaagaggaggaacagacattgaccatcctcattcgcactggcctgctagtgatctcaggtgtattccccgtgagtattcctatcacagccgctgcatggtacctgtgggaggtcaagaagcagcgggccggggttctttgggatgtgccaagcccccctccggtggaaaaagcggagctcgaagacggagcttatagaataaagcagaggggcattctgggctactctcaaatcggggccggagtctataaagagggtacctttcacacgatgtggcatgtgactcgtggcgcagttttgatgcaccgcgggaagcggatcgagccatcctgggccgatgtaaaaaaggacttaatttcatacggaggcggttggaagctggaaggggagtggaaagaaggagaggaagtgcaggtcctcgctctggagcccggcaagaatcctagagccgtgcagaccaaaccaggcatcttcaagacaaacaccgggacaataggagcagttagtcttgattttagccccggtacttccggctctcctattgtggacaggaaagggaaggtcgtgggactgtacggcaatggtgtagtcacccgatcgggggcttatgtgagcgccatcgcgcagacggagaagtcaattgaagataacccggagatcgaagacgatatattccggaaaaagcgcttgacaattatggacctacatcccggagccggcaaaactaagagatacctgccagcaatcgttagggaggctatcaaacggggcctccgaaccctgattcttgcccctacaagagtggtcgctgcagaaatggaggaggccttacgcgggctgcccatcaggtatcaaaccccagccattaagactgaacacaccggacgtgagatagtggacctcatgtgtcatgctacattcacgatgcggttgctgtcccctgttagagtgcccaactacaatctcatcattatggatgaagcgcactttactgacccagcaagtatcgccgctaggggttatatctctacccgcgtcgagatgggcgaggccgcagggattttcatgacagccaccccgcctggaagccgagatccctttccacagtccaacgctcccataatggacgaagagagagaaatccctgagcggtcatggaattctggccacgaatgggtgactgatttcaagggtaaaacagtatggtttgtgccaagcattaaggcggggaacgacatcgccgcatgcctgaggaaaaatggaaagaaagttattcagcttagtcgcaagaccttcgattccgagtacgtcaagacgcgtgctaacgactgggattttgtggtgactacagacatcagcgagatgggcgccaatttcaaagcagaaagagtcatagatccccggaggtgtatgaagcctgtaatcctgaccgacggcgaggaacgcgtgattttggccgggccgatgccagttacccattcttcagctgcccaacgaagaggacggatcggtaggaaccccaaaaatgagaacgaccagtatatttacatgggcgaacctctagagaatgatgaggactgcgcgcactggaaggaagcaaaaatgctgctcgataacatcaatactcccgaggggataattccatccatgtttgaacctgagcgcgaaaaggtggacgccatcgatggagagtacagattaaggggcgaggctcggaaaacattcgtcgacctgatgcgtcgcggtgatcttcccgtgtggctggcctataaggttgctgcagaagggattaactacgccgaccgaaagtggtgttttgatggcatcaaaaataaccagatactcgaggaaaacatggaggtggagatctggaccaaggaaggagagagaaaaaagttgaaaccaaggtggctggacgctcggatttatagtgatcctctcgccctgaaggaattcaaggagttcgcagcgggccgcaaaagccttacactaaatctgatcactgaaatggggagattgccgacgtttatgacccagaaggccaggaacgctttagacaatctggccgtcctccatacagcagaggctggaggtcgggcctacaaccacgcactgtcggagcttcccgaaactctggagaccctcttgctgctaacactgctcgccaccgtgactggcgggattttcctttttctgatgtctggaaaaggcatcggtaagatgacgttagggatgtgctgcataattaccgcttccatcttgctgtggtatgcgcaaatccagccacactggattgccgcaagcatcatactcgaattctttctgattgtacttctgatccctgagcccgaaaaacagcgaacaccacaggataatcaactcacttacgtggttattgctatcttgaccgtcgtggccgccacaatggcaaacgagatgggcttcctggagaagaccaagaaagacttaggactaggctcaataactacacaggaaagtgagtctaatatcctggacattgatctcagacctgcttccgcctggacgctttatgcggtggctaccacttttgtcacacccatgctgcgccatagcatcgaaaactcaagtgttaatgtgagcttgaccgccattgcaaaccaggccaccgtactgatggggctcggaaagggttggccgctgtccaaaatggacatcggcgtgccacttctcgctattgggtgttactctcaggtcaatcctatcacactgactgcagccttgctgttactagtggcgcactacgctataattggacccggcctgcaagccaaggcaacgagggaggcccagaaacgggctgccgcaggtatcatgaagaacccaaccgttgatgggatcacagtgattgacctcgaacccataccttatgatccgaagttcgagaaacagcttggccaggtcatgctgttgatcctgtgcgtaactcaagtgctcatgatgcgtaccacatgggctctgtgtgaggcccttaccttagcgactggacccattagcacgctgtgggaaggcaatccagggagattttggaacacaaccatcgccgtttccatggcaaatattttcaggggatcatacctcgctggcgccggtttgctgttttctatcatgaagaacactaccagtacacgccgggggactggaaatataggcgagaccctaggtgaaaaatggaagtcgcgactgaacgcactcggcaaaagcgagttccagatctataagaaatccgggattcaggaggtggacagaacacttgctaaggaaggaatcaagaggggcgagacggatcatcacgccgtctctcgcgggtcagccaaactgcggtggtttgtggaaagaaacatggtcacccctgagggaaaggtggttgacttgggctgcggtcgtgggggatggagctactattgtggcggtctgaaaaatgtgagggaagtaaagggcctcactaaagggggacccggccatgaggagcctattccaatgtccacatacgggtggaacctggtgcggttacaaagtggagtcgatgttttcttcaccccccctgaaaagtgcgacactcttctgtgtgatatcggcgagtctagcccaaatcccacaatagaagcgggtcgcaccctccgagtgctaaacctggtcgagaattggttgaacaataacacgcagttttgcattaaggtgctgaatccgtatatgccttcagtaatcgaaaaaatggaggctctccagagacagtacgggggagcacttgtgaggaacccactgtcccggaatagtacccacgagatgtactgggttagcaacgccacaggcaatatcgtgtcttccgtcaacatgatttcacgcatgttgataaatagattcactatgaagcacaaaaaggctacctatgaacccgacgtggatctgggcagcgggacaaggaacatcggaattgagtcggaaatccctaacctcgacattatcggtaaacgaatagagaagatcaagcaagaacatgagatttcttggcactacgaccaggatcatccatataaaacttgggcctaccacggcagttatgagaccaagcagacagggtccgcaagctcaatggtcaatggagtggttcggttactgaccaaaccctgggacgtagtgccgatggtcactcagatggccatgacggatacaaccccttttggccaacagcgtgtgttcaaggaaaaagttgacactagaacccaggagcccaaggaaggtacaaagaaacttatgaagatcacggctgagtggctgtggaaagagctagggaagaaaaagaccccacgcatgtgtactagggaagagtttacaaaaaaggtgcggtccaacgcggccctcggagcaattttcaccgatgaaaataagtggaaatctgctagagaggccgtcgaagacggccgcttttgggagctggtggatagggagcgaaacttgcacctggaaggcaagtgcgagacttgtgtatacaatatgatggggaaacgggaaaagaaactcggagagttcggtagagcaaagggcagcagggccatctggtatatgtggcttggggctcgctttctggaattcgaggccttaggatttctgaacgaggaccattggttcagtcgtggcaattccttgagcggtgtggaaggggagggactccaccggctgggctacattctaagagatgttggcaagaaagaagggggagcgatgtacgcagacgatacagccggttgggacaccaggataacacttgaggacctgaagaacgaagagatggtcactaatcatatgaaaggcgagcacaagaaactcgctgaagccatctttaagctgacctatcagaacaaggtggtgcgcgtccaacgacctacgccccgggggaccgttatggatattatctctagaagggaccagcgcggatcaggccaggtgggtacatacgggttgaatactttcaccaacatggaggcacaactgatcagacagatggaaggagagggcattttcaaaagtatacagcatctcacagctactgaggaaatcgccgtacagaattggcttgctcgggtgggcagggagcgtctgtcccgaatggccattagcggggatgactgcgtcgtgaagccaatcgatgaccgctttgcatctgcgttaaccgccctgaacgatatgggaaaagttagaaaggacattcaacagtgggaaccctcgcggggttggaatgattggacgcaggtgcctttctgctcacaccactttcatgagttggtcatgaaagacggcagggtgctcgtagttccatgtcgcaaccaggatgaactgatcgggagagctcggataagccaaggagccggctggtccctaaaggagacagcatgccttggtaagagttatgctcagatgtggaccctgatgtacttccacaggcgagacctccgtctggccgcaaacgccatctgttctgcggtgccgagccattgggtccccacttccagaacaacctggtcaattcacgctaaacacgagtggatgactaccgaagatatgttggccgtgtggaatcgcgtgtggatccaggagaacccttggatggaagacaagacaccagtcgagagttgggaagaggttccctatttagggaaacgggaggaccagtggtgcggatctctgattggcctcacgagcagggcaacctgggccaagaatatccaaactgctataaaccaggtgagatcccttattggcaatgaagagtacacagattatatgccttcaatgaaacgctttcggagggaagaggaagaggccggggtactgtggtga

SEQ ID NO: 14497 - RNA, 9876 nt, synthetic construct
  misc_feature 1..9876: note = derived and/or modified CDS sequence (opt3) from DENV-2__FJ850067__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctacaagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatccgcggaattatgcaggctggcaaaagatcgctcaggcctcaaccaaccgaactgaagtatagctggaaaacttgggggaaggccaagatgctttccacagagtcacataaccagaccttcttgatcgatggaccggaaacagcagagtgccccaatactaaccgtgcgtggaatagtctggaggtcgaagactacggctttggtgttttcaccacgaacatttggctcaaactgcgggagaagcaggacgtgttttgtgattctaaattaatgagcgctgccatcaaggacaatcgagcagtgcacgccgatatggggtattggatagaatccgctctgaacgacacatggaaaatggagaaggcctcattcattgaggtaaagagctgccactggcctaaatctcataccctttggtccaatggagtcttggaaagtgagatgatcatcccaaagaacttcgcaggccccgtgagccagcacaactacagacctggttatcatactcaaaccgctggcccatggcacctcgggaaactggaaatggattttgacctatgtgagggaacaactgttgtggtcaccgaagattgcggcaatagggggccctctctgcgcacaacgaccgcctccggaaagctcattactgagtggtgctgtcggtcatgcacactgccgcctcttagatacaggggcgaggacggttgttggtacgggatggaaatccgcccattgaaagagaaggaagagaacctggtgaatagtttagttaccgcgggacatggccagattgataacttcagcctcggtgtgctgggcatggccctttttctggaagagatgttgcgaactcggatagggacaaagcacgctatcctcctggtagcagtctcgttcgtgaccctaattacgggaaatatgtcctttcgtgacctgggcagagtgatggtcatggttggggccactatgaccgatgacatcggaatgggcgtgacatatctcgctctgcttgccgcattcaaagtaaggcccacctttgcggccggtttgctgttacgcaagctcacttctaaagagctgatgatggctacaattgggatcgcccttctgagccagtcaaccatacctgaaacaatcctagagctcactgatgcactggctttgggaatgatggtgctgaagattgtccggaacatggaaaaataccaattagccgtgaccatcatggcaattagttgcgttcccaatgccgtgatcctccagaacgcttggaaggtctcctgtacgatactggcggccgtgtctgttagcccacttctgttgacatcctcacagcagaaggcagactggattcctctcgctctgaccatcaaaggcctaaatcccactgccatcttcctgaccacacttagcagaactagtaagaaaaggtcttggccactcaacgaggccattatggctgtgggcatggtctccatactggcaagctcgttgctgaagaatgacatcccgatgaccgggcctttagtagccggaggtctcctgacggtgtgctatgttcttacaggccgatcagcggatctggaattggagcgcgctgccgacgtgaaatgggaggatcaagcagaaatttctgggagttcccccatcctcagcattaccatctctgaggacggaagcatgtccataaagaacgaagaggaggaacagactctgacaatcctaattcggaccggcctgcttgtcatctcaggtgtgtttccagtaagtattcccatcactgccgctgcatggtacctctgggaggtgaaaaagcagagagccggggtcctgtgggatgttcctagcccaccccctgtggaaaaggcggagttggaagacggagcttataggataaaacagcgtggcattttaggctactctcaaatcggggccggagtgtataaggagggtacattccacaccatgtggcatgtcacgcgcggcgcagtgctgatgcaccgggggaaaagaatcgagccgtcctgggccgatgttaagaaagacctcatttcatacggaggcggttggaagctggaaggggagtggaaggaaggagaggaagtacaggtgcttgctctggagccaggcaaaaatcccagggccgtccagactaagcctggcatctttaaaaccaacacagggaccataggagcagtgagtttggatttcagcccaggtacatccggctctcccattgttgaccgaaaggggaaagtggtcggactatacggcaatggtgtggtaactcggtcgggggcttatgtcagcgccatcgcgcagaccgagaagtcaattgaagataaccctgagatcgaagacgatatatttcgcaagaaaagactgacgattatggacctccatccgggagccggcaagacaaaaaggtacctgcccgcaatcgtgcgggaggctatcaagcgaggccttagaactttaattctggccccaacccgcgttgtggctgcagaaatggaggaggccctcagggggttgcctatccgttatcaaacaaccgccattaaaactgaacacaccggacgggagatagtcgacctgatgtgtcatgctacattcacgatgagactcctgtcccccgtgagggttccaaactacaatcttatcattatggatgaagcgcacttcactgaccctgcaagtatcgccgctcgcggttatatctctacccgagtggagatgggcgaggccgcagggatttttatgacagccacccccccaggaagcagagatccgttccctcagtccaacgctcccataatggacgaagagcgggaaatcccagagaggtcatggaattctggccacgaatgggtcactgattttaagggtaagacagtgtggttcgtacccagcattaaagcggggaacgacatcgccgcatgcctgcgcaagaatggaaaaaaggtgattcagttgagtcgtaaaacctttgattccgagtacgttaagacgagagctaacgactgggatttcgtcgtgactacagacatcagcgagatgggcgccaattttaaggcagaacgggtgatagatcctaggcgctgtatgaaaccagtcatcctaaccgacggcgaggaacgagtaattctggccgggcccatgcctgtgacccattcttcagctgcccaaagacggggaaggatcggtcgcaacccgaagaatgagaacgaccagtatatttacatgggcgaaccactcgagaatgatgaggactgcgcgcactggaaagaagcaaagatgttactggataacatcaatactcccgaggggataattccttccatgttcgaacccgagagagaaaaagttgacgccatcgatggagagtacaggcttcggggcgaggctcgtaagacatttgtggacctgatgcgccgaggtgatctcccagtctggttggcctataaagtggctgcagaagggattaactacgccgacagaaagtggtgtttcgatggcatcaagaataaccagatactggaggaaaacatggaggttgagatctggaccaaagaaggagagaggaagaaactcaagcctcggtggctggacgctcgcatttatagtgatccccttgccctaaaagaatttaaggagttcgcagcgggcagaaagagcctgacattgaatttaatcactgaaatggggaggctgccaacgttcatgacccagaaagcccggaacgctctcgacaatctggccgtgcttcatacagcagaggctggaggtcgagcctacaaccacgcactgtcggagctccctgaaactttggagaccctgctactgctcacacttctggccaccgtcactggcgggatttttttattcttgatgtctggaaagggcatcggtaaaatgacgctggggatgtgctgcataattaccgcttccatcctcctgtggtatgcgcaaatccagccgcactggattgccgcaagcatcatacttgaatttttcctgattgtgctcttgatccccgagccagaaaagcagagaacacctcaggataatcaactgacttacgtagtgattgctatcttaaccgttgtcgccgccacaatggcaaacgagatgggctttctagagaaaaccaagaaggacctgggactcggctcaataactacacaggaaagtgagtctaatatccttgacattgatctgcgccccgcttccgcctggacgttgtatgcggtggctaccactctggtgacaccaatgctcaggcatagcatcgaaaactcaagtgtcaatgttagcctgaccgccattgcaaaccaggccaccgtgcttatggggctcggaaaaggttggcctctgtccaagatggacatcggcgtacccttgctggctattgggtgttactctcaggtgaatccgatcacattaactgcagccctactgctccttgtcgcgcactacgctataattggaccaggcctgcaagccaaagcaacgcgggaggcccagaagcgtgctgccgcaggtatcatgaaaaaccctaccgtggatgggatcacagttattgacttggaacccataccatatgatcccaagttcgagaagcagctgggccaggtgatgctcctgatcctttgcgtcactcaagtattaatgatgagaaccacatgggctctgtgtgaggccctcaccttggcgactggacctattagcacgctgtgggaaggcaatccggggaggttttggaacacaaccatcgccgtgtccatggcaaatattttccgcggatcatacctagctggcgccggtctgctcttttctatcatgaaaaacactaccaatacacggcgagggactggaaccataggcgagacacttggtgaaaagtggaaaagtagactgaacgcattgggcaagtcggagttccagatctataaaaagagcgggattcaggaggttgacaggacgctggctaaagaaggaatcaagcgcggcgagaccgatcatcacgccgtgtcccgggggtctgccaagctcagatggtttgtcgaacgtaacatggtgactcccgagggaaaagtcgtggacctgggctgcggtagggggggatggtcatactattgtggcggtttaaagaatgttcgggaagtgaaaggccttacaaaggggggaccaggccatgaggagcctattcccatgagcacctacgggtggaacctggtacgcctccaatccggagtggatgtcttctttactcctccagaaaaatgcgagacactactgtgtgacatcggcgaaagttctcccaatcctaccatagaggcgggtcgaacgttgagagttctgaacctcgtggaaaattggcttaacaataacacccagttctgcattaaggtcctgaatccatatatgcccagcgtgatcgagaagatggaggctttgcagaggaaatacgggggagcactggtacggaacccgctctcacgcaattccacacacgaaatgtactgggtgagtaacgccactggcaatatcgttagctctgtgaacatgatttccagaatgttaataaataggttcaccatgaagcacaaaaaggctacatatgagcctgatgtcgacctgggctcagggactcgaaacatcggaattgaaagcgagatcccaaaccttgatattatcggtaaacggatagaaaagatcaagcaggagcatgagacctcgtggcactacgaccaagaccatccctataaaacatgggcctaccacggctcttatgaaaccaagcagactgggagtgcatccagcatggtgaatggagtcgtgcgtctgctaacgaaaccttgggatgttgtaccaatggtgacacagatggccatgaccgacactaccccctttggccagcaaagagtcttcaaggagaaagtggatacacgcacgcaggaaccgaaggagggtaccaagaaactcatgaagattactgctgagtggctgtggaaagaattggggaagaaaaagacacctaggatgtgtacccgggaggaatttactagaaaagttcgctcaaacgcggccctgggagcaatcttcacagacgagaataagtggaagtccgctagggaagccgtggaggatggccgattttgggagctcgtcgaccgggaaagaaaccttcacctggagggcaaatgcgaaacctgtgtgtacaatatgatggggaagagggagaaaaagttaggagaattcggtaaagcaaagggctctcgcgccatttggtatatgtggctgggggctcgttttttggagttcgaggccctcggatttctgaacgaagatcattggttcagccggggcaatagtctatccggtgtagagggggaaggacttcacagactgggctacatcctcagggacgtgggcaagaaagaggggggagcgatgtacgcagatgacacagccggttgggatactcgcattaccctggaagacttgaagaacgaggagatggttacgaatcatatgaaaggcgaacacaagaaactggctgaggccatatttaagctcacctatcagaacaaggtcgtgcgagtgcagcggcccacaccaagagggactgtcatggacatcattagcaggcgcgatcaaagaggatctggccaggttggtacctacgggcttaatacattcactaacatggaagcacagctgatccggcaaatggagggagagggcatctttaaatcaattcagcatttaaccgctacggaagagatagccgtgcagaattggctggctagggtaggccgtgaacgattgagtcgcatggccatctccggggacgattgcgtggtcaagcctattgacgatagattcgcaagcgcgctcacagccctgaacgacatgggaaaaatccggaaggatattcagcaatgggagccctctaggggttggaatgactggacccaggtgccattctgctcgcaccactttcatgaactagttatgaaagatggccgcgtgcttgtcgtgccctgtagaaaccaggacgagctgatcgggcgggctaggatatcacagggagccggctggagcctcaaggagactgcatgcctgggtaagtcctatgctcaaatgtggacattgatgtacttccaccgacgtgatttaagactggccgcaaacgccatctgtagtgcggtaccttctcattgggttccaaccagccgcactacctggtccattcacgctaaacacgaatggatgacaacggaggacatgctcgccgtgtggaatcgggtctggatccaggaaaacccgtggatggaggataagacccccgtggaatcatgggaggaggtgccttatcttgggaaaagggaagaccagtggtgcggaagtctgattggcctaacttctagagcaacatgggccaagaatatccagaccgctataaaccaagtccgcagcctgattggcaatgaggaatacactgactatatgccatccatgaaacggtttaggcgagaggaagaggaggccggggttctctggtga

SEQ ID NO: 14498 - RNA, 9876 nt, synthetic construct
  misc_feature 1..9876: note = derived and/or modified CDS sequence (opt3) from DENV-2__FJ850060__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctacaagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggtcgaagactacggctttggtgttttcaccacgaacatttggctcaagctgcgtgagaaacaggacgtgttttgtgattctaagttaatgagcgctgccatcaaagacaatcgggcagtgcacgccgatatggggtattggatagaatccgctctgaacgacacatggaagatggagaaggcctcattcattgaggtaaaaagctgccactggcctaagtctcataccctttggtccaatggagtcttggaaagtgagatgatcatcccaaaaaacttcgcaggccccgtgagccagcacaactaccgacctggttatcatactcaaaccgctggcccatggcacctcgggaagctggaaatggattttgacctatgtgagggaacaactgttgtggtcaccgaagattgcggcaatagagggccctctctgaggacaacgaccgcctccggaaaactcattactgagtggtgctgtcgctcatgcacactgccgcctcttcggtacagaggcgaggacggttgttggtacgggatggaaatcaggccattgaaggagaaggaagagaacctggtgaatagtttagttaccgcgggacatggccagattgataacttcagcctcggtgtgctgggcatggccctttttctggaagagatgttgcgcactcgaatagggacaaaacacgctatcctcctggtagcagtctcgttcgtgaccctaattacgggaaatatgtcctttcgggacctgggccgtgtgatggtcatggttggggccactatgaccgatgacatcggaatgggcgtgacatatctcgctctgcttgccgcattcaagattagacccacctttgcggccggtttgctgttaaggaaactcacttctaaggagctgatgatggctacaatcgggatagcccttctgagccagtcaaccatccctgaaacaattctagagctcactgatgcactggctttgggaatgatggtactgaaaatcgtgcgcaacatggaaaagtaccaattagccgtcaccattatggcaatcagttgcgtgcccaatgccgttatactccagaacgcttggaaggtgtcctgtgcgattctggccgcagtctctgtgagcccacttctgttgacgtcctcacagcagaaagctgactggatccctctcgccctgacaatcaagggcctaaatcccaccgccattttcctgactacccttagccggacaagtaaaaagagatcttggccactcaacgaggctgttatggcagtgggcatggtctccatactggccagctcgttgctgaaaaatgacatcccgatgactgggcctttagtagcgggaggtctcctgaccgtgtgctatgttcttacgggcaggtcagctgatctggaattggagcgagccgcagacgtgaagtgggaggatcaagccgaaatttctgggagttcccccatcctcagcattacaatctctgaggacggaagcatgtccataaaaaacgaagaggaggaacagaccctgactatcctaattcgcacaggcctgcttgtcatctcaggtgtgtttccagtaagtattcccatcaccgctgcagcctggtacctctgggaggtgaagaagcagcgggcgggggtcctgtgggatgttcctagcccaccccctgtggaaaaagctgagttggaagacggagcctatagaataaagcagaggggcattttaggctactctcaaatcggggcaggagtgtataaagagggtactttccacacaatgtggcatgtcacccgtggcgccgtgctgatgcaccgcgggaagcggatcgagccgtcctgggctgatgttaaaaaggacctcatttcatacggaggcggttggaagctggaaggggagtggaaagaaggagaggaagtacaggtgcttgccctggagccaggcaagaatcccagagcagtccagacgaaacctggcatctttaagactaacaccgggacaataggagctgtgagtttggatttcagcccaggtacctccggctctcccattgttgacaggaaagggaaggtggtcggactatacggcaatggtgtggtaacacgatcgggggcctatgtcagcgcgatcgcccagactgagaagtcaattgaagataaccctgagatcgaagacgatatatttcggaaaaagcgcctgaccattatggacctccatccgggagcaggcaaaacgaagagatacctgcccgctatcgtgagggaggccatcaaacggggccttcgaacattaattctggctccaactagagttgtggcagccgaaatggaggaggccctccgcgggttgcctatcaggtatcaaacccccgctattaagacagaacacaccggacgtgagatagtcgacctgatgtgtcatgcgactttcaccatgcggctcctgtccccagtgagagttcctaactacaatcttatcattatggatgaagcacacttcacagaccccgccagtatcgctgccaggggttatatctctacgcgcgtggagatgggcgaggcagccgggatttttatgactgctaccccaccgggaagccgagatcctttcccccagtccaacgcgccaataatggacgaagagagagaaatccccgagcggtcatggaattctggccacgaatgggtcacagattttaagggtaaaaccgtgtggttcgtacctagcattaaggccgggaacgacatcgcagcttgcctgaggaaaaatggaaagaaagtgattcagttgagtcgcaagacttttgattccgagtacgttaagacacgtgccaacgactgggatttcgtcgtgaccacggacatcagcgagatgggcgcaaattttaaagccgaaagagtgatagatccacggaggtgtatgaagcccgtcatcctaactgacggcgaggaacgcgtaattctggctgggcctatgccggtgacacattcttcagccgcgcaacgaagaggacggatcggtaggaacccaaaaaatgagaacgaccagtatatttacatgggcgaacccctcgagaatgatgaggactgcgcacactggaaggaagccaaaatgttactggataacatcaatacccctgaggggataattccctccatgttcgaaccagagcgcgaaaaggttgacgctatcgatggagagtacagacttaggggcgaggcccggaaaacctttgtggacctgatgcgtcgcggtgatctccctgtctggttggcttataaggtggcagccgaagggattaactacgctgaccgaaagtggtgtttcgatggcatcagaaataaccagatactggaggaaaacatggaggttgagatctggactaaagaaggagagaggaagaaactcaagccccggtggctggacgcccgcatttatagtgatccacttgcactaaaagaatttaaggagttcgcggccggcagaaagagcctgacattgaatttaatcaccgaaatggggaaactgcctacattcatgactcagaaggctaggaacgccctcgacaatctggcagtgcttcatacggctgaggccggaggtcgggcatacaaccacgccctgtcggagctcccggaaaccttggagacactgctactgctcactcttctggctaccgtcacaggcgggatttttttattcttgatgtctggaaaaggcatcggtaagatgaccctggggatgtgctgcataattactgcgtccatcctcctgtggtatgcccaaatccagccccactggattgcagctagcatcatacttgaatttttcctgattgtgctcttgatcccagagcctgaaaaacagcgaacgccccaggataatcaactgacctacgtagtgattgccatcttaacagttgtcgccgcaactatggctaacgagatgggctttctagagaagaccaagaaagacctgggactcggctcaataacaacccaggaaagtgagtctaatatccttgacattgatctgagaccagcctccgcgtggactttgtatgctgtggccacaacgttcgtgacccctatgctgcgccatagcatcgaaaactcaagtgtcaatgttagcctcactgcaattgccaaccaggctacagtgctgatggggcttggaaagggttggcccctctccaaaatggacatcggcgtaccgctgttggcaattgggtgttactctcaggtgaatccaatcaccctgaccgccgcgttactactgctcgtcgctcactacgccataattggacctggccttcaagcaaaggccacaagggaggctcagaaacgggccgcagctggtatcatgaagaaccccactgtggatgggatcacggttattgacctggaaccaataccctatgatcctaagtttgagaaacagttgggccaggtgatgctgctcatcctgtgcgtcacccaagtacttatgatgcgtacaacttgggccttatgtgaggcgctgaccctcgccacaggaccgattagcaccttgtgggaaggcaatcccgggagattctggaacactacgatcgcagtgtccatggctaatatttttaggggatcatacctggccggcgcaggtctactgttctctatcatgaagaacacaaccaatactcgccgggggaccggaaacataggcgagacactcggtgaaaaatggaagagtcgacttaacgctctgggcaaatcggagtttcagatctataagaaaagcgggattcaggaggttgacagaactttggccaaggaaggaatcaagaggggcgagaccgatcatcacgccgtgtcccgcgggtctgcgaaactgcggtggttcgtcgaaagaaatatggtgacaccagagggaaaggtcgtggacctcggctgcggtcgtgggggatggtcatactattgtggcggtctgaaaaacgttagggaagtgaagggcttaacgaaagggggacctggccatgaggagcccattcctatgagcacctacgggtggaatcttgtacggctgcaatccggagtggatgtctttttcactccacccgaaaagtgcgacacactcctatgtgatatcggcgagagttctcctaacccaaccatagaagctggtcgcactctgcgagttttgaatctggtggagaactggctcaataacaatacacagttctgcattaaggtccttaacccctatatgccgagcgtgatcgaaaaaatggaggcactgcagagaaagtacgggggagccttggtaaggaatcctctgtcacggaactccacccacgagatgtactgggtgagtaatgctacgggcaacatcgttagctctgtgaatatgatttcccgcatgctcataaacagatttaccatgaaacacaagaaagccacatatgaaccagacgtcgatttaggctcagggactaggaacatcggaattgagagcgaaatccccaatctggacattatcggtaagcgaatagagaagatcaaacaggaacatgagacctcgtggcactacgaccaagatcatccttataagacatgggcataccacggctcttatgagactaaacagaccgggagtgcctccagcatggtgaacggagtcgtgcggcttctgacaaagccatgggacgttgtacccatggtgacccagatggctatgactgatacgacaccgttcggccagcaacgtgtctttaaagaaaaggtggacaccagaactcaggagcctaaggaaggtaccaaaaagctaatgaaaattacagcggagtggctctggaaggagctggggaaaaagaaaacgccccgcatgtgtaccagggaagagttcactcggaaggttagatcaaatgccgcattgggagctatctttacagatgaaaacaagtggaaatccgcccgcgaggcagtggaagacggcaggttctgggagctggtcgatcgagagcggaatctccaccttgaaggcaagtgcgagacctgtgtgtacaacatgatggggaaaagagaaaagaaactgggagagtttggtaaggccaagggctctagggctatttggtatatgtggttaggggcccgcttcctggaatttgaggcgttgggattcctcaatgaggaccattggtttagccgtggcaacagtctgtccggtgtagaaggggagggactacaccggcttggctacatcctgagagatgtgggcaaaaaggaagggggagcaatgtacgccgacgatactgctggttgggacacaaggattaccctcgaggacctgaaaaatgaagagatggttacaaaccatatgaagggcgagcacaaaaagttggccgaagcaatattcaagctgacttatcagaataaagtcgtgcgcgtgcagcgaccaacccctcgggggacggtcatggatatcattagcagaagggaccaacgcggatctggccaggttggtacctacgggctcaacacatttactaatatggaggctcagcttatcagacaaatggaaggagagggcatcttcaagtcaattcagcatctgaccgccacagaggaaatagctgtgcagaactggttagcccgggtaggcagggagcgtctgagtcgaatggcaatctccggggatgactgcgtggtcaaacccattgatgaccgcttcgcgagcgccttgactgctctcaatgatatgggaaaggtgagaaaagacatccagcaatgggaaccatctcggggttggaacgattggacccaggttcccttttgctcgcaccacttccatgagctggtgatgaaggacggcagggtcctagtggtaccttgtcgcaaccaggatgaacttattgggagagcccggatctcacagggagcaggctggagcctgaaggagacggcttgcctcggtaaatcctatgcccaaatgtggacactgatgtactttcacaggcgagacttgcgtttagcagccaatgcgatatgtagtgctgttccaccgcattgggtgcccacctctagaactacatggagcatccacgccaagcacgagtggatgaccactgaagatatgctggcagtctggaaccgcgtgtggattcaggggaatccttggatggaggacaaaaccccagtggaatcctgggaggaagtcccctatctcggaaagcgggaggaccagtggtgcggctcacttatcggcctgacaagtagggccacgtgggctaaaaacattcagaccgccatcaatcaagttagatctctaatagggaacgaggaatacactgattatatgcctagcatgaagcgcttccggagggaggaagaggaagcaggagtgctgtggtga

SEQ ID NO: 14499 - RNA, 9876 nt, synthetic construct
  misc_feature 1..9876: note = derived and/or modified CDS sequence (opt3) from DENV-2__FJ850061__SS-prME
  source 1..9876: mol_type = other RNA
accgccggcgtgatcattatgctgatacccacagctatggcattccacctcactacgcggaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtcctcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttatctgcaagcattctatggtggatagaggctggggtaacgggtgtggactattcggcaagggcgggattgtaacctgcgccatgtttacatgcaaaaagaatatggaaggaaaagtggtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtcaaagaaattgctgagactcagcacggcaccatcgtgattagagtacagtatgagggtgacgggtctccatgcaagatacccttcgaaatcacggatttggagaaaaggcatgttctcggccggctgattaccgtgaacccgatcgtcacagaaaaggactcccctgtgaacatcgaggccgaacccccatttggagatagctacattataatcggcgtcgagcctgggcagttaaaactgaattggttcaagaagggatcgtctattggtcaaatgtttgctactaccatgcgaggcgccaaacgcatggcaatcctaggggacacagcctgggatttcggatccctcggcggtgtgtttacttcaattgggaaggctctgcaccaggttttcggcgcgatctacggagcagcctttagtggcgtgagctggaccatgaaaatacttatcggggtaattatcacgtggattggaatgaactccagatctactagcttgtcagtcagtctggtgctcgttggcgtggtcaccctgtatcttggtgctatggtgcaggccgactccgggtgtgtagtgagctggaagaataaagagctgaagtgcggatctggcatcttcataactgataacgttcacacatggaccgaacagtacaagtttcaacccgagtcaccaagtaaattggcaagcgccattcagaaggctcatgaagagggtatctgtggcattaggtccgtcactcggctcgaaaatctgatgtggaaacagatcacccccgagttaaaccacatactgtctgagaatgaagtgaagctaacaatcatgacgggggacattaaaggaatcatgcaggccggcaagcgctcgctcagacctcaaccaaccgagctgaaatatagctggaagacttgggggaaggcaaaaatgctttccacagaatcacataaccagaccttcttgattgatggaccggagacagcggaatgccccaatactaacagggcttggaatagtctggaggtggaggactacggctttggtgtcttcaccacgaacatctggctcaagctgcgtgaaaaacaggacgtattttgtgattctaagttaatgagcgccgcaataaaagacaatcgggccgtgcacgctgatatggggtattggattgagtccgccctgaacgacacatggaagatggaaaaggcatcattcatcgaggtgaaaagctgccactggcctaagtctcataccctttggtccaatggagtattggagagtgaaatgatcattcccaagaatttcgctggccccgtcagccagcacaactaccgacctggttatcatactcaaaccgccggcccatggcacctcgggaagctggagatggattttgacctatgtgaaggaacaactgtggttgtgaccgaggattgcggcaatagagggccctctctgaggacaacgaccgcgtccggaaaactcatcactgaatggtgctgtcgctcatgcacactgccgcctcttcggtacagaggcgaggacggttgttggtacgggatggagattaggccattgaaggaaaaggaggaaaacctggtcaatagtttagtgaccgccggacatggccagatagataacttcagcctcggtgttctgggcatggctctttttctggaggaaatgttgcgcactcgaatcgggacaaaacacgcaattctcctggtggccgtatcgttcgtcaccctaatcacgggaaatatgtcctttcgggacctgggccgtgtgatggtgatggtcggggctactatgaccgatgacattggaatgggcgttacatatctcgccctgcttgcagcgttcaaggtgagacccacctttgccgctggtttgctgttaaggaaactcacttctaaggagctgatgatggccacaatcgggatagcacttctgagccagtcaaccatccctgagacaattctagaactcactgatgctctggccttgggaatgatggtactgaaaatcgtgcgcaacatggagaagtaccaattagcagtcaccattatggccatcagttgcgtgcccaatgctgttatactccagaacgcgtggaaggtgtcctgtacgattctggccgcagtctctgtgagcccacttctgttgacatcctcacagcagaaagctgactggatccctctcgccctgaccatcaagggcctaaatcccactgccattttcctgaccacacttagccggacaagtaaaaagagatcttggccactcaacgaagctataatggcagttggcatggtgtccatcctggccagctcgttgctgaaaaatgacattccgatgaccgggcctttagtcgcgggaggtctcctgacggtatgctatgtgcttacaggcaggtcagctgatctggagttggaacgagccgcagacgttaagtgggaggatcaagccgagatctctgggagttcccccattctcagcatcaccatatctgaagacggaagcatgtccatcaaaaacgaggaagaggagcagactctgacaattctaatccgcaccggcctgcttgtgatttcaggtgtctttccagtgagtatccccataactgctgcagcctggtacctctgggaagtaaagaagcagcgggcgggggtgctgtgggatgtccctagcccaccccctgttgagaaagctgaattggaggacggagcctatagaattaagcagaggggcatcttaggctactctcaaatcggggcaggagtgtataaagaaggtacattccacaccatgtggcatgtgacgcgtggcgccgtcctgatgcaccgcgggaagcggattgagccgtcctgggctgatgtgaaaaaggacctcatctcatacggaggcggttggaagctggagggggaatggaaagagggagaagaggttcaggtacttgccctggaaccaggcaagaatcccagagcagtgcagactaaacctggcatatttaagaccaacacagggaccattggagctgtcagtttggatttcagcccaggtacatccggctctcccatcgtggacaggaaagggaaggttgtgggactatacggcaatggtgtcgtgactcgatcgggggcctatgtaagcgcgattgcccagaccgagaagtcaatcgaggataaccctgaaatagaggacgatatttttcggaaaaagcgcctgacgatcatggacctccatccgggagcaggcaaaacaaagagatacctgcccgctatcgtcagggaagccattaaacggggccttcgaactttaatcctggctccaaccagagtggttgcagccgagatggaagaggccctccgcgggttgcctattaggtatcaaacacccgctataaagaccgagcacactggacgtgaaatcgtggacctgatgtgtcatgcgaccttcacaatgcggctcctgtccccagtcagagtgcctaactacaatcttattatcatggatgaggcacacttcacggaccccgccagtatcgctgccaggggttatatttctactcgcgttgaaatgggcgaggcagccgggatatttatgaccgctacaccaccgggaagccgagatcctttcccccagtccaacgcgccaatcatggacgaggaaagagagattcccgaacggtcatggaactctggccacgagtgggtgaccgattttaagggtaaaactgtctggttcgtgcctagcatcaaggccgggaacgacattgcagcttgcctgaggaaaaatggaaagaaagtaatccagttgagtcgcaagacatttgattccgaatacgtgaagacccgtgccaacgactgggatttcgttgtcacgactgacataagcgagatgggcgcaaattttaaagccgagagagtgatcgatccacggaggtgtatgaagcccgtgattctaacagacggcgaagaacgcgtcatcctggctgggcctatgccggtaacccattcttcagccgcgcaacgaagaggacggattggtaggaaccccaagaatgaaaacgaccagtatatctacatgggcgagcccctcgaaaatgatgaggactgcgcacactggaaggaggccaaaatgttactggataacataaatacccctgaagggattatcccctccatgttcgagccagaacgcgagaaggtggacgctattgatggagaatacagacttaggggcgaggcccggaaaacttttgttgacctgatgcgtcgcggtgatctccctgtgtggttggcttataaggtcgcagccgaggggatcaactacgctgaccgaaagtggtgtttcgatggcatcaagaataaccagatcctggaagagaacatggaagtggagatttggacaaaggagggagaaaggaaaaagctcaaacccagatggctggacgcccggatctatagtgatccacttgcactaaaggagtttaaggagttcgcggccggccgcaaaagcctgaccttgaatttaattacagagatggggagactgcctactttcatgacgcagaaggctaggaacgccctcgacaatctggcagttcttcataccgctgaagccggaggtcgggcatacaaccacgccctgtcggagctcccggagacattggaaactctgctactgctcacccttctggctacagtgaccggcgggatctttttattcttgatgtctggaaaaggcataggtaagatgactctggggatgtgctgcattatcacggcgtccatcctcctgtggtatgcccaaattcagccccactggatcgcagctagcataattcttgagtttttcctgatcgtcctcttgattccagaacctgagaaacagcgaaccccacaggataatcaactgacatacgtggtaatcgccatattaactgtggttgccgcaaccatggctaacgaaatgggctttctagagaagacaaagaaagacctgggactcggctcaatcaccactcaggagagtgaatctaatattcttgacatcgatctgagaccagcctccgcgtggacattgtatgctgtcgccacgaccttcgtgactcctatgctgcgccatagcattgagaactcaagtgtgaatgtcagcctcacagcaatcgccaaccaggctaccgttctgatggggcttggaaagggttggcccctctccaaaatggacattggcgtgccgctgttggcaatcgggtgttactctcaggtaaagccaataacctttacagccgcgctgttactactggtggctcactacgccattatcggacctggcctccaagcaaaagcccccagggaagctcagaagcgggccgcagctggtatcatgaagaatccaactgtcgatgggattacggtgatagaccttgagcccatcccttatgatccgaaattcgaaaagcagctgggccaggttatgttgctgattctctgcgtgacccaagtcctgatgatgcgtacaacttgggccctttgtgaggcgttaaccctggccacaggacccatcagcaccctctgggagggcaacccagggagattttggaatactacgattgcagtatccatggctaacatcttcaggggatcatacttggccggcgcaggtctgctattttctataatgaaaaatacaaccaacactcgccgggggaccggaaatatcggcgaaacactgggtgagaagtggaaaagtcgactcaacgctcttggcaagtcggagttccagatttataaaaagagcgggatccaggaggtggacagaactctggccaaggagggaattaaaaggggcgaaaccgatcatcacgccgtttcccgcgggtctgcgaagttgcggtggtttgtggagagaaacatggtcacacctgaaggaaaagtggtcgacctgggctgcggtcgtgggggatggtcatactattgtggcggtctcaagaatgtgagggaggttaaaggcctgacgaaagggggacccggccatgaagaacctatcccaatgagcacctacgggtggaacttagtgcggcttcaatccggagtagatgtgttcttcactccccctgagaagtgcgacacactgctctgtgatataggcgaaagttctccaaatcccaccattgaggctggtcgcactctacgagtcctgaacttggttgaaaattggctgaacaataacacacagttttgcatcaaagtgctcaatccgtatatgcctagcgtcatcgagaagatggaagcacttcagagaaaatacgggggagccctggtgaggaacccattgtcaagaaattccacccacgagatgtactgggtaagtaacgctacgggcaatattgtgagctctgttaacatgatatcccgcatgctgatcaatagattcaccatgaagcacaaaaaggccacatatgagcccgacgtggatctcggctcagggactaggaacattggaatcgaaagcgaggtccctaacttagacattatcggtaagcgaatagagaaaataaagcaggaacatgaaacctcgtggcactacgaccaagatcatccatataaaacatgggcataccacggctcttatgagactaagcagaccgggagtgcctccagcatggtgaatggagtcgtgcggctgcttacaaaaccctgggacgttgtaccgatggtgacccagatggctatgactgatacgacaccttttggccagcaacgtgtcttcaaggagaaggtggacaccagaactcaggaacccaaagagggtaccaagaaactgatgaagattacagcggaatggctatggaaagagctcgggaagaaaaagacgccacgcatgtgtaccagggaggaatttactcggaaggttagatcaaacgccgcactgggagctatcttcacagatgagaataaatggaagtccgcccgcgaagcagtggaggacggcaggttttgggaattggtcgatcgagagcggaacctgcacctcgagggcaaatgcgaaacctgtgtgtacaatatgatggggaagagagagaagaaacttggagagttcggtaaagccaaaggctctagggctatttggtatatgtggctgggggcccgctttttagagttcgaagcgctgggatttttgaacgaggaccattggttcagccgtggcaatagtctctccggtgtagagggggaaggactgcaccggctaggctacatccttagagatgtgggcaagaaagaagggggagcaatgtacgccgacgatactgctggttgggacacaaggattaccctggaagacctcaagaacgaggaaatggttacaaatcatatgaaaggcgagcacaagaagctggccgaggcaatatttaaattgacttatcagaacaaggtcgtgcgcgtgcagcgacctaccccacgggggacggtcatggatatcattagcagaagggaccaacgcggatctggccaggttggtacctacgggctgaatacattcactaacatggaagctcagctcatcagacaaatggagggagaaggcatcttcaaatcaattcagcatcttaccgccacagaggagatagctgtgcagaattggctggcccgggtaggcagggaacgtttaagtcgaatggcaatctccggggatgactgcgtggtcaagccaattgatgaccgctttgcgagcgccctgactgctttgaacgatatgggaaaagtgagaaaggacatccagcaatgggagccctctcggggttggaatgattggacccaggttcctttctgctcgcaccactttcatgaactcgtgatgaaggacggcagggtcctggtggtaccatgtcgcaaccaggatgagctaattgggagagcccggatctcacagggagcaggctggagccttaaagaaacggcttgcctgggtaagtcctatgcccaaatgtggacactcatgtacttccacaggcgagacctgcgtttggcagccaacgcgatatgtagtgctgttccgccccattgggtgcctacctctagaactacatggagcatccacgccaaacacgagtggatgaccactgaggatatgttagcagtctggaatcgcgtgtggattcaggaaaacccatggatggaggacaagacccccgtggaatcctgggaggaagtcccttatctggggaaacgggaggaccagtggtgcggatcactcatcggccttacaagtagggccacgtgggctaagaatattcagaccgccatcaaccaagttagatctctgataggcaatgaggaatacactgattatatgccaagcatgaagcgctttcggagggaggaagaggaagcaggggtgctatggtga

SEQ ID NO: 14500 - RNA, 9876 nt, synthetic construct
  misc_feature 1..9876: note = derived and/or modified CDS sequence (opt3) from DENV-2__FJ744709__SS-prME
  source 1..9876: mol_type = other RNA
accgccggagtgatcgtcatgctgattcccacggctatggcattccacctcactacgcggaatggggaacctcatatgatagttggaagacaggaaaagggtaaaagccttctgtttaagaccgaagacggcgtgaatatgtgcacattgatggccatcgatttaggggaactgtgtgaggacactattacctacaaatgcccactactccggcaaaacgaaccggaggatatcgactgttggtgcaattccacatctacctgggtgacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcagtgttggcctacaccatcggcacgactcactttcagaaggctctcattttcatcctgctgacagcagtcgccccatccatgaccatgcgctgcattgggatctctaacagagattttgtggaaggagtatcgggtggctcatgggttgacatagtgctcgagcacgggagctgtgtcactacaatggctaagaataaacccaccttagatttcgaactgattaagacggaggccaaacagcctgcgacccttaggaagtattgcatcgaagcaaaattgacaaacactaccacagagagtcggtgtccaactcaaggagagccctccctgaatgaagaacaggacaagcgctttatttgcaagcattctatggtggatcgaggctggggtaacgggtgtggactattcggcaaaggcgggatcgtgacctgcgccatgtttacatgcaagaaaaatatggaaggaaaggtcgttcagcctgagaacctcgaatacaccatcgtgattactccacacagcggtgaggagcatgctgtaggcaatgacacggggaaacacggaaaggaaataaaaatcacaccgcagtcctcaattaccgaggccgaactgactggctatggtaccgtgacaatggagtgtagtcccagaaccgggcttgatttcaacgaaatggtcctgttgcaaatggaggacaaggcatggctcgtgcacaggcagtggtttctggatttacctctgccatggctccccggcgctgacactcagggaagcaattggatccagaaggagacacttgttacgttcaaaaaccctcatgccaagaaacaagacgtggtcgtgctgggctctcaggaaggggcgatgcacaccgccttgactggagcaacagagatacagatgtcctcaggtaatctactgtttaccggccatctcaagtgccggctgcgtatggataaacttcaactgaaggggatgagctacagtatgtgtacaggaaagttcaaaattgtaaaggaaatcgctgagactcagcacggcaccatcgttattcgcgtgcagtatgagggtgacgggtctccatgcaaaatccccttcgaaattacggatttggagaagagacatgtcctcggcaggctgataaccgtgaacccgatcgtcacagaaaaagactcccctgtgaacattgaggccgaacccccatttggagatagctacatcatcattggcgttgagcctgggcagttaaagctgaattggttcaagaaaggatcgtctataggtcaaatgtttgagactaccatgcggggcgctaagcgaatggccatcctaggggacacagcatgggatttcggatccctcggcggtgtgtttacttcaattgggaaagccctgcaccaggtattcggcgctatctacggagcggcatttagtggcgtcagctggaccatgaagattcttatcggggtgataatcacgtggattggaatgaactcccgctctactagcttgtcagttagtctggtgctcgtcggcgtggtaaccctgtatcttggtgccgtggttcaggctgactccgggtgtgtcgtgagctggaaaaataaggaactgaagtgcggatctggcatcttcattactgataacgtgcacacatggaccgagcagtacaaatttcaacccgaatcaccaagtaagttggccagcgcaatccagaaagcccatgaggaaggtatatgtggcattagatccgtcactaggctcgagaatctgatgtggaagcagatcacccccgagttaaaccacattctgtctgaaaatgaggttaaactaacaatcatgacgggggacataaagggaatcatgcaggctggcaaacggtcgctccgccctcaaccaaccgaactgaagtatagctggaagacttgggggaaagccaagatgctttccacagagtcacataaccagaccttcttgattgatggaccggaaacagcagagtgccccaatactaacagagcgtggaatagtctggaggtggaagactacggctttggtgtgttcaccacgaacatctggctcaaactgagggagaagcaggacgtattttgtgattctaaattaatgagcgctgccattaaggacaatcgtgcagtccacgccgatatggggtattggatcgaatccgctctgaacgacacatggaagatggagaaagcctcattcatagaggtaaagagctgccactggcctaaatctcataccctttggtccaatggagttttggaaagtgagatgattatcccaaagaacttcgcaggccccgtgagccagcacaactaccggcctggttatcatactcaaaccgctggcccatggcacctcgggaaactggaaatggattttgacttctgtgagggaacaactgtcgtggttaccgaagattgcggcaatcgagggccctctctaagaacaacgaccgcctccggaaagctgatcactgagtggtgctgtaggtcatgcacactcccgcctctgcgctaccggggcgaggacggttgttggtacgggatggaaattagaccacttaaggagaaagaagagaacttggtgaatagtctggtaaccgcgggacatggccagatcgataactttagcttaggtgtcctcggcatggccctgttccttgaagagatgctgaggactcgcattgggacaaagcacgctatattgctcgtggcagtgtcgtttgtcaccctgatcacgggaaatatgtccttccgagacctaggccgggttatggtgatggtaggggccactatgaccgatgacattggaatgggcgtgacatatctggctctcctggccgcatttaaagtccgtcccaccttcgcggccggtcttttgctgagaaagttaacttctaaagagctcatgatggctacaatcgggattgccctgcttagccagtcaaccatccctgaaacaatactggagctaactgatgcactcgctctgggaatgatggtgttgaagatcgttaggaacatggaaaagtaccaactggccgtgaccattatggcaatcagttgcgtccccaatgccgtgattttacagaacgcttggaaagtttcctgtacgatcctcgcggccgtgtctgtcagcccactgcttctgacatcctcacagcagaaggcagactggatacctttggctctcaccattaaaggcctgaatcccactgccatctttctaaccacactgagccgcacaagtaagaaacggtcttggccacttaacgaggccatcatggctgtaggcatggtgtccattctcgcaagctcgctgttgaagaatgacataccgatgaccgggcctctggttgccggaggtttactcacggtgtgctatgtcctgacaggcagatcagcggatcttgaactggagagggctgccgacgtgaaatgggaggatcaagcagaaatctctgggagttcccccattttgagcatcaccatttctgaggacggaagcatgtccatcaagaacgaagaggaggaacagactctcacaatactgatccgaaccggcctactggtaatttcaggtatcttcccagtgagtattcccatcactgccgctgcatggtacctttgggaggtcaagaaacagcgcgccggggttctctgggatgtgcctagcccaccccctgtggaaaaggcggagctggaagacggagcttatcggataaaacagagaggcattttgggctactctcaaatcggggccggagtctataaggagggtacatttcacaccatgtggcatgtgacgaggggcgcagttttaatgcaccgtgggaaacgcatcgagccgtcctgggccgatgtaaagaaggacctgatttcatacggaggcggttggaaactcgaaggggagtggaaggaaggagaggaagtgcaggtcctggctcttgagccaggcaaaaatccccgggccgtgcagactaagcctggcatcttcaaaaccaacacagggaccataggagcagttagtctggattttagcccaggtacatccggctctcccattgtggacagaaaggggaaggtcgtgggattgtacggcaatggtgtagtcactaggtcgggggcttatgtgagcgccatcgcgcagaccgagaaatcaattgaagataaccctgagatcgaagacgatatattccgaaagaaacggctaacgattatggacctgcatccgggagccggcaagacaaaacgctacctccccgcaatcgttagagaggctatcaagaggggcctgcggactcttattttagccccaacccgagtggtcgctgcagaaatggaggaggccctgagagggctccctatccgctatcaaacacccgccattaagaccgaacacactggaagggagatagtggacttgatgtgtcatgctaccttcacaatgcgtctgctctccccagttcgggtgcctaactacaatctgatcattatggatgaagcgcactttacggaccccgcaagtatcgccgctagaggttatatctctactagggtcgagatgggcgaggccgcagggattttcatgaccgccacaccaccgggaagccgcgatccttttccccagtccaacgctccaataatggacgaagaacgagaaatccccgagagatcatggaactctggccacgaatgggtgaccgatttcaaaggtaagactgtatggtttgtgcctagcattaaagcggggaacgacatcgccgcatgccttcggaagaatggcaagaaggttattcagctgagtaggaagacattcgattccgagtacgtcaaaacccgcgctaacgactgggattttgtggtgacgactgacatcagcgagatgggcgccaatttcaaggcagaacgtgtcatagatccaagacggtgtatgaaacccgtaatcttgacagacggcgaggaaagggtgattctagccgggcctatgccggttacccattcttcagctgcccaacgccgaggaagaatcggtcggaacccaaagaatgagaacgaccagtatatttacatgggcgaacccctggagaatgatgaggactgcgcgcactggaaagaagcaaagatgctcttagataacatcaatacccctgaggggataattccctccatgtttgaaccagagagggaaaaagtggacgccatcgatggagagtaccgcctgagaggcgaggctaggaagactttcgtcgaccttatgcggcgtggtgatctgcctgtgtggctcgcctataaggttgctgcagaagggattaactacacagaccgcaaatggtgttttgatggcatcaagaataaccagatattggaggaaaacatggaggtggagatctggaccaaagaaggagagcgaaagaaactgaagcccagatggctcgacgccaggatttatagtgatccactggctcttaaggagttcaaagagttcgccgcaggcagaaagagcctaacactgaatttgatcactgaaatggggcgcttacctacgtttatgacccagaaagcgagaaacgccctggacaatctcgctgtcctgcatacagccgaggcaggaggtagggcttacaaccacgccctttcggagctgccggaaactctcgagaccttgctgctactgacactccttgcaaccgtgactggcgggattttcctgtttttaatgtctggaaagggcatcggtaaaatgacgttggggatgtgctgcataattaccgcctccatcctgctctggtatgctcaaatccagccccactggattgcggccagcatcatactggagttctttcttattgtactgctcatcccagagcctgaaaagcagcggacaccccaggataatcaattgacttacgtggttattgcaatcctgaccgtcgtggctgccacaatggccaacgagatgggcttcttagagaagaccaaaaaggacctaggactgggctcaataactacacaggaaagtgagtctaatatcctcgacattgatcttcgaccagcatccgcttggacgctgtatgccgtggcgaccacttttgtcacacctatgttgagacatagcatcgaaaactcaagtgttaatgtgagcctgaccgctattgccaaccaggcaaccgtactcatggggctgggaaaaggttggcccctttccaagatggacatcggcgtgccgctcctggccattgggtgttactctcaggtcaatccaatcacattgactgctgcactgttactactggtggcccactacgcgataattggacctggcctccaagctaaagccacgcgcgaggcacagaagagggccgctgccggtatcatgaagaaccccaccgttgatgggatcacagtgattgaccttgaaccaataccctatgatcctaaattcgagaagcagctgggccaggtcatgttgctgatcctctgcgtaactcaagtgctgatgatgcggaccacatgggcactttgtgaggctttaaccctggccactggaccgattagcacgctctgggaaggcaatcccgggcgtttttggaacacaaccatcgcggtttccatggccaatattttcagaggatcatacttggcaggcgctggtctgctattttctatcatgaaaaacactaccagtacaaggcgcgggactggaaatataggcgagaccctgggtgaaaagtggaaatcgcggctcaacgcccttggcaagagcgagttccagatctataaaaagtccgggattcaggaggtggaccgaacactggcaaaggaaggaatcaaaagaggcgagacggatcatcacgctgtctctagggggtcagccaagttgcgctggtttgtggaacggaacatggtcaccccagagggaaaagtggttgacctgggctgcggtagagggggatggagctactattgtggcggtctcaagaatgtgcgtgaagtaaaaggcctgactaaagggggacctggccatgaggagcccattcctatgtccacatacgggtggaacttagtgaggcttcaaagtggagtcgatgttttcttcaccccacccgaaaagtgcgacactctgctctgtgatatcggcgagtctagccctaatccaacaatagaagccggtcggaccctacgcgtgctgaacttggtcgagaattggctgaacaataacacgcagttttgcattaaagtgctcaatccctatatgccgtcagtaatcgaaaagatggaggcgcttcagcgacagtacgggggagctctggtgagaaaccctttgtccaggaatagtacccacgagatgtactgggttagcaacgcaacaggcaatatcgtgtcttccgtcaacatgatttcacggatgctgataaatcgcttcactatgaaacacaagaaagccacctatgaaccagacgtggatctcggcagcgggacaagaaacatcggaattgagtcggaaatccccaacttagacattatcggtaagaggatagagaagatcaaacaagaacatgagatttcttggcactacgaccaggatcatccttataagacttgggcttaccacggcagttatgagaccaaacagacagggtccgccagctcaatggtcaatggagtggttcgactgcttaccaagccatgggacgtagtgcccatggtcactcagatggcaatgacggatacaaccccgtttggccaacagcgggtgttcaaagaaaaggttgacactcgtacccaggagcctaaggaaggtaccaagaagctgatgaaaatcacggccgagtggctatggaaggagctcgggaggaaaaagacaccccgcatgtgtactagggaagagtttacacggaaagtgagatccaacgctgcgctgggagccattttcaccgatgaaaataagtggaagtctgcacgcgaggctgtcgaagacggcaggttttgggagttggtggatcgagagcggaacctgcacctcgaaggcaaatgcgagacttgtgtatacaatatgatggggaagagagagaagaaacttggagagttcggtaaagccaaaggcagcagggcaatctggtatatgtggctgggggcccgctttttagagttcgaggctctgggatttttgaacgaggaccattggttcagtcgtgaaaattccctcagcggcgtggagggtgaagggctgcaccggctaggatacattcttagagatgttggcaagaaagagggcggggccatgtacgcggacgatacagcaggatgggacaccaggataacactggaagacctcaagaacgaggagatggtcactaatcatatgaaaggtgaacacaagaaactggccgaggctatctttaagttgacctatcagaacaaggtggtgcgcgtccaacgaccaacgcctcggggcaccgttatggatattatctctagaagggaccagcgcgggtcaggacaggtgggcacatacggtctgaatactttcaccaacatggaagcccaactcatcagacagatggagggggagggaattttcaaaagtatacagcatcttacagcaactgaagagatcgctgtacagaattggctggcccgggtgggcagggaacgtttatcccgaatggctattagcggcgatgactgcgtcgtgaagcccatcgatgaccgctttgcctctgcactgaccgcgttgaacgatatggggaaagttagaaaggacattcaacagtgggagccatcgcggggatggaatgattggacacaggtgcccttctgctcacaccactttcatgaactcgtcatgaaagacggtagggtgctggtagttccttgtcgcaaccaggatgagctaatcggcagagcccggataagccaaggggctggatggtcccttaaggagacagcctgcctgggcaagagttatgcacagatgtggaccctcatgtacttccacaggcgagacctgcgtttggctgccaacgcaatctgttctgccgtgccaagccattgggtcccgacttccagaacaacctggtcaattcacgcgaaacacgaatggatgactaccgaggatatgttagctgtgtggaatcgcgtgtggatccaggaaaacccctggatggaggacaagacacctgtcgaaagttgggaggaggttccatatctgggtaaacgggaagaccagtggtgcgggtctctcattggacttacgagcagggccacctgggcaaagaatatccaaactgccataaaccaggtgagatccctgattggcaatgaggaatacacagattatatgccctcaatgaaacgctttcggagggaggaagaggaggctggcgtactatggtga

SEQ ID NO: 14501 - RNA, 9876 nt, synthetic construct
  misc_feature 1..9876: note = derived and/or modified CDS sequence (opt3) from DENV-2__FJ744708__SS-prME
  source 1..9876: mol_type = other RNA
accgcaggcgtgatagtaatgctgattcccacagctatggcattccacctcactacgagaaacggggaacctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatagaatccgctctgaacgacacatggaagatggagaaggcctcattcattgaggtcaaaagctgccactggcctaagtctcataccctttggtccaatggagtgttggaaagtgagatgatcatccccaagaatttcgcaggccccgttagccagcacaactaccgacctggttatcatactcaaaccgctggcccatggcacctcgggaagctggaaatggattttgacttctgtgagggaacaactgtggtcgtgaccgaagattgcggcaatagagggccctctctaaggacaacgaccgcctccggaaaactgattactgagtggtgctgtcgctcatgcacactcccgcctctgcggtacagaggcgaggacggttgttggtacgggatggaaatcaggccacttaaggagaaggaagagaacttggttaatagtctggtgaccgcgggacatggccagattgataactttagcttaggtgtactcggcatggccctgttccttgaagagatgctgcgcactcgaatagggacaaaacacgctatcttgctcgtcgcagtgtcgtttgtgaccctgattacgggaaatatgtccttccgggacctaggccgtgtcatggttatggtgggggccactatgaccgatgacatcggaatgggcgtaacatatctggctctcctggccgcatttaaggtgagacccaccttcgcggccggtcttttgctgaggaaattaacttctaaggagctcatgatggctacaattgggatcgccctgcttagccagtcaaccatacctgaaacaatcctggagctaactgatgcactcgctctgggaatgatggtcttgaaaattgtgcgcaacatggaaaagtaccaactggccgttaccatcatggcaattagttgcgtgcccaatgccgtcatcttacagaacgcttggaaggtgtcctgtacgatactcgcggccgtttctgtgagcccactgcttctgacatcctcacagcagaaagcagactggattcctttggctctcaccatcaagggcctgaatcccactgccatctttctaaccacactgagccggacaagtaaaaagagatcttggccacttaacgaggccattatggctgtcggcatggtatccatactcgcaagctcgctgttgaaaaatgacatcccgatgaccgggcctctggtggccggaggtttactcacggtttgctatgtgctgacaggcaggtcagcggatcttgaactggagcgagctgccgacgtcaagtgggaggatcaagcagaaatttctgggagttcccccatcttgagcattaccatctctgaggacggaagcatgtccatcaaaaacgaagaggaggaacagactctcacaatcctgattcgcaccggcctactggtgatctcaggtgtattcccagtgagtattcccatcactgccgctgcatggtacctttgggaggtcaagaagcagcgggccggggttctctgggatgtgcctagcccaccccctgtggaaaaagcggagctggaagacggagcttatagaataaagcagaggggcattttgggctactctcaaatcggggccggagtctataaagagggtacatttcacaccatgtggcatgtgacgcgtggcgcagttttaatgcaccgcgggaagcggatcgagccgtcctgggccgatgtcaaaaaggacctgatttcatacggaggcggttggaagctcgaaggggagtggaaagaaggagaggaagtgcaggtcctggctcttgagccaggcaagaatcccagagccgtgcagactaaacctggcatcttcaagaccaacacagggaccataggagcagttagtctggattttagcccaggtacatccggctctcccattgtggacaggaaagggaaggtcgtgggattgtacggcaatggtgtagtcactcgatcgggggcttatgtgagcgccatcgcgcagaccgagaagtcaattgaagataaccctgagatcgaagacgatatattccggaaaaagcgcctaacgattatggacctgcatccgggagccggcaaaacaaagagatacctccccgcaatcgttagggaggctatcaaacggggcctgcgaactcttattttagccccaaccagagtggtcgctgcagaaatggaggaggccctgcgcgggctccctatcaggtatcaaacacccgccattaagaccgaacacactggacgtgagatagtggacttgatgtgtcatgctaccttcacaatgcggctgctctccccagttagagtgcctaactacaatctgatcattatggatgaagcgcactttacggaccccgcaagtatcgccgctaggggttatatctctactcgcgtcgagatgggcgaggccgcagggattttcatgaccgccacaccaccgggaagccgagatccttttccccagtccaacgctccaataatggacgaagagagagaaatccccgagcggtcatggaactctggccacgaatgggtgaccgatttcaagggtaaaactgtatggtttgtgcctagcattaaggcggggaacgacatcgccgcatgccttaggaaaaatggaaagaaagttattcagctgagtcgcaagacattcgattccgagtacgtcaagacccgtgctaacgactgggattttgtggtgacgactgacatcagcgagatgggcgccaatttcaaagcagaaagagtcatagatccacggaggtgtatgaagcccgtaatcttgacagacggcgaggaacgcgtgattctagccgggcctatgccggttacccattcttcagctgcccaacgaagaggacggatcggtaggaaccccaaaaatgagaacgaccagtatatttacatgggcgaacccctggagaatgatgaggactgcgcgcactggaaggaagcaaaaatgctcttagataacatcaatacccctgaggggataattccctccatgtttgaaccagagcgcgaaaaggtggacgccatcgatggagagtacagactgaggggcgaggctcggaaaactttcgtcgaccttatgcgtcgcggtgatctgcctgtgtggctcgcctataaggttgctgcagaagggattaactacgccgaccgaaagtggtgttttgatggcatcaaaaataaccagatattggaggaaaacatggaggtggagatctggacaaaggaaggagagaggaaaaagctgaaacccagatggctcgacgctcggatttatagtgatccactggcccttaaggagttcaaggagttcgcagcgggccgcaaaagcctaaccctgaatttgatcacagaaatggggagattacctacttttatgacgcagaaggccaggaacgctctggacaatctcgccgtcctgcataccgcagaggctggaggtcgggcctacaaccacgcactttcggagctgccggaaacactcgagactttgctgctactgaccctccttgccacagtgaccggcgggattttcctgtttttaatgtctggaaaaggcatcggtaagatgactttggggatgtgctgcataattacggcttccatcctgctctggtatgcggaaatccaaccccactggattgccgcaagcatcatactggagttctttcttattgtactgctcatcccagaacctgagaaacagcgaaccccacaggataatcagttgacatacgtggttattgctatcctgactgtcgtggccgccaccatggcaaacgagatgggcttcttagaaaagacaaagaaagacctaggactgggctcaataaccactcaagagagtgaatctaatatcctcgacattgatcttagaccagcttccgcctggacactgtatgcggtggctacgacctttgtcactcctatgttgcgccatagcatcgagaactcaagtgttaatgtgagcctgacagccattgcaaaccaggccaccgtactcatggggctgggaaagggttggcccctttccaaaatggacatcggcgtgccgctcctggctattgggtgttactctcaggtcaatccaatcaccttgacagcagccctgttactactggtggcgcactacgctataattggacctggcctccaggccaaggcaactagggaagcccaaaaacgggctgccgcaggtatcatgaagaaccccacggttgatgggatcaccgtgattgaccttgagccaataccctatgatcctaagttcgagaaacagctgggccaggtcatgttgctgatcctctgcgtaacacaggtgctgatgatgcgtactacctgggctctttgtgaagccttaacactggcgaccggaccgattagcactctctgggagggcaatcccgggagattttggaacacgacaatcgccgtttccatggtgaatattttctcaggatcttacttggcaggcgctggtctgcatgtcccactaaggaagaacaccctgcgcactcggcgagggaccggaaatacaggcgaaactctcggtgagaaatggaagagtagacttaacgccctgggcaaatcggagtttcaaatctataagaaaagcgggatacaggaagtggacaggaccttggcaaaggagggaatcaagcgcggcgaaacagatcaccatgctgtctcccgggggtctgccaaactgagatggttcgtggagcgtaacatggttacgcctgaaggaaaggtggtagacctcggctgcggtagagggggatggtcatactattgtggcggtctgaaaaatgtgcgggaggtcaagggcttaaccaaagggggacccggccacgaggaacctattccaatgagcacttacgggtggaaccttgttcgcctgcagtccggagtggatgtctttttcacaccccctgagaagtgcgacaccctcctatgtgatatcggcgaaagttctccaaatcccactattgaggccggtcgaacactgagagtgttgaacctggtagaaaattggctcaacaataacacccaattctgcatcaaggtgcttaatccgtatatgcctagcgttatagagaaaatggaggcgctgcagaggcagtacgggggagctttggtgcggaacccactgtcacgcaattccacgcacgaaatgtactgggtcagtaacgcaaccggcaatattgtgagctctgtcaacatgatctccagaatgctcatcaataggtttacaatgaagcataaaaaggccacttatgagcccgacgtggatttaggctcagggacccgaaacattggaatagaaagcgagatccctaacctggacattatcggtaaacggattgaaaagatcaagcaggagcacgagatatcgtggcattacgaccaagatcacccatataaaacatgggcttaccacggctcttatgaaactaagcagaccgggagtgcctccagcatggttaatggagtagtgcgtcttctgacaaaaccctgggacgtcgtgccgatggttacccagatggcaatgactgatacgacacctttcggccagcaaagagtgtttaaggagaaagtcgacacccgcactcaggaacccaaggagggtaccaagaaactaatgaagatcacagccgagtggctctggaaagaactggggaagaaaaagacgccaaggatgtgtacccgggaggagttcactaaaaaggtgagatcaaacgctgcgttgggagccatttttacagatgagaataagtggaaatccgcacgcgaagctgtagaggacggcaggttctgggagctggtggatcgagaacggaacctccatcttgagggcaagtgcgaaacctgtgtttacaatatgatggggaaaagagagaagaaactgggagaatttggtaaggccaagggctctagggcaatctggtatatgtggttaggggcccgcttcctggagtttgaggctttgggattcctcaacgaagaccactggtttagccgtggcaatagtctgtccggtgtcgagggggaaggactacatcggcttggctacattctgagagatgtgggcaaaaaggaagggggagccatgtacgcggacgatactgcaggttgggacacaaggatcaccctcgaagacctgaaaaacgaggagatggtgacaaatcacatgaagggcgaacataaaaagttggccgaggctattttcaagctgacttatcagaacaaagtcgttcgcgtgcagcgacctaccccacgggggacggtaatggatataatcagcagaagggaccaacgcggatctggccaggtgggtacctacgggctcaatacatttactaacatggaagcccagcttattagacaaatggagggagagggcatcttcaagtcaatccagcacctgaccgcaacagaagagattgctgtccagaattggttagcccgggtgggcagggaacgtctgagtcgaatggctatatccggggatgactgcgttgtgaaaccaatcgatgaccgcttcgccagcgcattgactgcgctcaacgatatgggaaaggtcagaaaagacattcagcaatgggagccctctcggggttggaatgattggacccaggtgcctttttgctcgcaccatttccacgaactggtaatgaaggacggcagggttctagtggtcccatgtcgcaaccaggatgagcttatcgggagagcccggatttcacagggagctggctggagcctgaaggagacggcctgcctcggtaaatcctatgcacaaatgtggacactgatgtactttcataggcgagacttgcgtttagctgccaacgcaatctgtagtgccgtgccgtctcactgggtgcccaccagcagaactacatggtccatacacgcgaagcatgaatggatgaccactgaggatatgctggctgtctggaatcgcgtttggatccaggaaaacccttggatggaggacaaaaccccagtggaatcatgggaggaggtaccctatctcgggaagcgggaagaccagtggtgcggaagtcttattggcctgacatctagggccacgtgggccaaaaatatccagaccgccattaaccaagtgagaagcctaatcggcaatgaggaatacactgattatatgccttccatgaagcgcttccggagggaggaagaggaggctggggtcctgtggtga

SEQ ID NO: 14502 - RNA, 9876 nt, synthetic construct
  misc_feature 1..9876: note = derived and/or modified CDS sequence (opt3) from DENV-2__FJ810418__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttaaaactaccatgcgaggcgctaagcgcatggccattctaggggacacagcatgggatttcggatccctcggcggtgtttttacttcaatcgggaaagccctgcaccaggtgttcggcgctatttacggagcggcatttagtggcgtaagctggaccatgaagatccttataggggtcgtgatcacgtggattggaatgaactccagatctacaagcttgtcagttagtctggtgctcgtcggcgtggtaaccctgtatcttggtgccgtggttcaggctgactccgggtgtgtcgtgagctggaaaaataaggagctgaagtgcggatctggcatcttcattactgataacgtgcacacatggaccgaacagtacaaatttcaacccgagtcaccaagtaagttggccagcgcaatccagaaagcccatgaagagggtatatgtggcattaggtccgtcactcggctcgaaaatctgatgtggaagcagatcacccccgagttaaaccacattctgtctgagaatgaagttaaactaacaatcatgacgggggacataaagggaatcatgcaggctggcaaacgctcgctcagacctcaaccaaccgagctgaagtatagctggaagacttgggggaaagccaagatgctttccacagaatcacataaccagaccttcttgattgatggaccggagacagcagaatgccccaatactaacagggcgtggaatagtctggaggtggaggactacggctttggtgtgttcaccacgaacatctggctcaaactgcgtgaaaagcaggacgtattttgtgattctaaattaatgagcgctgccattaaggacaatcgggcagtccacgccgatatggggtattggatcgagtccgctctgaacgacacatggaagatggaaaaagcctcattcatagaggtgaagagctgccactggcctaaatctcataccctttggtccaatggagttttggagagtgaaatggtgattccaaagaacttcgcaggccccgtcagccagcacaactaccgacctggttatcatactcaaaccgctggcccatggcacctcgggaaactggagatggattttgacttctgtgaaggaacaactgtggttgtgaccgaggattgcggcaatagagggccctctctaaggacaacgaccgcctccggaaagctgatcactgaatggtgctgtcgctcatgcacactcccgcctctgcggtacagaggcgaggacggttgttggtacgggatggagatcaggccacttaaggaaaaagaggaaaacttggtaaatagtctggtcaccgcgggacatggccagattgataactttagcttaggtgtgctcggcatggccctgttccttgaggaaatgctgcgcactcgaatcgggacaaagcacgctattttgctcgtggcagtctcgtttgttaccctgataacgggaaatatgtccttccgggacctaggccgtgtgatggtaatggtgggggccactatgaccgatgacatcggaatgggcgtcacatatctggctctcctggccgcatttaaagtgagacccaccttcgcggccggtcttttgctgaggaagttaacttctaaagagctcatgatggctacaattgggatcgccctgcttagccagtcaaccattcctgagacaatcctggaactaactgatgcactcgctctgggaatgatggttttgaagatagtgcgcaacatggagaagtaccaactggccgtcaccatcatggcaattagttgcgtgcccaatgccgttatcttacagaacgcttggaaagtgtcctgtacgattctcgcggccgtctctgtaagcccactgcttctgacatcctcacagcagaaggcagactggatccctttggctctcaccataaaaggcctgaatcccactgccatttttctaaccacactgagccggactagtaagaaaagatcttggccacttaacgaagccatcatggctgtgggcatggtttccatcctcgcaagctcgctgttgaagaatgacattccgatgaccgggcctctggtggccggaggtttactcacggtctgctatgtgctgacaggcaggtcagcggatcttgagctggaacgagctgccgacgtaaaatgggaggatcaagcagagatatctgggagttcccccatcttgagcattaccatctctgaagacggaagcatgtccattaagaacgaggaagaggagcagactctcacaatcctgatacgcaccggcctactggtgatctcaggtgtcttcccagttagtattcccatcactgccgctgcatggtacctttgggaagtgaagaaacagcgggccggggtgctctgggatgtccctagcccaccccctgtggagaaggcggaactggaggacggagcttatagaattaaacagaggggcatcttgggctactctcaaataggggccggagtttataaggaaggtacatttcacaccatgtggcatgtaacgcgtggcgcagtgttaatgcaccgcgggaaacggattgagccgtcctgggccgatgtcaagaaggacctgatctcatacggaggcggttggaaactcgagggggaatggaaggagggagaagaggtgcaggttctggctcttgaaccaggcaaaaatcccagagccgtgcagactaagcctggcatcttcaaaaccaacacagggaccattggagcagtcagtctggattttagcccaggtacatccggctctcccatcgtggacaggaaggggaaggtagtcggattgtacggcaatggtgtggttactcgatcgggggcttatgtgagcgccatagcgcagaccgagaaatcaattgaggataaccctgaaatcgaggacgatattttccggaagaaacgcctaacgatcatggacctgcatccgggagccggcaagacaaaaagatacctccccgcaatagtcagggaagctattaagcggggcctgcgaactcttatcttagccccaaccagagtggttgctgcagagatggaagaggccctgcgcgggctccctatcaggtatcaaacacccgccattaagaccgagcacactggacgtgaaatcgtggacttgatgtgtcatgctaccttcacaatgcggctgctctccccagtcagagtgcctaactacaatctgattataatggatgaggcgcactttacggaccccgcaagtatcgccgctaggggttatatttctactcgcgtagaaatgggcgaggccgcagggatcttcatgaccgccacaccaccgggaagccgagatccttttccccagtccaacgctccaatcatggacgaggaaagagagattcccgaacggtcatggaattctggccacgagtgggtgaccgatttcaaaggtaagactgtttggtttgtccctagcataaaagcggggaacgacatcgccgcatgccttaggaagaatggaaaaaaggtgattcagctgagtcgcaagacattcgattccgaatacgtgaaaacccgtgctaacgactgggattttgtcgtaacgactgacatcagcgagatgggcgccaatttcaaggcagagagagtgattgatccacggaggtgtatgaaacccgttatcttgacagacggcgaagagcgcgtgatactagccgggcctatgccggtcacccattcttcagctgcccaacgaagaggacggatcggtaggaacccaaagaatgaaaacgaccagtatatttacatgggcgagcccctggaaaatgatgaggactgcgcgcactggaaagaggcaaagatgctcttagataacatcaatacccctgaagggattatcccctccatgtttgagccagaacgcgagaaagtggacgccatagatggagaatacagactgaggggcgaggctcggaagactttcgttgaccttatgcgtcgcggtgatctgcctgtgtggctcgcctataaggtcgctgcagaggggattaactacgccgaccgaaaatggtgttttgatggcatcaagaataaccagattttggaagagaacatggaagtggagatctggacaaaagagggagaaagaaagaaactgaagcccaggtggctcgacgctcggatatatagtgatccactggcccttaaggagttcaaagaattcgcagcgggccgcaagagcctaaccctgaatttgatcacagagatggggagattacctacttttatgacgcagaaagccaggaacgctctggacaatctcgccgtactgcataccgcagaagctggaggtcgggcctacaaccacgcactttcggagctgccggagacactcgaaactttgctgctactgaccctccttgccacagtgaccggcgggattttcctgtttttaatgtctggaaagggcatcggtaaaatgactttggggatgtgctgcattatcacggcttccatactgctctggtatgcgcaaattcagccccactggatcgccgcaagcatcattctggagttctttcttatcgttctgctcataccagaacctgagaagcagcgaaccccccaggataatcaattgacatacgtcgtgattgctatcctgactgtggtcgccgccaccatggcaaacgaaatgggcttcttagagaagacaaaaaaggacctaggactgggctcaattaccactcaggagagtgaatctaatatcctcgacatagatcttagaccagcttccgcctggacactgtatgcggttgctacgacctttgtgactcctatgttgcgccatagcatcgagaactcaagtgtaaatgtgagcctgacagccattgcaaaccaggccaccgtcctcatggggctgggaaaaggttggcccctttccaagatggacatcggcgtgccgctcctggctattgggtgttactctcaggttaatccaatcaccttgacagcagccctgttactactggtggcgcactacgctattatcggacctggcctccaagccaaagcaactagggaagcccagaagcgggctgccgcaggtataatgaagaaccccacggtcgatgggattaccgtaatcgaccttgagccaatcccctatgatcctaaattcgaaaagcagctgggccaggtgatgttgctgattctctgcgttacacaagtgctgatgatgcgtactacctgggctctttgtgaggccttaacactggcgaccggaccgataagcactctctgggagggcaatcccgggagattttggaacacgacaatcgccgtctccatggcaaatattttcaggggatcatacttggctggcgccggtctgctattttctatcatgaaaaacaccactagtacccgccgggggacaggaaatattggcgaaactctgggtgagaagtggaaatcgcgactcaacgcacttggcaagagcgaattccagatctataaaaagtccgggatacaggaggtggacagaaccctggctaaggagggaatcaaaaggggcgaaacagatcatcacgccgtctctcgcgggtcagccaagttgcggtggtttgtggagagaaacatggttacgccagaaggaaaagtggtagacctgggctgcggtcgtgggggatggagctactattgtggcggtctcaagaatgtgagggaggtcaaaggcctgaccaaggggggacctggccatgaagagcccattcctatgtccacttacgggtggaacttagttcggcttcaaagtggagtggatgtcttcttcacaccacccgagaagtgcgacaccctgctctgtgatatcggcgaatctagccctaatccaactattgaggcgggtcgcacactacgagtgctgaacttggtagaaaattggctgaacaataacacccagttttgcatcaaagtgctcaatccctatatgccgtcagttatagagaagatggaagctcttcagagacagtacgggggagcactggtgaggaaccctttgtcccggaatagtacgcacgagatgtactgggtcagcaacgccaccggcaatattgtgtcttccgtcaacatgatctcacgcatgctgatcaatagattcacaatgaaacacaagaaagctacttatgagccagacgtggatctcggcagcgggaccaggaacattggaatagaatcggagatccccaacttagacattatcggtaagcgaattgaaaagatcaaacaagagcatgaaatatcttggcactacgaccaggatcatccttataagacatgggcctaccacggcagttatgagactaaacagaccgggtccgcaagctcaatggttaatggagtagtgcggctgcttacaaagccatgggacgtcgtgcccatggttacccagatggccatgactgatacgacaccgtttggccaacagcgtgtgttcaaagagaaggtcgacaccagaactcaggaacctaaggagggtaccaaaaagctgatgaaaatcacagctgaatggctatggaaggagctcgggaaaaagaaaacgccccgcatgtgtaccagggtggagtttactaagaaggtacggtccaacgcggccctgggagcaattttcacagatgaaaataaatggaagtctgctagagaggccgtggaagacggccgcttttgggagttggttgatagggaacgaaacctgcacctcgagggcaaatgcgagacctgtgtctacaatatgatggggaagcgggaaaaaaagcttggagagttcggtaaggcaaaaggcagcagagccatctggtatatgtggctgggggctaggtttttagaattcgaggccctgggatttttgaacgaagaccattggttcagtcgcggcaattccctcagcggtgtggagggggagggactgcaccgtctaggctacattcttcgggatgtgggcaagaaagaagggggagcgatgtacgcagacgatactgccggttgggacacaagaatcaccctggaggacctcaagaacgaagagatggtcacaaatcatatgaaaggcgaacacaagaagctggctgaggccatttttaaattgacttatcagaacaaggttgtgagggtacaacgcccaacccctcgagggacggtgatggatataatctctcggagagaccagaggggatcaggccaggtcggtacctacgggctgaatacattcactaacatggaggcacaactcattcgccagatggaaggagagggcatcttcaaaagtatccagcatcttaccgctacagaagagattgccgtgcagaattggctggctagagttggccgggagaggttatcccgtatggccataagcggggatgactgcgtggtcaagcccatcgatgaccgatttgcatctgcgctgactgccttgaacgatatgggaaaagtgcgcaaggacattcaacagtgggaaccatcgagaggttggaatgattggacccaggtacccttctgctcacaccactttcatgagctcgttatgaaggacggccgggtgctggtcgtgccttgtaggaaccaggatgaactaatcgggcgcgctagaattagccaaggagccggctggtcccttaaagagacggcatgcctgggtaagagttatgctcagatgtggacactcatgtacttccaccggagggacctgcgattggccgcaaacgccatctgttctgcggtgccaagccattgggtcccgacctcccgtactacatggtcaatacacgctaaacacgaatggatgaccactgaggatatgttagccgtttggaatagagtgtggatccaggagaacccctggatggaagacaagacccctgtagagagttgggaagaggtgccatatctggggaaacgcgaagaccagtggtgcggatctctcattggccttacaagccgggcaacgtgggccaagaatatccaaaccgctattaaccaggtcaggtccctgatcggcaatgaggagtacactgattatatgccctcaatgaagagatttcgccgggaagaggaagaggccggggtgctatggtga

SEQ ID NO: 14503 - RNA, 9876 nt, synthetic construct
  misc_feature 1..9876: note = derived and/or modified CDS sequence (opt3) from DENV-2__FJ639835__SS-prME
  source 1..9876: mol_type = other RNA
accgccggcgtgatcgtcatgctgattccaacagctatggctttccacctcactacgagaaacggggaacctcatatgatagttggaaggcaggaaaagggtaaaagccttctgtttaagaccgaagacggcgtgaatatgtgcacattgatggccatcgatttaggggaactgtgtgaagacactattacctacaaatgcccactactccggcaaaacgaaccggaagatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatagaatccgctctgaacgacacatggaagatggagaaggcctcattcattgaggtcaaaagctgccactggcctaagtctcataccctttggtccaatggagtgttggaaagtgagatggttatccccaagaatttcgcaggccccgtgagccagcacaactaccgacctggttatcatactcaaaccgctggcccatggcacctcgggaagctggaaatggattttgacttctgtgagggaacaactgtcgtggttaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaattaggccacttaaggagaaggaagagaacttggtgaatagtctggtaaccgcgggacatggccagatcgataactttagcttaggtgtcctcggcatggccctgttccttgaagagatgctgcgcactcgaattgggacaaaacacgctatattgctcgtggcagtgtcgtttgtcaccctgatcacgggaaatatgtccttccgggacctaggccgtgttatggtgatggtaggggccactatgaccgatgacattggaatgggcgtgacatatctggctctcctggccgcatttaaggtcagacccaccttcgcggccggtcttttgctgaggaaattaacttctaaggagctcatgatggctacaatcgggattgccctgcttagccagtcaaccatccctgaaacaatactggagctaactgatgcactcgctctgggaatgatggtgttgaaaatcgttcgcaacatggaaaagtaccaactggccgtgaccattatggcaatcagttgcgtccccaatgccgtgattttacagaacgcttggaaggtttcctgtacgatcctcgcggccgtgtctgtcagcccactgcttctgacatcctcacagcagaaagcagactggatacctttggctctcaccattaagggcctgaatcccactgccatctttctaaccacactgagccggacaagtaaaaagagatcttggccacttaacgaggccatcatggctgtaggcatggtgtccattctcgcaagctcgctgttgaaaaatgacataccgatgaccgggcctctggttgccggaggtttactcacggtgtgctatgtcctgacaggcaggtcagcggatcttgaactggagcgagctgccgacgtgaagtgggaggatcaagcagaaatctctgggagttcccccattttgagcatcaccatttctgaggacggaagcatgtccatcaaaaacgaagaggaggaacagactctcacaatactgatccgcaccggcctactggtaatttcaggtgtgttcccagtcagtatccccattactgccgctgcatggtacctttgggaggttaagaagcagcgggccggggtgctctgggatgtgcctagcccaccccctgtcgaaaaagcggagctggaagacggagcttatagaatcaagcagaggggcatattgggctactctcaaattggggccggagtgtataaagagggtacatttcacaccatgtggcatgttacgcgtggcgcagtattaatgcaccgcgggaagcggatcgagccgtcctgggccgatgtgaaaaaggacctgatctcatacggaggcggttggaagctcgaaggggagtggaaagaaggagaggaagtccaggtgctggctcttgagccaggcaagaatcccagagccgttcagactaaacctggcattttcaagaccaacacagggaccatcggagcagtgagtctggattttagcccaggtacatccggctctcccatagtcgacaggaaagggaaggtggtaggattgtacggcaatggtgtcgtgactcgatcgggggcttatgttagcgccattgcgcagaccgagaagtcaatcgaagataaccctgagattgaagacgatatcttccggaaaaagcgcctaacgataatggacctgcatccgggagccggcaaaacaaagagatacctccccgcaattgtgagggaggctatcaaacggggcctgcgaactcttatcttagccccaaccagagtcgtggctgcagaaatggaggaggccctgcgcgggctccctattaggtatcaaacacccgccatcaagaccgaacacactggacgtgagattgttgacttgatgtgtcatgctaccttcacaatgcggctgctctccccagtgagagtccctaactacaatctgataatcatggatgaagcgcactttacggaccccgcaagtattgccgctaggggttatatctctactcgcgtggagatgggcgaggccgcagggatcttcatgaccgccacaccaccgggaagccgagatccttttccccagtccaacgctccaattatggacgaagagagagaaatacccgagcggtcatggaactctggccacgaatgggtaaccgatttcaagggtaaaactgtgtggtttgttcctagcatcaaggcggggaacgacattgccgcatgccttaggaaaaatggaaagaaagtcatccagctgagtcgcaagacattcgattccgagtacgtgaagacccgtgctaacgactgggattttgtggtcacgactgacattagcgagatgggcgccaatttcaaagcagaaagagtaatcgatccacggaggtgtatgaagcccgtgatattgacagacggcgaggaacgcgttatcctagccgggcctatgccggtgacccattcttcagctgcccaacgaagaggacggattggtaggaaccccaagaatgagaacgaccagtatatctacatgggcgaacccctggagaatgatgaggactgcgcgcactggaaggaagcaaaaatgctcttagataacattaatacccctgaggggatcataccctccatgtttgaaccagagcgcgaaaaggtcgacgccattgatggagagtacagactgaggggcgaggctcggaaaactttcgtggaccttatgcgtcgcggtgatctgcctgtttggctcgcctataaggtggctgcagaagggatcaactacgccgaccgaaagtggtgttttgatggcattaaaaataaccagatcttggaggaaaacatggaggtcgagatatggacaaaggaaggagagaggaaaaagctgaaacccagatggctcgacgctcggatctatagtgatccactggcccttaaggagttcaaggagttcgcagcgggccgcaaaagcctaaccctgaatttgattacagaaatggggagattacctacttttatgacgcagaaggccaggaacgctctggacaatctcgccgtgctgcataccgcagaggctggaggtcgggcctacaaccacgcactttcggagctgccggaaacactcgagactttgctgctactgaccctccttgccacagtaaccggcgggatcttcctgtttttaatgtctggaaaatccattggcaagatgactttgggtatgtgctgcatcataacggctagcattctgctctggcacgcgcaaatccagccccattggatcgccgcatcaattatcctggagttctttcttatagtgctgctcattccagagcctgaaaaacagcgaaccccacaggataatcaattgacatatgttgtcatcgctattctgactgtggtggccgccaccatggcaaacgagatggggttcttagagaagacaaagaaagacctaggcctgggaagtatcaccactcaggaatctgagtccaatatactcgacatcgatcttagaccagctagcgcctggacactgtacgcggtcgctacgacctttgttactcctatgttgcgccactcaattgaaaacagtagcgtgaatgtatccctgacagccatcgcaaaccaggccaccgtgctcatgggcctggggaagggatggcccctttctaaaatggacattggtgtcccgctcctggctatcggctgttatagccaggtgaatccaattaccttgacagcagccctgttactactggttgcgcattacgctatcatagggcctggactccaagccaaggcaactagggaggcccagaaacgggctgccgcaggcattatgaagaaccccacggtggatggtatcaccgtcatcgaccttgaaccaattccctacgatcctaagttcgagaaacagctggggcaggtaatgttgctgatactctgcgtgacacaagttctgatgatgcgtactacctgggctctttgtgaggccttaacactggcgaccggcccgatctccactctctgggaaggaaatcccggcagattttggaacacgacaattgccgtgtcaatggcaaatatcttcagggggtcttatttggctggagccggcctgctatttagtattatgaagaacaccacttcgacccgccggggtacagggaatatcggagagactctgggcgaaaaatggaaaagccgactcaacgcacttggtaaatccgagttccagatatacaagaaatctggcatccaggaggtcgacagaaccctggctaaggaagggattaagaggggagagacagatcaccatgccgtgtcacgcggcagcgccaaattgcggtggtttgtcgaaagaaacatggtgacgccagaggggaaggttgtggacctgggatgcggccgtggtgggtggtcctattactgtggaggcctcaaaaatgtaagggaagtgaagggtctgaccaaaggcgggcctggacacgaggagcccatccctatgagtacttatggctggaacttagtccggcttcaatctggggttgatgtgttcttcacaccacccgaaaagtgcgacaccctgctctgtgatattggagagagctcacctaatccaactatcgaagcgggccgcacactacgagtcctgaacttggtggagaattggctgaacaataacacccagttttgcataaaggtactcaatccctacatgccgtccgtgattgagaagatggaggcacttcagagacagtatggtggggcactggttaggaaccctttgagtcggaatagcacgcacgagatgtactgggtgtctaacgccaccggaaatatcgtctcctcagtgaacatgatcagccgcatgctgattaatagattcacaatgaagcataaaaaggctacttacgaaccagacgtcgatctcggctcgggcaccaggaacatagggatcgagaacgaaattcccaatttagacatcattggaaaacgaatcgagaagataaagcaagaacacgagatctcttggcattatgaccaggatcacccttacaaaacatgggcctatcacggtagttacgagactaagcagaccggctccgcaagctcaatggtgaacggggttgtacggctgcttacaaaaccatgggacgtggtccccatggtgacccagatggccatgactgatacgacaccgtttggacaacagcgtgttttcaaggaaaaagtggacaccagaactcaggagcctaaggaaggcaccaagaaactgatgaagattacagctgagtggctatggaaagagctcggtaagaaaaagacgccccgcatgtgtaccagggaagagtttactcggaaagtcagatccaatgcggccctgggggcaatcttcacagatgaaaacaagtggaagtctgctcgcgaggccgtggaagacggaaggttttgggagttggtagatcgagagcggaatctgcatctcgaaggcaaatgcgagacctgtgtgtataacatgatgggcaagagagagaagaaacttggggagttcggaaaagcaaaaggtagcagggccatttggtacatgtggctgggcgctcgctttttagagttcgaggccctggggtttttgaatgaggaccactggttcagtcgtggaaactccctcagcggcgttgaaggtgaggggctgcatcggctaggatatatccttagagatgtcggcaagaaagaaggcggggcgatgtacgcagacgatactgccggatgggacacaaggattaccctggaggacctcaagaatgaagagatggtgacaaaccacatgaaaggtgagcataagaaactggctgaagccatatttaagttgacttaccagaataaggtggtccgcgttcaacgaccaacccctcggggcacggtgatggatatcatttctagaagggaccagcgcgggtcaggacaggtaggcacctatggtctgaacacattcactaatatggaggcacaactcatcagacagatggaaggggagggaatcttcaaaagtattcagcaccttaccgctacagaggaaatagccgtgcagaactggctggctcgggtcggcagggagcgtttatcccgaatggccatcagcggcgatgactgcgtggttaagcccattgatgaccgctttgcatctgcgctgactgccttgaatgatatggggaaagtgagaaaggacatccaacagtgggaaccatcgcggggatggaacgattggacccaggtccccttctgctcacaccattttcacgagctcgtgatgaaagacggtagggtactggttgtgccttgtcgcaaccaggatgaactaattggcagagctcggatcagccaaggggccggatggtcccttaaggagacggcatgcctgggcaagagttacgctcagatgtggacactcatgtatttccataggcgagacctgcgtttggccgcaaatgccatatgttctgcggtcccaagccactgggtgccgacctccagaactacatggtcaatccacgctaaacatgagtggatgaccactgaagatatgttagccgtgtggaaccgcgtctggattcaggagaatccctggatggaagacaagacccctgttgagagttgggaagaggtgccatacctgggtaaacgggaggaccagtggtgcgggtctctcatcggacttacaagcagggcaacgtgggccaagaacattcaaaccgctatcaatcaggtaagatccctgataggcaacgaagagtatactgattacatgccctcaatgaaacgctttcggagggaagaggaagaggccggcgtgctatggtga

SEQ ID NO: 14504 - RNA, 9876 nt, synthetic construct
  misc_feature 1..9876: note = derived and/or modified CDS sequence (opt3) from DENV-2__FJ850050__SS-prME
  source 1..9876: mol_type = other RNA
acagcaggcgtgatcgtaatgctgattcccacagctatggcattccacctcactacgaggaacggggaacctcatatgatagttggaaggcaggaaaagggtaagagccttctgtttaagaccgaggacggcgtgaatatgtgcacattgatggcaatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggcagcaatcttggcatacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggaggtacagagattcagatgtcctcaggcaatctactgtttaccgggcatctcaaatgccgtctgcgcatggataaacttcaactgaaaggaatgagctacagtatgtgtacaggcaagttcaagatcgtgaaagaaatcgcagagactcagcacggtaccattgtaatcagagttcagtatgagggggacggctctccatgcaagattcccttcgaaataacggatttggagaaaaggcatgtgctcggacggctgatcaccgtcaacccgattgtgacagaaaaggactcccctgtcaacatcgaggctgaacccccatttggcgatagctacatcattataggggtggagcctggacagttaaaactgaattggttcaagaagggttcgtctatcggccaaatgtttgagactaccatgcgaggggccaaacgcatggctattctaggagacacagcctgggatttcggctccctcggtggggtttttacttcaatcggcaaggcactgcaccaggtgttcggagccatttacggcgctgcgtttagtggggtaagctggaccatgaaaatccttataggagtcatcattacgtggatcggcatgaactccagatctaccagcttgtcagtgagtctggttctcgtgggtgtcgtgaccctgtatcttggggcagtagtgcaggccgactccggatgtgttgtcagctggaagaataaagaactgaagtgcggctctggtattttcatcactgataacgtgcacacatggaccgagcagtacaagtttcaacccgaatcaccaagtaaattggctagcgccatacagaaggcacatgaggaaggcatttgtgggatcaggtccgtgactcggctcgagaatctgatgtggaaacagattacccccgagttaaaccacatcctgtctgaaaatgaggtcaagctaacaataatgacgggagacatcaaaggcattatgcaggccgggaagcgctcgctcagacctcaaccaaccgaactgaaatatagctggaagacttggggaaaggctaaaatgctttccacagagtcacataaccagaccttcttgatcgatggcccggaaacagccgagtgccccaatactaacagggcatggaatagtctggaggttgaagactacggttttggggtgttcaccacgaacatttggctcaagctgcgtgagaaacaggacgtgttttgtgattctaagttaatgagcgcggctatcaaatataatcgggccgtacacgcagacatgggatactggatagaatccgccccttgcgattcatgggagatgcagaaggctagcttcattgaggtcatctcttgtcactggccaaagtccctgacactttggagtaacggcgtgttggaaagcgagatgatcattcccaaaaatttcgccggtcctgtttctcaacataactatcgaccaggctaccacacccagactgcagggccctggcatctcggaaagctggaaatggactttgatttctgcgagggcaccacagtggtcgtgactgaagactgcgggaacagaggaccgtccctaaggaccacaacggcttcaggcaaactgatcaccgagtggtgttgccgcagttgtactctccctccactgcggtacagaggtgaggatgggtgctggtatggaatggaaattaggccccttaaggagaaagaagagaatttggttaacagcctggtgacagccggccacggtcagatagacaatttttcgttaggcgtactcgggatggcgctgttccttgaagagatgctgcgcacccgaatcggaactaagcatgccattttgctcgtcgctgtgtcctttgtgacactgatcaccggcaacatgtctttccgggatctagggcgtgtcatggttatggtgggagcaacgatgactgacgatattggcatgggtgtaacctacctggccctcctggctgcctttaaggtgagacctacattcgcagcggggcttttgctgaggaaattaaccagcaaggagctcatgatggccactatcggaatagctctgctttcacaaagtacaatccccgaaaccattctggagctaacagacgccctcgcactgggcatgatggtcttgaaaatcgtgcgcaatatggaaaagtatcagctggctgttactattatggccatctcctgtgtgccaaacgcagtcatattacagaatgcctggaaagtgtcttgcaccattctcgctgcggttagcgtgtcccctctgcttctgacgtcaagccagcaaaaggccgattggatccccttggcactcacaatcaagggcctgaacccaaccgctatttttctaactaccctgagtcggacatctaaaaagagatcctggccgcttaatgaggccataatggccgtcgggatggtaagcatcctcgcttcgtcactgttgaaaaacgacattcctatgactggacccctggtggccggtggcttactcaccgtttgttacgtgctgacggggaggtctgccgaccttgaactggagcgagcggctgatgtcaagtgggaggaccaggccgaaatcagtggatccagcccaattttgtctatcacaataagcgaggatggctccatgtcaatcaaaaatgaagaggaggaacagaccctcactattctgatccgcacaggtctactggtgattagtggggtattccccgtgagcatccctataaccgcagccgcttggtatctttgggaggtcaagaaacagcgggcaggagttctctgggacgtgccatctccccctccggtggaaaaggccgagctggaagatggcgcgtacagaattaagcaaaggggcatcttggggtattcccagatcggagctggtgtctacaaagagggcacttttcacacaatgtggcacgtgacccgtggggccgttttaatgcatcgcggaaagcggattgagccatcatgggcagacgtcaagaaggatctgatcagttacggcggtgggtggaaactcgaaggagagtggaaggaaggcgaggaagtgcaggtcctggcccttgagcccggcaagaaccctagagctgtgcagacgaaaccagggatattcaagactaataccggaacaattggtgccgttagcctggacttttcccccggcacctctgggtcgcctatcgtggataggaaaggaaaggtcgtgggcttgtatggtaacggggtagtcacacgaagcggagcatacgtgtcagctattgcccaaactgagaaatccatcgaagacaatccggagatagaagatgacattttccggaagaagcgcctaaccatcatggatctgcaccccggcgcgggcaaaacgaagagatatctcccagccatcgttagggaggcaattaaacgggggctgcgaacacttatcttagctcctactagagtggtcgccgctgaaatggaggaggcactgcgcggactccccattaggtaccagaccccagccataaagacagaacataccggtcgtgagatcgtggacttgatgtgccacgccactttcaccatgcggctgctcagtcctgttagagtgcccaactataacctgattatcatggacgaagctcattttacagatccagcgtctatcgcagccaggggctacattagcacgcgcgtcgagatgggggaggctgccggaatattcatgactgcaaccccgcctggctcccgagacccctttccacagtcaaatgcccccatcatggatgaagagagagaaattcctgagcggtcttggaacagcggtcacgaatgggtgacagacttcaaagggaagaccgtatggtttgtgccaagtatcaaggctggaaatgatattgcggcctgtcttaggaaaaacggcaagaaagttatccaactgtcccgcaagactttcgacagcgagtatgtcaaaacacgtgcaaatgattgggactttgtggtgaccacggatatatctgagatgggcgctaacttcaaggccgaaagagtcatcgacccccggaggtgcatgaagcctgtaattttgactgatggggaggaacgcgtgatcctagcaggaccgatgccagttacacactcatccgccgctcagcgaagaggtcggattggcaggaatcccaaaaacgagaatgaccagtacatctacatgggggaacctctggagaacgacgaggattgtgcccattggaaggaagcgaaaatgctcttagacaatataaacacccccgagggaattatcccaagtatgtttgaacctgagcgcgaaaaggtggatgcaattgacggcgagtatagactgaggggtgaggcccggaaaaccttcgtcgatcttatgcgtcgcggggacctgcccgtgtggctcgcttacaaggttgccgctgaaggcatcaattatgcagatcgaaaatggtgctttgacggaataaagaacaatcagatcttggaggaaaacatgcaagagcagatttggactaaggagggcgaaaggaaaaagctgaaaccaagatggctcgatgcccggatctacagcgaccctctggctcttaaggagttcaaagagttcgccgcagggcgcaagtcgctaacactgaacttgattaccgagatgggaagattaccgacatttatgactcagaaggcgaggaatgccctggataacctcgctgtgctgcacacggccgaagccggtggccgggcttataatcatgccctttctgagctgcccgagaccctcgaaacattgctgctactgactctccttgcaaccgtcacagggggaatcttcctgtttttaatgtccggcaaaggtatagggaagatgaccttgggcatgtgctgtattatcactgccagcatcctgctctggtacgctcagattcaaccacactggatcgcggcctcaataattctggagttctttcttatcgtgctgctcattcctgaacccgagaaacagcgaacgccacaggacaaccagttgacctatgtagtgatcgcaatactgacagttgtcgctgccactatggccaatgaaatgggattcttagagaagaccaaaaaggatctaggcctggggagtatcacaacccaagagtctgaatccaacattctcgacatcgaccttagacctgcaagcgcttggactctgtacgccgtggcgacaacgtttgtgacccccatgttgcgccactcaattgagaatagtagcgtcaacgtttccctgactgctatcgccaatcaggcaacagtgctcatgggactgggtaagggctggccgctttctaaaatggatattggggtaccactcctggccatcggatgctacagccaggtgaaccctataaccttgaccgctgcactgttactactggtcgcccattatgcgattatcggccccggtctccaggctaaggccacaagggaagcacaaaaacgggccgctgccgggatcatgaagaatccaactgtggacggcattacggttatagatcttgagcccatcccttacgacccgaaattcgaaaagcagctgggacaggtgatgttgctgattctctgtgtcacccaagtactgatgatgcgtacaacttgggcactttgcgaggctttaaccctggccacaggccccatctccaccctctgggaggggaacccaggaagattttggaatactacgattgcggtgtcaatggccaacatcttcaggggctcttatttggccggtgctgggctgctatttagtataatgaagaatacaacctcgactcgccggggaaccggcaacatcggtgaaacactgggcgagaaatggaaaagccgactcaatgcccttgggaaatccgagttccagatttacaagaaatctggaatccaggaggttgatagaactctggcaaaggagggcattaaaagaggggaaaccgaccaccatgctgtgtcacgcggaagcgccaagttgcggtggtttgtcgagagaaacatggtgacacctgaaggcaaggtcgtggatctgggttgtgggcgtggaggctggtcctattactgcggtggcctcaaaaacgttagggaggtgaaggggctgacgaaaggaggccccgggcacgaagaacctatcccaatgagtacctatggatggaatttagtacggcttcagtctggcgtggacgtcttcttcactccccctgagaagtgtgatacactgctctgcgacataggtgaaagctcaccaaaccccaccattgaggccgggcgcactctacgagttctgaatttggtggaaaactggctgaataacaatacacaattttgtatcaaagtcctcaacccgtacatgccttccgtgatcgagaagatggaagcgcttcagagacagtacggaggcgctctggtaaggaatccattgagtcggaacagcacccatgagatgtattgggtgtctaatgcaacgggcaacattgtttcctcagtgaatatgataagccgcatgctgatcaacagattcaccatgaagcacaaaaaggccacatacgagcccgatgtcgacctcgggtcgggaactaggaatattggtatcgaatctgagattcctaacttagatatcataggcaaacgaatcgaaaagattaaacaggagcacgaaatcagttggcattatgaccaagaccacccatacaagacctgggcttatcatgggtcctacgagacaaagcagactggaagcgcctcatccatggtgaacggcgtcgtgcggctgcttaccaaaccctgggatgttgtaccgatggtgacacagatggcaatgaccgacactacgccttttggtcagcaacgtgtcttcaaggagaaagtggatacaagaacccaggaacccaaggaggggactaaaaagctgatgaagattaccgccgaatggctatggaaagagctcggaaagaaaaagacaccacgcatgtgcacgagggaggaatttaccaaaaaggttcggtctaatgctgcgctgggcgccatcttcactgacgagaacaaatggaaaagcgcaagagaagctgtggaggatggccgcttttgggaattggtcgacagggagcgaaatctgcacctcgaggggaagtgtgaaacatgcgtgtataacatgatgggaaaacgggagaagaaacttggtgagttcggcaaggccaaagggagtagagcaatttggtacatgtggctgggagccaggtttttagagttcgaagctctgggctttttgaatgaggatcactggttctcccgcggtaacagcctctctggggtagagggagaaggcctgcatcgtctaggctacatacttcgggacgtggggaagaaggagggaggtgccatgtatgcggatgacaccgcaggctgggatactagaatcacactggaagacctcaaaaatgaggaaatggttaccaaccacatgaagggggagcataaaaagctggccgaggctatttttaaattgacataccagaataaggtcgtgagggtgcaacgccctactccccgaggaaccgtcatggacatcatctcacggagagatcagaggggcagtggtcaggttgggacgtatggactgaacaccttcacaaatatggaagcccagctcattcgccaaatggagggcgaaggcatattcaagtccatccagcaccttactgcaaccgaggagattgctgtgcagaactggctggccagagtagggcgggaaaggttaagccgtatggctatctctggagacgattgcgtggtcaaaccaattgacgatcgatttgcctcggcactgacagcgttgaatgacatgggtaaggtgcgcaaagatatccagcaatgggagccctcaagaggctggaacgactggactcaggttcctttctgtagccatcactttcacgaactcgtgatgaaggatgggcgggtcctggtggtaccatgcaggaatcaggacgagctaataggacgcgccagaatctcccagggcgctggttggagtcttaaagaaaccgcctgtctggggaagtcttacgcacaaatgtggacgctcatgtatttccatcggagggatctgcgattggctgccaacgcaatttgcagcgccgttccgtcccactgggtgcccacatcacgtaccacttggagtatccatgcgaagcacgagtggatgacaaccgaggacatgttagctgtctggaacagagtgtggattcaggaaaatccttggatggaggataaaactccagtggaatcttgggaggaagtcccctacctgggaaagcgcgaggaccagtggtgtggcagcctcatcggccttacctcccgggccacatgggccaagaacatacagacggccattaatcaagttaggtcactgatcgggaacgaggaatataccgactacatgcctagcatgaagagatttcgccgggaggaagaggaagctggagtgctatggtga

SEQ ID NO: 14505 - RNA, 9876 nt, synthetic construct
  misc_feature 1..9876: note = derived and/or modified CDS sequence (opt3) from DENV-2__FJ639837__SS-prME
  source 1..9876: mol_type = other RNA
accgccggcgtgatcgtcatgctgattcccacagctatggcattccacctcactacgagaaacggggaacctcatatgatagttggaaggcaggaaaagggtaagagccttctgtttaagaccgaagacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatagaatccgctctgaacgacacatggaagatggagaaggcctcattcattgaggtcaaaagctgccactggcctaagtctcataccctttggtccaatggagtgttggaaagtgagatggttatccccaagaatttcgcaggccccgtgagccagcacaactaccgacctggttatcatactcaaaccgctggcccatggcacctcgggaagctggaaatggattttgacttctgtgagggaacaactgtcgtggttaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaattaggccacttaaggagaaggaagagaacttggtgaatagtctggtaaccgcgggacatggccagatcgataactttagcttaggtgtcctcggcatggccctgttccttgaagagatgctgcgcactcgaattgggacaaaacacgctatattgctcgtggcagtgtcgtttgtcaccctgatcacgggaaatatgtccttccgggacctaggccgtgttatggtgatggtaggggccactatgaccgatgacattggaatgggcgtgacatatctggctctcctggccgcatttaaggtcagacccaccttcgcggccggtcttttgctgaggaaattaacttctaaggagctcatgatggctacaatcgggattgccctgcttagccagtcaaccatccctgaaacaatactggagctaactgatgcactcgctctgggaatgatggtgttgaaaatcgttcgcaacatggaaaagtaccaactggccgtgaccattatggcaatcagttgcgtccccaatgccgtgattttacagaacgcttggaaggtttcctgtacgatcctcgcggccgtgtctgtcagcccactgcttctgacatcctcacagcagaaagcagactggatacctttggctctcaccattaagggcctgaatcccactgccatctttctaaccacactgagccggacaagtaaaaagagatcttggccacttaacgaggccatcatggctgtaggcatggtgtccattctcgcaagctcgctgttgaaaaatgacataccgatgaccgggcctctggttgccggaggtttactcacggtgtgctatgtcctgacaggcaggtcagcggatcttgaactggagcgagctgccgacgtgaagtgggaggatcaagcagaaatctctgggagttcccccattttgagcatcaccatttctgaggacggaagcatgtccatcaaaaacgaagaggaggaacagactctcacaatactgatccgcaccggcctactggtaatttcaggtgtgttcccagtcagtatccccattactgccgctgcatggtacctttgggaggttaagaagcagcgggccggggtgctctgggatgtgcctagcccaccccctgtcgaaaaagcggagctggaagacggagcttatagaatcaagcagaggggcatattgggctactctcaaattggggccggagtgtataaagagggtacatttcacaccatgtggcatgttacgcgtggcgcagtattaatgcaccgcgggaagcggatcgagccgtcctgggccgatgtgaaaaaggacctgatctcatacggaggcggttggaagctcgaaggggagtggaaagaaggagaggaagtccaggtgctggctcttgagccaggcaagaatcccagagccgttcagactaaacctggcattttcaagaccaacacagggaccatcggagcagtgagtctggattttagcccaggtacatccggctctcccatagtcgacaggaaagggaaggtggtaggattgtacggcaatggtgtcgtgactcgatcgggggcttatgttagcgccattgcgcagaccgagaagtcaatcgaagataaccctgagattgaagacgatatcttccggaaaaagcgcctaacgataatggacctgcatccgggagccggcaaaacaaagagatacctccccgcaattgtgagggaggctatcaaacggggcctgcgaactcttatcttagccccaaccagagtcgtggctgcagaaatggaggaggccctgcgcgggctccctattaggtatcaaacacccgccatcaagaccgaacacactggacgtgagattgttgacttgatgtgtcatgctaccttcacaatgcggctgctctccccagtgagagtccctaactacaatctgataatcatggatgaagcgcactttacggaccccgcaagtattgccgctaggggttatatctctactcgcgtggagatgggcgaggccgcagggatcttcatgaccgccacaccaccgggaagccgagatccttttccccagtccaacgctccaattatggacgaagagagagaaatacccgagcggtcatggaactctggccacgaatgggtaaccgatttcaagggtaaaactgtgtggtttgttcctagcatcaaggcggggaacgacattgccgcatgccttaggaaaaatggaaagaaagtcatccagctgagtcgcaagacattcgattccgagtacgtgaagacccgtgctaacgactgggattttgtggtcacgactgacattagcgagatgggcgccaatttcaaagcagaaagagtaatcgatccacggaggtgtatgaagcccgtgatattgacagacggcgaggaacgcgttatcctagccgggcctatgccggtgacccattcttcagctgcccaacgaagaggacggattggtaggaaccccaagaatgagaacgaccagtatatctacatgggcgaacccctggagaatgatgaggactgcgcgcactggaaggaagcaaaaatgctcttagataacattaatacccctgaggggatcataccctccatgtttgaaccagagcgcgaaaaggtcgacgccattgatggagagtacagactgaggggcgaggctcggaaaactttcgtggaccttatgcgtcgcggtgatctgcctgtttggctcgcctataaggtggctgcagaagggatcaactacgccgaccgaaagtggtgttttgatggcattaaaaataaccagatcttggaggaaaacatggaggtcgagatatggacaaaggaaggagagaggaaaaagctgaaacccagatggctcgacgctcggatctatagtgatccactggcccttaaggagttcaaggagttcgcagcgggccgcaaaagcctaaccctgaatttgattacagaaatggggagattacctacttttatgacgcagaaggccaggaacgctctggacaatctcgccgtgctgcataccgcagaggctggaggtcgggcctacaaccacgcactttcggagctgccggaaacactcgagactttgctgctactgaccctccttgccacagtaaccggcgggatcttcctgtttttaatgtctggaaaatccattggcaagatgactttgggtatgtgctgcatcataacggctagcattctgctctggcacgcgcaaatccagccccattggatcgccgcatcaattatcctggagttctttcttatagtgctgctcattccagagcctgaaaaacagcgaaccccacaggataatcaattgacatatgttgtcatcgctattctgactgtggtggccgccaccatggcaaacgagatggggttcttagagaagacaaagaaagacctaggcctgggaagtatcaccactcaggaatctgagtccaatatactcgacatcgatcttagaccagctagcgcctggacactgtacgcggtcgctacgacctttgttactcctatgttgcgccactcaattgaaaacagtagcgtgaatgtatccctgacagccatcgcaaaccaggccaccgtgctcatgggcctggggaagggatggcccctttctaaaatggacattggtgtcccgctcctggctatcggctgttatagccaggtgaatccaattaccttgacagcagccctgttactactggttgcgcattacgctatcatagggcctggactccaagccaaggcaactagggaggcccagaaacgggctgccgcaggcattatgaagaaccccacggtggatggtatcaccgtcatcgaccttgctccaattccctacgatcctaagttcgaaaaacagctggggcaggtaatgttgctgatactctgcgtgacacaagttctgatgatgcgtactacctgggccctttgtgaggcgttaacactggccaccggcccgatctccactctctgggagggaaatcccggcagattttggaacacgacaattgcagtgtcaatggctaatatcttcagggggtcttatttggccggagcaggcctgctatttagtattatgaagaacaccacttcgacccgccggggtacagggaatatcggagaaactctgggcgagaaatggaaaagccgactcaacgctcttggtaaatccgagttccagatatacaagaaatctggcatccaggaggtcgacagaaccctggccaaggaggggattaagaggggagaaacagatcaccatgccgtgtcacgcggcagcgcgaaattgcggtggtttgtcgagagaaacatggtgacgccagaagggaaggttgtggacctgggatgcggccgtggtgggtggtcctattactgtggaggcctcaaaaatgtaagggaggtgaagggtctgaccaaaggcgggcctggacacgaagaaccaatccctatgagtacttatggctggaacttagtccggcttcaatctggggttgatgtgttcttcacaccacccgagaagtgcgacaccctgctctgtgatattggagaaagctcacctaatccaactatcgaggctggccgcacactacgagtcctgaacttggtggaaaattggctgaacaataacacccagttttgcataaaggtactcaatccctacatgccgtccgtgattgagaaaatggaagcacttcagagacagtatggtggggccctggttaggaaccctttgagtcggaatagcacgcacgagatgtactgggtgtctaacgctaccggaaatatcgtctcctcagtgaacatgatcagccgcatgctgattaatagattcacaatgaagcataaaaaggccacttacgagccagacgtcgatctcggctcgggcaccaggaacatagggatcgaaaacgagattcccaatttagacatcattggaaaacgaatcgaaaagataaagcaagagcacgaaatctcttggcattatgaccaggatcacccttacaaaacatgggcatatcacggtagttacgagactaagcagaccggctccgccagctcaatggtgaacggggttgtacggctgcttacaaaaccatgggacgtggtccccatggtgacccagatggctatgactgatacgacaccgtttggacaacagcgtgttttcaaggagaaagtggacaccagaactcaggaacctaaggagggcaccaagaaactgatgaagattacagcggaatggctatggaaagagctcggtaagaaaaagacgccccgcatgtgtaccagggaggaatttactcggaaagtcagatccaatgccgcactgggggctatcttcacagatgagaacaagtggaagtctgcccgcgaagcagtggaggacggaaggttttgggaattggtagatcgagagcggaatctgcatctcgagggcaaatgcgaaacctgtgtgtataacatgatgggcaagagagagaagaaacttggggagttcggaaaagccaaaggtagcagggctatttggtacatgtggctgggcgcccgctttttagagttcgaagcgctggggtttttgaatgaggaccactggttcagtcgtggaaactccctcagcggcgttgagggtgaagggctgcatcggctaggatatatccttagagatgtcgcaaagaaagagggcggcgccatgtacgctgacgatactgccgggtgggacacaaggattaccctggaagacctcaagaatgaggaaatggtgacaaaccacatgaaaggagagcataagaaactggcagaggctatatttaagttgacttaccagaataaggtggtccgcgttcaacgaccaacccctcggggtacggtgatggatatcatttctagaagggaccagcgcggctcagggcaggtaggaacctatggcctgaacacattcactaatatggaagcccaactcatcagacagatggagggtgaagggatcttcaaaagtattcagcaccttaccgctacagaggagatagccgtgcagaactggctggcacgggtcggaagggaacgtttatcccgaatggcgatcagcggcgatgactgcgtggttaagcccattgatgaccgctttgcctctgctctgactgccttgaatgatatgggcaaagtgagaaaggacatccaacagtgggagccatcgcgggggtggaacgattggacccaggtccccttctgctcacaccattttcacgaactcgtgatgaaagacggaagggtactggttgtgccttgtcgcaaccaggatgagctaattggtagagcacggatcagccaaggcgctgggtggtcccttaaggaaacggcctgcctgggaaagagttacgcacagatgtggacactcatgtatttccataggcgagacctgcgtttggccgcgaatgctatatgttctgccgtcccaagccactgggtgccgacctccagaactacatggtcaatccacgcaaaacatgagtggatgaccactgaggatatgttagccgtgtggaaccgcgtctggattcaggaaaatccctggatggaggacaagacccctgttgaaagttgggaggaagtgccatacctgggcaaacgggaggaccagtggtgcggttctctcatcgggcttacaagcagggctacgtgggccaagaacattcaaaccgcaatcaatcaggtaagatccctgataggaaacgaggaatatactgattacatgccctcaatgaaacgctttcggagggaggaagaggaagctggcgtgctatggtga

SEQ ID NO: 14506 - RNA, 9876 nt, synthetic construct
  misc_feature 1..9876: note = derived and/or modified CDS sequence (opt3) from DENV-2__FJ744706__SS-prME
  source 1..9876: mol_type = other RNA
accgccggagtgatagtaatgctgattcccactgctatggctttccacctcactacgaggaacggggagcctcatatgatagttgggaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacaggatcacataaccagaccttcttgatcgatggcccggagacagcagaatgccccaatactaacagggcgtggaatagtctggaggttgaggactacggttttggggtgttcaccacgaacatttggctcaagctgcgtgaaaaacaggacgtgttttgtgattctaagttaatgagcgctgccatcaaagacaatcgggcagtacacgccgatatgggatattggatagagtccgctctgaacgacacatggaagatggaaaaggcctcattcattgaggtcaaaagctgccactggcctaagtctcataccctttggtccaatggcgtgttggagagtgaaatgatcatccccaagaatttcgcaggtcccgttagccagcacaactaccgacctggctatcatactcaaaccgctgggccatggcacctcggaaagctggagatggattttgacttctgtgaaggcacaactgtggtcgtgaccgaggattgcgggaatagaggaccctctctaaggacaacgaccgcctccggcaaactgattactgaatggtgctgtcgctcatgcacactcccgcctctgcggtacagaggtgaggacgggtgttggtacggaatggagatcaggccacttaaggaaaaggaggaaaacttggttaatagtctggtgaccgcgggccatggtcagattgataactttagcttaggcgtactcgggatggccctgttccttgaggaaatgctgcgcactcgaataggaacaaaacacgctatcttgctcgtcgcagtgtcgtttgtgaccctgattacgggcaatatgtccttccgggacctagggcgtgtcatggttatggtgggagccactatgaccgatgacatcggcatgggtgtaacatatctggctctcctggccgcatttaaggtgagacccaccttcgcggccgggcttttgctgaggaaattaacttctaaggagctcatgatggctacaattggaatcgccctgcttagccagtcaaccatacctgagacaatcctggaactaactgatgcactcgctctgggcatgatggtcttgaaaattgtgcgcaacatggagaagtaccaactggccgttaccatcatggcaattagttgcgtgcccaatgccgtcatcttacagaacgcttggaaggtgtcctgtacgatactcgcggccgtttctgtgagcccactgcttctgacatcctcacagcagaaagcagactggattcctttggctctcaccatcaagggcctgaatcccactgccatctttctaaccacactgagccggacaagtaaaaagagatcttggccacttaacgaagccattatggctgtcgggatggtatccatactcgcaagctcgctgttgaaaaatgacatcccgatgaccggacctctggtggccggtggcttactcacggtttgctatgtgctgacagggaggtcagcggatcttgagctggaacgagctgccgacgtcaagtgggaggatcaagcagagatttctggaagttcccccatcttgagcattaccatctctgaagacggcagcatgtccatcaaaaacgaggaagaggagcagactctcacaatcctgattcgcaccggtctactggtgatctcaggggtattcccagtgagtattcccatcactgccgctgcatggtacctttgggaagtcaagaagcagcgggccggagttctctgggatgtgcctagcccaccccctgtggagaaagcggaactggaggacggcgcttatagaataaagcagaggggcattttggggtactctcaaatcggagccggtgtctataaagaaggcacatttcacaccatgtggcatgtgacgcgtggggcagttttaatgcaccgcggaaagcggatcgagccgtcctgggccgatgtcaaaaaggacctgatttcatacggcggtgggtggaagctcgagggagaatggaaagagggcgaagaggtgcaggtcctggctcttgaaccaggcaagaatcccagagccgtgcagactaaacctgggatcttcaagaccaacacaggaaccataggtgcagttagtctggattttagcccaggcacatccgggtctcccattgtggacaggaaaggaaaggtcgtgggcttgtacggtaatggggtagtcactcgatcgggagcttatgtgagcgccatcgcgcagaccgagaagtcaattgaggataaccctgaaatcgaggacgatatattccggaaaaagcgcctaacgattatggacctgcatccgggcgccggcaaaacaaagagatacctccccgcaatcgttagggaagctatcaaacgggggctgcgaactcttattttagccccaaccagagtggtcgctgcagagatggaagaggccctgcgcggactccctatcaggtatcaaacacccgccattaagaccgagcacactggtcgtgaaatagtggacttgatgtgtcatgctaccttcacaatgcggctgctctccccagttagagtgcctaactacaatctgatcattatggatgaggcgcactttacggaccccgcaagtatcgccgctaggggctatatctctactcgcgtcgaaatgggggaggccgcaggaattttcatgaccgccacaccaccgggcagccgagatccttttccccagtccaacgctccaataatggacgaggaaagagagatccccgaacggtcatggaactctggtcacgagtgggtgaccgatttcaaggggaaaactgtatggtttgtgcctagcattaaggcgggaaacgacatcgccgcatgccttaggaaaaatggcaagaaagttattcagctgagtcgcaagacattcgattccgaatacgtcaagacccgtgctaacgactgggattttgtggtgacgactgacatcagcgagatgggcgccaatttcaaagcagagagagtcatagatccacggaggtgtatgaagcccgtaatcttgacagacggggaagaacgcgtgattctagccggacctatgccggttacccattcttcagctgcccaacgaagaggtcggatcggcaggaaccccaaaaatgaaaacgaccagtatatttacatgggggagcccctggaaaatgatgaggactgcgcgcactggaaggaggcaaaaatgctcttagataacatcaatacccctgaaggaataattccctccatgtttgagccagaacgcgagaaggtggacgccatcgatggcgaatacagactgaggggtgaggctcggaaaactttcgtcgaccttatgcgtcgcggggatctgcctgtgtggctcgcctataaggttgctgcagagggcattaactacgccgaccgaaagtggtgttttgatggaatcaaaaataaccagatattggaagagaacatggaagtggagatctggacaaaggagggcgaaaggaaaaagctgaaacccagatggctcgacgctcggatttatagtgatccactggcccttaaggagttcaaggagttcgcagcggggcgcaaaagcctaaccctgaatttgatcacagagatgggaagattacctacttttatgacgcagaaggccaggaacgctctggacaatctcgccgtcctgcataccgcagaagctggtggccgggcctacaaccacgcactttcggagctgccggagacactcgaaactttgctgctactgaccctccttgccacagtgaccgggggaattttcctgtttttaatgtctggcaaaggtatcgggaagatgactttgggcatgtgctgcataattacggcttccatcctgctctggtatgcgcaaatccagccccactggattgccgcaagcatcatactggagttctttcttattgtactgctcatcccagaacctgagaaacagcgaaccccacaggataatcaattgacatacgtggttattgctatcctgactgtcgtggccgccaccatggcaaacgaaatgggattcttagagaagacaaagaaagacctaggcctggggtcaataaccactcaggagagtgaatctaatatcctcgacattgatcttagaccagcttccgcctggacactgtatgcggtggctacgacctttgtcactcctatgttgcgccatagcatcgagaactcaagtgttaatgtgagcctgacagccattgcaaaccaggccaccgtactcatgggactgggtaagggctggcccctttccaaaatggacatcggggtgccgctcctggctattggatgttactctcaggtcaatccaatcaccttgacagcagccctgttactactggtggcgcactacgctataattggccctggtctccaagccaaggcaactagggaagcccagaaacgggctgccgcagggatcatgaagaaccccacggttgatggcatcaccgtgattgaccttgagccaataccctatgatcctaagttcgaaaaacagctgggacaggtcatgttgctgatcctctgcgtaacacaagtgctgatgatgcgtactacctgggctctttgtgaggccttaacactggcgaccggcccgattagcactctctgggaggggaatcccggaagattttggaacacgacaatcgccgtttccatggcaaatattttcaggggctcatacttggctggtgccgggctgctattttctatcatgaagaacaccacaagtacccgccggggaacaggcaatataggtgaaactctgggcgagaaatggaagtcgcgactcaacgcacttgggaaaagcgagttccagatctataagaaatccggtattcaggaggtggacagaaccctggctaaggagggcatcaagagaggggaaacagatcatcacgccgtctctcgcggatcagccaaattgcggtggtttgtggagagaaacatggtcacgccagaaggcaaggtggttgacctgggttgcgggcgtggaggctggagctactattgtggtggcctcaaaaatgtgagggaggtaaaggggctgaccaaaggaggccctgggcatgaagaaccaattcctatgtccacttacggatggaacttagtgcggcttcaaagtggcgtcgatgttttcttcacaccacccgagaagtgcgacaccctgctctgtgatatcggtgaatctagccctaatccaactatagaggcggggcgcacactacgagtgctgaacttggtcgaaaattggctgaacaataacacccagttttgcattaaggtgctcaatccctatatgccgtcagtaatcgagaaaatggaagcacttcagagacagtacggaggcgcactggtgaggaaccctttgtcccggaatagtacgcacgagatgtactgggttagcaacgccaccggcaatatcgtgtcttccgtcaacatgatttcacgcatgctgataaatagattcacaatgaagcacaaaaaggctacttatgagccagacgtggatctcgggagcggaaccaggaacatcggtattgaatcggagatccccaacttagacattatcggcaaacgaatagaaaagatcaagcaagagcatgaaatttcttggcactacgaccaggatcatccttataaaacatgggcctaccacgggagttatgagactaagcagaccggatccgcaagctcaatggtcaatggcgtggttcggctgcttacaaaaccatgggacgtagtgcccatggtcacccagatggccatgactgatacgacaccgtttggtcaacagcgtgtgttcaaggagaaagttgacaccagaactcaggaacctaaggaggggaccaagaaactgatgaagatcacagctgaatggctatggaaagagctcggaaagaaaaagacgccccgcatgtgtaccagggaggaatttactaaaaaggtgcggggcaacgcggccctgggcgcaattttcacagatgagaataagtggaaatccgctagagaagccgtcgaggacgggcgcttttgggaattggtggatagggagcgaaacctgcacctcgagggaaagtgcgaaacctgtgtatacaatatgatgggtaaacgggagaagaaacttggcgagttcgggaaggcaaagggatctagagccatctggtatatgtggctgggcgctaggtttttagagttcgaagccctgggatttttgaacgaggaccattggttcagccgcgggaatagtctctccggagtggagggcgaaggcctgcaccgtctagggtacattcttcgggatgttggcaaaaaggagggtggcgcgatgtacgcagacgatactgccgggtgggacacaagaataaccctggaagacctcaaaaacgaggaaatggtcacaaatcatatgaagggagagcacaaaaagctggctgaggccatctttaagttgacttatcagaacaaagtggtgagggtccaacgcccaacccctcgaggcacggttatggatattatcagccggagagaccagaggggttctggacaggtgggaacctacggcctgaatacattcactaacatggaagcacaactcatccgccagatggagggcgaagggattttcaagtcaatacagcatcttaccgctacagaggagatcgccgtacagaattggctggctagagtgggacgggaaaggttaagtcgtatggccatttccggtgatgactgcgtcgtgaaacccatcgatgaccgatttgcaagcgcgctgactgccttgaacgatatgggcaaggttcgcaaagacattcaacagtgggagccatctagagggtggaatgattggacccaggtgcccttctgctcgcaccactttcatgaactcgtcatgaaggacggacgggtgctggtagttccttgtaggaaccaggatgagctaatcggccgcgctagaatatcacaaggtgccgggtggagccttaaggaaacggcatgcctgggaaaatcctatgctcagatgtggacactcatgtacttccaccggagggacctgcgattggccgcaaacgccatctgtagtgcggtgccatctcattgggtcccgaccagccgtactacatggtccattcacgctaagcacgagtggatgaccactgaggatatgttagccgtgtggaatagagtgtggatccaggaaaacccctggatggaggacaaaacccctgtcgaatcatgggaggaagttccatatctgggcaagcgcgaggaccagtggtgcggcagtctcattgggcttacatctcgggcaacgtgggccaaaaatatccaaaccgctataaaccaggtgaggagcctgattggaaatgaggaatacactgattatatgccctccatgaagagatttcgccgggaggaagaggaagccggtgtactatggtga

SEQ ID NO: 14507 - RNA, 9876 nt, synthetic construct
  misc_feature 1..9876: note = derived and/or modified CDS sequence (opt3) from DENV-2__FJ744707__SS-prME
  source 1..9876: mol_type = other RNA
accgccggcgtgatagtaatgctgattccaactgctatggctttccacctcactacgagaaacggggaacctcatatgatagttggaaggcaggaaaagggtaaaagccttctgtttaagaccgaagacggcgtgaatatgtgcacattgatggccatcgatttaggggaactgtgtgaagacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatagaatccgctctgaacgacacatggaagatggagaaggcctcattcattgaggtcaaaagctgccactggcctaagtctcataccctttggtccaatggagtgttggaaagtgagatgatcatccccaagaatttcgcaggccccgttagccagcacaactaccgacctggttatcatactcaaaccgctggcccatggcacctcgggaagctggaaatggattttgacttctgtgagggaacaactgtggtcgtgaccgaagattgcggcaatagagggccctctctaaggacaacgaccgcctccggaaaactgattactgagtggtgctgtcgctcatgcacactcccgcctctgcggtacagaggcgaggacggttgttggtacgggatggaaatcaggccacttaaggagaaggaagagaacttggttaatagtctggtgaccgcgggacatggccagattgataactttagcttaggtgtactcggcatggccctgttccttgaagagatgctgcgcactcgaatagggacaaaacacgctatcttgctcgtcgcagtgtcgtttgtgaccctgattacgggaaatatgtccttccgggacctaggccgtgtcatggttatggtgggggccactatgaccgatgacatcggaatgggcgtaacatatctggctctcctggccgcatttaaggtgagacccaccttcgcggccggtcttttgctgaggaaattaacttctaaggagctcatgatggctacaattgggatcgccctgcttagccagtcaaccatacctgaaacaatcctggagctaactgatgcactcgctctgggaatgatggtcttgaaaattgtgcgcaacatggaaaagtaccaactggccgttaccatcatggcaattagttgcgtgcccaatgccgtcatcttacagaacgcttggaaggtgtcctgtacgatactcgcggccgtttctgtgagcccactgcttctgacatcctcacagcagaaagcagactggattcctttggctctcaccatcaagggcctgaatcccactgccatctttctaaccacactgagccggacaagtaaaaagagatcttggccacttaacgaggccattatggctgtcggcatggtatccatactcgcaagctcgctgttgaaaaatgacatcccgatgaccgggcctctggtggccggaggtttactcacggtttgctatgtgctgacaggcaggtcagcggatcttgaactggagcgagctgccgacgtcaagtgggaggatcaagcagaaatttctgggagttcccccatcttgagcattaccatctctgaggacggaagcatgtccatcaaaaacgaagaggaggaacagactctcacaatcctgattcgcaccggcctactggtgatctcaggtgtattcccagtgagtattcccatcactgccgctgcatggtacctttgggaggtcaagaagcagcgggccggggttctctgggatgtgcctagcccaccccctgtggaaaaagcggagctggaagacggagcttatagaataaagcagaggggcattttgggctactctcaaatcggggccggagtctataaagagggtacatttcacaccatgtggcatgtgacgcgtggcgcagttttaatgcaccgcgggaagcggatcgagccgtcctgggccgatgtcaaaaaggacctgatttcatacggaggcggttggaagctcgaaggggagtggaaagaaggagaggaagtgcaggtcctggctcttgagccaggcaagaatcccagagccgtgcagactaaacctggcatcttcaagaccaacacagggaccataggagcagttagtctggattttagcccaggtacatccggctctcccattgtggacaggaaagggaaggtcgtgggattgtacggcaatggtgtagtcactcgatcgggggcttatgtgagcgccatcgcgcagaccgagaagtcaattgaagataaccctgagatcgaagacgatatattccggaaaaagcgcctaacgattatggacctgcatccgggagccggcaaaacaaagagatacctccccgcaatcgttagggaggctatcaaacggggcctgcgaactcttattttagccccaaccagagtggtcgctgcagaaatggaggaggccctgcgcgggctccctatcaggtatcaaacacccgccattaagaccgaacacactggacgtgagatagtggacttgatgtgtcatgctaccttcacaatgcggctgctctccccagttagagtgcctaactacaatctgatcattatggatgaagcgcactttacggaccccgcaagtatcgccgctaggggttatatctctactcgcgtcgagatgggcgaggccgcagggattttcatgaccgccacaccaccgggaagccgagatccttttccccagtccaacgctccaataatggacgaagagagagaaatccccgagcggtcatggaactctggccacgaatgggtgaccgatttcaagggtaaaactgtatggtttgtgcctagcattaaggcggggaacgacatcgccgcatgccttaggaaaaatggaaagaaagttattcagctgagtcgcaagacattcgattccgagtacgtcaagacccgtgctaacgactgggattttgtggtgacgactgacatcagcgagatgggcgccaatttcaaagcagaaagagtcatagatccacggaggtgtatgaagcccgtaatcttgacagacggcgaggaacgcgtgattctagccgggcctatgccggttacccattcttcagctgcccaacgaagaggacggatcggtaggaaccccaaaaatgagaacgaccagtatatttacatgggcgaacccctggagaatgatgaggactgcgcgcactggaaggaagcaaaaatgctcttagataacatcaatacccctgaggggataattccctccatgtttgaaccagagcgcgaaaaggtggacgccatcgatggagagtacagactgaggggcgaggctcggaaaactttcgtcgaccttatgcgtcgcggtgatctgcctgtgtggctcgcctataaggttgctgcagaagggattaactacgccgaccgaaagtggtgttttgatggcatcaaaaataaccagatattggaggaaaacatggaggtggagatctggacaaaggaaggagagaggaaaaagctgaaacccagatggctcgacgctcggatttatagtgatccactggcccttaaggagttcaaggagttcgcagcgggccgcaaaagcctaaccctgaatttgatcacagaaatggggagattacctacttttatgacgcagaaggccaggaacgctctggacaatctcgccgtcctgcataccgcagaggctggaggtcgggcctacaaccacgcactttcggagctgccggaaacactcgagactttgctgctactgaccctccttgccacagtgaccggcgggattttcctgtttttaatgtctggaaaaggcatcggtaagatgactttggggatgtgctgcataattacggcttccatcctgctctggtatgcgcaaatccagccccactggattgccgcaagcatcatactggagttctttcttattgtactgctcatcccagagcctgaaaaacagcgaaccccacaggataatcaattgacatacgtggttattgctatcctgactgtcgtggccgccaccatggcaaacgagatgggcttcttagagaagacaaagaaagacctaggactgggctcaataaccactcaggaaagtgagtctaatatcctcgacattgatcttagaccagcttccgcctggacactgtatgcggtggctacgacctttgtcactcctatgttgcgccatagcatcgaaaactcaagtgttaatgtgagcctgacagccattgcaaaccaggccaccgtactcatggggctgggaaagggttggcccctttccaaaatggacatcggcgtgccgctcctggctattgggtgttactctcaggtcaatccaatcaccttgacagcagccctgttactactggtggcgcactacgctataattggacctggcctccaagccaaggcaactagggaggcccagaaacgggctgccgcaggtatcatgaagaaccccacggttgatgggatcaccgtgattgaccttgaaccaataccctatgatcctaagttcgagaaacagctgggccaggtcatgttgctgatcctctgcgtaacacaagtgctgatgatgcgtactacctgggctctttgtgaggccttaacactggcgaccggaccgattagcactctctgggaaggcaatcccgggagattttggaacacgacaatcgccgtttccatggcaaatattttcaggggatcatacttggctggcgccggtctgctattttctatcatgaagaacaccacaagtacccgccgggggacaggaaatataggcgagactctgggtgaaaaatggaagtcgcgactcaacgcacttggcaaaagcgagttccagatctataagaaatccgggattcaggaggtggacagaaccctggctaaggaaggaatcaagaggggcgagacagatcatcacgccgtctctcgcgggtcagccaaattgcggtggtttgtggaaagaaacatggtcacgccagagggaaaggtggttgacctgggctgcggtcgtgggggatggagctactattgtggcggtctcaaaaatgtgagggaagtaaagggcctgaccaaagggggacctggccatgaggagcccattcctatgtccacttacgggtggaacttagtgcggcttcaaagtggagtcgatgttttcttcacaccacccgaaaagtgcgacaccctgctctgtgatatcggcgagtctagccctaatccaactatagaagcgggtcgcacactacgagtgctgaacttggtcgagaattggctgaacaataacacccagttttgcattaaggtgctcaatccctatatgccgtcagtaatcgagaaaatggaggcacttcagagacagtacgggggagcactggtgaggaaccctttgtcccggaatagtacgcacgagatgtactgggttagcaacgccaccggcaatatcgtgtcttccgtcaacatgatttcacgcatgctgataaatagattcacaatgaagcacaaaaaggctacttatgaaccagacgtggatctcggcagcgggaccaggaacatcggaattgagtcggaaatccccaacttagacattatcggtaaacgaatagagaagatcaagcaagaacatgagatttcttggcactacgaccaggatcatccttataaaacatgggcctaccacggcagttatgagactaagcagaccgggtccgcaagctcaatggtcaatggagtggttcggctgcttacaaaaccatgggacgtagtgcccatggtcacccagatggccatgactgatacgacaccgtttggccaacagcgtgtgttcaaggaaaaagttgacaccagaactcaggagcctaaggaaggtaccaagaaactgatgaagatcacagctgagtggctatggaaagagctcgggaagaaaaagacgccccgcatgtgtaccagggaagagtttactaaaaaggtgcggtccaacgcggccctgggagcaattttcacagatgaaaataagtggaaatctgctagagaggccgtcgaagacggccgcttttgggagttggtggatagggagcgaaacctgcacctcgaaggcaagtgcgagacctgtgtatacaatatgatggggaaacgggaaaagaaacttggagagttcggtaaggcaaagggcagcagagccatctggtatatgtggctgggggctaggtttttagagttcgaggccctgggatttttgaacgaggaccattggttcagtcgcggcaattccctcagcggtgtggaaggggagggactgcaccgtctaggctacattcttcgggatgttggcaaaaaggaagggggagcgatgtacgcagacgatactgccggttgggacacaagaataaccctggaggacctcaaaaacgaagagatggtcacaaatcatatgaagggcgagcacaaaaagctggctgaagccatctttaagttgacttatcagaacaaagtggtgagggtccaacgcccaacccctcgagggacggttatggatattatctctcggagagaccagaggggatcaggccaggtgggtacctacgggctgaatacattcactaacatggaggcacaactcatccgccagatggaaggagagggcattttcaagagtatacagcatcttaccgctacagaggaaatcgccgtacagaattggctggctagagtgggccgggagaggttatcccgtatggccattagcggggatgactgcgtcgtgaaacccatcgatgaccgatttgcatctgcgctgactgccttgaacgatatgggaaaggttcgcaaagacattcaacagtgggaaccatcgagaggttggaatgattggacccaggtgcccttctgctcacaccactttcatgagctcgtcatgaaggacggccgggtgctggtagctccttgtaggaaccaggatgaactaatcgggcgcgccagaataagccaaggagcaggctggtcccttaaggagacggcttgcctgggtaaaagttatgcccagatgtggacactcatgtacttccaccggagggacctgcgattggcagccaacgcgatctgttctgctgttccaagccattgggtgccgacctcccgtactacatggtcaattcacgccaagcacgagtggatgaccactgaagatatgttagcagtctggaatagagtgtggatccaggagaacccctggatggaagacaaaacccctgtggagagttgggaagaggtcccatatctggggaagcgcgaggaccagtggtgcggatctctcattggccttacaagccgggccacgtgggctaaaaatatccaaaccgccataaaccaggttaggtccctgattggcaatgaagagtacactgattatatgccctcaatgaagagatttcgccgggaagaggaagaggcaggggtgctatggtga

SEQ ID NO: 14508 - RNA, 9876 nt, synthetic construct
  misc_feature 1..9876: note = derived and/or modified CDS sequence (opt3) from DENV-2__FJ744704__SS-prME
  source 1..9876: mol_type = other RNA
accgccggagtgatcgtcatgctgattcccaccgctatggcattccacctcactacgagaaatggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatccgcggaattatgcaggctggcaaaagatcgctcaggcctcaaccaaccgaactgaagtatagctggaaaacttgggggaaggccaagatgctttccacagagtcacataaccagaccttcttgatcgatggaccggaaacagcagagtgccccaatactaaccgtgcgtggaatagtctggaggtcgaagactacggctttggtgttttcaccacgaacatttggctcaaactgcgggagaagcaggacgtgttttgtgattctaaattaatgagcgctgccatcaaggacaatcgagcagtgcacgccgatatggggtattggatagaatccgctctgaacgacacatggaaaatggagaaggcctcattcattgaggtaaagagctgccactggcctaaatctcataccctttggtccaatggagtcttggaaagtgagatgatcatcccaaagaacttcgcaggccccgtgagccagcacaactacagacctggttatcatactcaaaccgctggcccatggcacctcgggaaactggaaatggattttgacctatgtgagggaacaactgttgtggtcaccgaagattgcggcaatagggggccctctctgcgcacaacgaccgcctccggaaagctcattactgagtggtgctgtcggtcatgcacactgccgcctcttagatacaggggcgaggacggttgttggtacgggatggaaatccgcccattgaaagagaaggaagagaacctggtgaatagtttagttaccgcgggacatggccagattgataacttcagcctcggtgtgctgggcatggccctttttctggaagagatgttgcgaactcggatagggacaaagcacgctatcctcctggtagcagtctcgttcgtgaccctaattacgggaaatatgtcctttcgtgacctgggcagagtgatggtcatggttggggccactatgaccgatgacatcggaatgggcgtgacatatctcgctctgcttgccgcattcaaagtaaggcccacctttgcggccggtttgctgttacgcaagctcacttctaaagagctgatgatggctacaattgggatcgcccttctgagccagtcaaccatacctgaaacaatcctagagctcactgatgcactggctttgggaatgatggtgctgaagattgtccggaacatggaaaaataccaattagccgtgaccatcatggcaattagttgcgttcccaatgccgtgatcctccagaacgcttggaaggtctcctgtacgatactggcggccgtgtctgttagcccacttctgttgacatcctcacagcagaaggcagactggattcctctcgctctgaccatcaaaggcctaaatcccactgccatcttcctgaccacacttagcagaacaagtaagaaaaggtcttggccactcaacgaggccattatggctgtgggcatggtctccatactggcaagctcgttgctgaagaatgacatcccgatgaccgggcctttagtagccggaggtctcctgacggtgtgctatgttcttacaggccgatcagcggatctggaattggagcgcgctgccgacgtgaaatgggaggatcaagcagaaatttctgggagttcccccatcctcagcattaccatctctgaggacggaagcatgtccataaagaacgaagaggaggaacagactctgacaatcctaattcggaccggcctgcttgtcatctcaggtgtgtttccagtaagtattcccatcactgccgctgcatggtacctctgggaggtgaaaaagcagagagccggggtcctgtgggatgttcctagcccaccccctgtggaaaaggcggagttggaagacggagcttataggataaaacagcgtggcattttaggctactctcaaatcggggccggagtgtataaggagggtacattccacaccatgtggcatgtcacgcgcggcgcagtgctgatgcaccgggggaaaagaatcgagccgtcctgggccgatgttaagaaagacctcatttcatacggaggcggttggaagctggaaggggagtggaaggaaggagaggaagtacaggtgcttgctctggagccaggcaaaaatcccagggccgtccagactaagcctggcatgtttaaaaccaacacagggaccatcggagcagtgagtttggatttcagcccaggtacatccggctctcccatagttgaccgaaaggggaaagtggtcggactatacggcaatggtgtggtaactcggtcgggggcttatgtcagcgccattgcgcagaccgagaagtcaatcgaagataaccctgagattgaagacgatatctttcgcaagaaaagactgacgataatggacctccatccgggagccggcaagacaaaaaggtacctgcccgcaattgtgcgggaggctatcaagcgaggccttagaactttaatcctggccccaacccgcgttgtggctgcagaaatggaggaggccctcagggggttgcctattcgttatcaaacacccgccatcaaaaccgaacacactggacgggagattgtcgacctgatgtgtcatgctaccttcacaatgagactcctgtccccagtgagggttcctaactacaatcttataatcatggatgaagcgcacttcacggaccccgcaagtattgccgctcgcggttatatctctactcgagtggagatgggcgaggccgcagggatctttatgaccgccacaccaccgggaagcagagatcctttcccccagtccaacgctccaattatggacgaagaacgggaaatacccgagaggtcatggaactctggccacgaatgggtcaccgattttaagggtaagactgtgtggttcgtacctagcatcaaagcggggaacgacattgccgcatgcctgcgcaagaatggcaagaaggtgatccagttgagtcgtaaaacatttgattccgagtacgttaagaccagagctaacgactgggatttcgtcgtgacgactgacattagcgagatgggcgccaattttaaggcagaacgggtgatcgatccaaggcgctgtatgaaacccgtcatactaacagacggcgaggaacgagtaatcctggccgggcctatgccggtgacccattcttcagctgcccaaagacggggaaggattggtcgcaacccaaagaatgagaacgaccagtatatctacatgggcgaacccctcgagaatgatgaggactgcgcgcactggaaagaagcaaagatgttactggataacattaatacccctgaggggatcataccctccatgttcgaaccagagagagaaaaagttgacgccattgatggagagtacaggcttcggggcgaggctcgtaagacttttgtggacctgatgcgccgaggtgatctccctgtctggttggcctataaagtggctgcagaagggatcaactacgccgacagaaagtggtgtttcgatggcattaagaataaccagatcctggaggaaaacatggaggttgagatatggacaaaagaaggagagaggaagaaactcaagccccggtggctggacgctcgcatctatagtgatccacttgccctaaaagaatttaaggagttcgcagcgggcagaaagagcctgaccttgaatttaattacagaaatggggaggctgcctactttcatgacgcagaaagcccggaacgctctcgacaatctggccgtgcttcataccgcagaggctggaggtcgagcctacaaccacgcactgtcggagctcccggaaacattggagactctgctactgctcacccttctggccacagtcaccggcgggatctttttattcttgatgtctggaaagggcattggtaaaatgactctggggatgtgctgcatcataacggcttccattctcctgtggtatgcgcaaatccagccccactggatcgccgcaagcattatccttgaatttttcctgatagtgctcttgattccagagcctgaaaagcagagaacaccccaggataatcaactgacatacgtagtgatcgctattttaactgttgtcgccgccaccatggcaaacgagatgggctttctagagaaaacaaagaaggacctgggactcggctcaatcaccactcaggaaagtgagtctaatatacttgacatcgatctgcgcccagcttccgcctggacattgtatgcggtggctacgaccttcgtgactcctatgctgaggcatagcattgaaaactcaagtgtcaatgttagcctcacagccatcgcaaaccaggccaccgtgctgatggggcttggaaaaggttggcccctctccaagatggacattggcgtaccgctgttggctatcgggtgttactctcaggtgaatccaattaccctgacagcagccttactactgctcgtcgcgcactacgctatcataggacctggccttcaagccaaagcaactcgggaggcccagaagcgtgctgccgcaggtattatgaaaaaccccacggtggatgggatcaccgttatcgacctggaaccaattccctatgatcctaagtttgagaagcagttgggccaggtgatgctgctcatactgtgcgtcacacaagtacttatgatgagaactacctgggctttatgtgaggccctgacactcgcgaccggaccgatcagcactttgtgggaaggcaatcccgggaggttctggaacacgacaattgccgtgtccatggcaaatatctttcgcggatcatacctggctggcgccggtctactgttctctattatgaaaaacaccactaatacccggcgagggacaggaaacatcggcgagactctcggtgaaaagtggaaaagtagacttaacgcactgggcaagtcggagtttcagatatataaaaagagcgggatccaggaggttgacaggaccttggctaaagaaggaattaagcgcggcgagacagatcatcacgccgtgtcccgggggtctgccaagctgagatggttcgtcgaacgtaatatggtgacgccagagggaaaagtcgtggacctcggctgcggtagagggggatggtcatactattgtggcggtctgaagaacgttcgggaagtgaaaggcttaaccaaagggggacctggccatgaggagcccatccctatgagcacttacgggtggaatcttgtacgcctgcaatccggagtggatgtctttttcacaccacccgaaaaatgcgacaccctcctatgtgatattggcgagagttctcctaacccaactatcgaagcgggtcgaacactgagagttttgaatctggtggagaactggctcaataacaatacccagttctgcataaaggtccttaacccctatatgccgagcgtgattgaaaagatggaggctctgcagaggaaatacgggggagcattggtacggaatcctctgtcacgcaactccacgcacgagatgtactgggtgagtaatgccaccggcaacatcgttagctctgtgaatatgatctccagaatgctcattaacaggtttacaatgaagcacaaaaaggctacttatgaaccagacgtcgatttaggctcagggacccgaaacataggaatcgagagcgaaattcccaatctggacatcattggtaaacggatcgagaagataaagcaggaacatgagacatcgtggcactacgaccaagatcatccttataaaacttgggcctaccacggctcttatgagaccaagcagacagggagtgcatccagcatggtgaacggagtcgtgcgtcttctgaccaaaccatgggacgttgtacccatggtgactcagatggccatgacggatacaaccccgttcggccagcaaagagtctttaaggaaaaagtggacactcgcacccaggagcctaaggaaggtacaaagaaactaatgaagatcacggctgagtggctctggaaagagctggggaagaaaaagacccccaggatttgtactcgggaagagttcacaagaaaagttcgctcaaatgcggccttgggagcaatctttaccgatgaaaacaagtggaagtccgctagggaggccgtggaagacggccgattctgggagctggtcgatcgggagagaaatctccaccttgaaggcaaatgcgagacttgtgtgtacaacatgatggggaagagggagaagaagctgggagagtttggtaaagcaaagggctctcgcgccatttggtatatgtggttaggggctcgtttcctggaatttgaggccttgggattcctcaatgaggaccattggtttagccgggaaaacagtctgtccggcgtagagggtgaagggctacacagacttggatacatcctgagggatgtgggcaagaaagagggcggggcgatgtacgcagacgatacagccggatgggacacccgcattacactcgaagacctgaagaatgaggagatggttactaaccatatgaaaggtgaacacaagaaattggctgaggccatattcaagctgacctatcagaataaggtcgtgcgagtgcagcggccaacgcctagaggcaccgtcatggatatcattagcaggcgcgaccaaagagggtctggacaggttggcacatacggtctcaacacttttaccaatatggaagcacagcttatccggcaaatggagggggagggaatcttcaaatcaattcagcatctgacagctactgaagagatagccgtgcagaactggttagctagggtaggccgtgaacgactgagtcgcatggccatctccggcgatgactgcgtggtcaagcccattgatgacagattcgcaagcgcgttgaccgccctcaatgatatggggaaagtgcggaaggacatccagcaatgggagccatctaggggatggaacgattggacgcaggttcccttttgctcgcaccacttccatgaactggtgatgaaagacggtcgcgtcctagtggtaccttgtagaaaccaggatgagcttattggccgggctaggatctcacagggggccggatggagcctgaaggagacagcatgcctcggcaagtcctatgctcaaatgtggaccctgatgtactttcaccgacgtgacttgagattagccgcaaatgccatatgtagtgcggttccaccgcattgggtgcccacttctcgcacaacctggagcatccacgctaaacacgaatggatgactaccgaggatatgctggccgtctggaaccgggtgtggattcaggaaaatccttggatggaggacaagacaccagtggaatcctgggaggaggtcccctatctcggtaaaagggaagaccagtggtgcgggtcacttatcggactgacgagtagagcaacctgggccaagaacattcagactgctatcaatcaagttcgctctctaataggcaacgaggaatacacagattatatgcctagcatgaaacggttcaggcgagaggaagaggaggccggcgtgctgtggtga

SEQ ID NO: 14509 - RNA, 9876 nt, synthetic construct
  misc_feature 1..9876: note = derived and/or modified CDS sequence (opt3) from DENV-2__FJ744745__SS-prME
  source 1..9876: mol_type = other RNA
accgccggcgtgatagtcatgctgattccaacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgaagatggataaacttcaactgaaggggatgagctacagtatgtgtacaggaaagttcaaaatcgtgaaggaaatcgctgagactcagcacggcaccattgtaatccgcgttcagtatgagggtgacgggtctccatgcaaaattcccttcgaaataacggatttggagaagagacatgtgctcggcaggctgatcaccgtcaacccgattgtgacagaaaaagactcccctgtcaacatcgaggccgaacccccatttggagatagctacatcattataggcgtggagcctgggcagttaaagctgaattggttcaagaaaggatcgtctatcggtcaaatgtttgagactaccatgcggggcgctaagcgaatggccattctaggggacacagcatgggatttcggatccctcggcggtgtttttacttcaatcgggaaagccctgcaccaggtgttcggcgctatttacggagcggcatttagtggcgtaagctggaccatgaagatccttataggggtcatcattacgtggatcggaatgaactcccgctctactagcttgtcagtgagtctggttctcgtgggcgtcgtgaccctgtatcttggtgccatggtacaggctgactccgggtgtgtggttagctggaaaaataaggaactgaagtgcggatctggcattttcatcactgataacgtccacacatggaccgagcagtacaaatttcaacccgaatcaccaagtaagttggccagcgcaatacagaaagcccatgaggaaggtatttgtggcatcagatccgtgactaggctcgagaatctgatgtggaagcagattacccccgagttaaaccacatcctgtctgaaaatgaggtgaaactaacaataatgacgggggacatccggggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggtcgaagactacggctttggtgttttcaccacgaacatttggctcaagctgcgtgagaaacaggacgtgttttgtgattctaagttaatgagcgctgccatcaaagacaatcgggcagtgcacgccgatatggggtattggatagaatccgctctgaacgacacatggaagatggagaaggcctcattcattgaggtaaaaagctgccactggcctaagtctcataccctttggtccaatggagtcttggaaagtgagatgatcatccccaaaaatttcgcaggccccgtgagccagcacaactaccgacctggttatcatactcaaaccgctggcccatggcacctcgggaagctggaaatggattttgacctatgtgagggaacaactgttgtggtcaccgaagattgcggcaatagagggccctctctgaggacaacgaccgcctccggaaaactcattactgagtggtgctgtcgctcatgcacactgccgcctcttcggtacagaggcgaggacggttgttggtacgggatggaaatcaggccattgaaggagaaggaagagaacctggtgaatagtttagttaccgcgggacatggccagattgataacttcagcctcggtgtgctgggcatggccctttttctggaagagatgttgcgcactcgaatagggacaaaacacgctatcctcctggtagcagtctcgttcgtgaccctaattacgggaaatatgtcctttcgggacctgggccgtgtgatggtcatggttggggccactatgaccgatgacatcggaatgggcgtgacatatctcgctctgcttgccgcattcaaggtaagacccacctttgcggccggtttgctgttaaggaaactcacttctaaggagctgatgatggctacaattgggatcgcccttctgagccagtcaaccatacctgaaacaatcctagagctcactgatgcactggctttgggaatgatggtgctgaaaattgtccgcaacatggaaaagtaccaattagccgtgaccatcatggcaattagttgcgttcccaatgccgtgatcctccagaacgcttggaaggtctcctgtacgatactggcggccgtgtctgttagcccacttctgttgacatcctcacagcagaaagcagactggattcctctcgctctgaccatcaagggcctaaatcccactgccatcttcctgaccacacttagccggacaagtaaaaagagatcttggccactcaacgaggccattatggctgtgggcatggtctccatactggcaagctcgttgctgaaaaatgacatcccgatgaccgggcctttagtagccggaggtctcctgacggtgtgctatgttcttacaggcaggtcagcggatctggaattggagcgagctgccgacgtgaagtgggaggatcaagcagaaatttctgggagttcccccatcctcagcattaccatctctgaggacggaagcatgtccatcaaaaacgaagaggaggaacagactctgacaatcctaattcgcaccggcctgcttgtcatctcaggtgtgtttccagtaagtattcccatcactgccgctgcatggtacctctgggaggtgaagaagcagcgggccggggtcctgtgggatgttcctagcccaccccctgtggaaaaagcggagttggaagacggagcttatagaataaagcagaggggcattttaggctactctcaaatcggggccggagtgtataaagagggtacattccacaccatgtggcatgtcacgcgtggcgcagtgctgatgcaccgcgggaagcggatcgagccgtcctgggccgatgttaaaaaggacctcatttcatacggaggcggttggaagctggaaggggagtggaaagaaggagaggaagtacaggtgcttgctctggagccaggcaagaatcccagagccgtccagactaaacctggcatctttaagaccaacacagggaccataggagcagtgagtttggatttcagcccaggtacatccggctctcccattgttgacaggaaagggaaggtggtcggactatacggcaatggtgtggtaactcgatcgggggcttatgtcagcgccatcgcgcagaccgagaagtcaattgaagataaccctgagatcgaagacgatatatttcggaaaaagcgcctgacgattatggacctccatccgggagccggcaaaacaaagagatacctgcccgcaatcgtgagggaggctatcaaacggggccttcgaactttaattctggccccaaccagagttgtggctgcagaaatggaggaggccctccgcgggttgcctatcaggtatcaaacacccgccattaagaccgaacacactggacgtgagatagtcgacctgatgtgtcatgctaccttcacaatgcggctcctgtccccagtgagagttcctaactacaatcttatcattatggatgaagcgcacttcacggaccccgcaagtatcgccgctaggggttatatctctactcgcgtggagatgggcgaggccgcagggatttttatgaccgccacaccaccgggaagccgagatcctttcccccagtccaacgctccaataatggacgaagagagagaaatccccgagcggtcatggaactctggccacgaatgggtcaccgattttaagggtaaaactgtgtggttcgtacctagcattaaggcggggaacgacatcgccgcatgcctgaggaaaaatggaaagaaagtgattcagttgagtcgcaagacatttgattccgagtacgttaagacccgtgctaacgactgggatttcgtcgtgacgactgacatcagcgagatgggcgccaattttaaagcagaaagagtgatagatccacggaggtgtatgaagcccgtcatcctaacagacggcgaggaacgcgtaattctggccgggcctatgccggtgacccattcttcagctgcccaacgaagaggacggatcggtaggaaccccaaaaatgagaacgaccagtatatttacatgggcgaacccctcgagaatgatgaggactgcgcgcactggaaggaagcaaaaatgttactggataacatcaatacccctgaggggataattccctccatgttcgaaccagagcgcgaaaaggttgacgccatcgatggagagtacagacttaggggcgaggctcggaaaacttttgtggacctgatgcgtcgcggtgatctccctgtctggttggcctataaggtggctgcagaagggattaactacgccgaccgaaagtggtgtttcgatggcatcaaaaataaccagatactggaggaaaacatggaggttgagatctggacaaaggaaggagagaggaaaaagctcaaacccagatggctggacgctcggatttatagtgatccacttgccctaaaggaatttaaggagttcgcagcgggccgcaaaagcctgaccttgaatttaatcacagaaatggggagactgcctactttcatgacgcagaaggccaggaacgctctcgacaatctggccgtgcttcataccgcagaggctggaggtcgggcctacaaccacgcactgtcggagctcccggaaacattggagactctgctactgctcacccttctggccacagtcaccggcgggatatttttattcttgatgtctggaaaaggcatcggtaagatgactctggggatgtgctgcataattacggcttccaccctcctgtggtatgcgcaaatccagccccactggatcgccgcaagcattatccttgaatttttcctgatagtgctcttgattccagagcctgaaaaacagcgaacaccccaggataatcaactgacttacgtagtgatcgctattttaaccgttgtcgccgccacaatggcaaacgagatgggctttctagagaagaccaagaaagacctgggactcggctcaatcactacacaggaaagtgagtctaatatacttgacatcgatctgagaccagcttccgcctggacgttgtatgcggtggctaccactttcgtgacacctatgctgcgccatagcattgaaaactcaagtgtcaatgttagcctcaccgccatcgcaaaccaggccaccgtgctgatggggcttggaaagggttggcccctctccaaaatggacattggcgtaccgctgttggctatcgggtgttactctcaggtgaatccaattacactgactgcagccttactactgctcgtcgcgcactacgctatcataggacctggccttcaagccaaggcaacgagggaggcccagaaacgggctgccgcaggtattatgaagaaccccaccgtggatgggatcacagttatcgacctggaaccaattccctatgatcctaagtttgagaaacagttgggccaggtgatgctgctcatactgtgcgtcactcaagtacttatgatgcgtaccacatgggctttatgtgaggccctgaccctcgcgactggaccgatcagcacgttgtgggaaggcaatcccgggagattctggaacacaaccattgccgtgtccatggcaaatatctttaggggatcatacctggctggcgccggtctactgttctctattatgaagaacactaccaatacacgccgggggactggaaacatcggcgagaccctcggtgaaaaatggaagagtcgacttaacgcactgggcaaatcggagtttcagatatataagaaaagcgggatccaggaggttgacagaacattggctaaggaaggaattaagaggggcgagacggatcatcacgccgtgtcccgcgggtctgccaaactgcggtggttcgtcgaaagaaatatggtgaccccagagggaaaggtcgtggacctcggctgcggtcgtgggggatggtcatactattgtggcggtctgaaaaacgttagggaagtgaagggcttaactaaagggggacctggccatgaggagcccatccctatgagcacatacgggtggaatcttgtacggctgcaatccggagtggatgtctttttcaccccacccgaaaagtgcgacactctcctatgtgatattggcgagagttctcctaacccaacaatcgaagcgggtcgcaccctgcgagttttgaatctggtggagaactggctcaataacaatacgcagttctgcataaaggtccttaacccctatatgccgagcgtgattgagaaaatggaggctctgcagagaaagtacgggggagcattggtaaggaatcctctgtcacggaactccacccacgagatgtactgggtgagtaatgccagcggcaacatcgtttcttccgtgaatatgatctcacgcatgctcattaacagatttacaatgaaacacaagaaagctacttatgaaccagacgtcgatttaggcagcgggaccaggaacataggaatcgagtcggaaattcccaatctggacatcattggtaagcgaatcgagaagataaaacaggaacatgagacatcttggcactacgaccaagatcatccttataagacttgggcctaccacggcagttatgagaccaaacagacagggtccgcaagctcaatggtgaacggagtcgtgcggcttctgaccaagccatgggacgttgtacccatggtgactcagatggccatgacggatacaaccccgttcggccagcaacgtgtctttaaagaaaaggtggacactagaacccaggagcctaaggaaggtacgaaaaagctaatgaaaatcacagctgagtggctctggaaggagctggggaaaaagaaaaccccacgcatgtgtactagggaagagttcacacggaaggttagatccaatgcggccttgggagcaatttttaccgatgaaaacaagtggaaatctgctcgcgaggccgtggaagacagcaggttctgggagctggtcgatcgagagcggaatctccaccttgaaggcaagtgcgagacttgtgtgtacaacatgatgggcaaaagagaaaagaaactgggggagtttggaaaggcaaagggtagtagggccatctggtatatgtggttaggcgctcgcttcctggaatttgaggccttggggttcctcaatgaggaccattggttttcccgtggaaacagcctgtctggcgtagaaggtgaggggctacaccggcttggatacattctgagagatgtgggcaaaaaggaaggcggggcgatgtacgcagacgatacagccggatgggacaccaggatcacactcgaggacctgaaaaatgaagagatggttactaaccatatgaagggtgagcacaaaaagttggctgaagccattttcaagctgacctatcagaataaagtcgtgcgcgtgcagcgaccaacgcctcggggcaccgtcatggatataatctcaagaagggaccaacgcgggagtggacaggttggcacatacggtctcaacacttttaccaatatggaggcacagcttattagacaaatggaaggggagggaatcttcaagtccatccagcatctgacagctactgaggaaattgccgtgcagaactggttagctcgggtaggcagggagcgtctgagccgaatggccatatctggcgatgactgcgtggtcaaacccatcgatgaccgcttcgcatcggcgttgaccgccctcaatgatatggggaaggtgagaaaagacattcagcaatgggaaccatcacggggatggaacgattggacgcaggttcccttttgcagccaccacttccatgagctggtgatgaaggacggtagggtcctagtggtaccttgtcgcaaccaggatgaacttatcggcagagctcggatttcccagggggccggatggagtctgaaggagacagcatgcctcggcaaatcttatgctcaaatgtggaccctgatgtactttcacaggcgagacttgcgtttagccgcaaatgccatctgtagcgcggttccaccgcattgggtgcccacttccagaacaacctggtcaatacacgctaagcacgagtggatgactaccgaagatatgctggccgtctggaaccgcgtgtggatccaggagaatccttggatggaagacaaaacaccagtggagagttgggaagaggtcccctatctcggtaagcgggaggaccagtggtgcgggtctcttattggactgacgagcagggcaacctgggccaaaaacatccagactgctattaatcaagttagatccctaatcggcaacgaagagtacacagattatatgccttcaatgaagcgcttccggagggaagaggaagaggccggcgtgctgtggtga

SEQ ID NO: 14510 - RNA, 9876 nt, synthetic construct
  misc_feature 1..9876: note = derived and/or modified CDS sequence (opt3) from DENV-2__FJ744705__SS-prME
  source 1..9876: mol_type = other RNA
accgccggagtgatcgtcatgctgattcccaccgctatggcattccacctcactacgagaaatggggagcctcatatgatagttgggaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgattctccatgcaagattcccttcgaaataacggacttggagaaaaggcatgtgctcgggcggctgatcaccgtcaacccgattgtgacagaaaaggattcccctgtcaacatcgaggccgaacccccatttggcgacagctacatcattataggagtggagcctggccagttaaaactgaattggttcaagaaggggtcgtctatcggacaaatgtttgagactaccatgcgaggtgctaaacgcatggccattctaggcgatacagcatgggacttcgggtccctcggaggcgtttttacttcaatcggtaaggccctgcaccaggtgttcggggctatttacggcgcggcatttagtggagtaagctggaccatgaaaatccttataggcgtcatcattacgtggatcgggatgaactccagatctactagcttgtcagtgagtctggttctcgtgggagtcgtgaccctgtatcttggcgccatggtacaggctgattccggttgtattgtgagctggaagaataaagaactgaagtgcgggtctggaatcttcataactgacaacgttcacacatggaccgagcagtacaagtttcaacccgaatcaccaagtaaattggccagcgcaattcagaaggcccatgaggaaggcatctgtggtattaggtccgtcactcggctcgagaatctgatgtggaaacagatcacccccgagttaaaccacatactgtctgaaaatgaggtgaagctaacaatcatgacgggcgatattcgcgggatcatgcaggctggaaaaagatcgctcaggcctcaaccaaccgaactgaagtatagctggaaaacttggggcaaggccaagatgctttccacagagtcacataaccagaccttcttgattgacgggccggaaacagtggagtgccccaatactaaccgtgcatggaatagtctggaggtcgaagactacggatttggcgttttcaccacgaacatctggctcaaactgcgggagaagcaggatgtgttttgtgactctaaattaatgagcgcggctataaaggataatcgagccgtgcacgcagacatgggttattggattgaatccgccctgaacgatacatggaaaatggagaaggcttcattcatcgaggtaaagagctgccactggcctaaatctcataccctttggtccaatggggtcttggaaagtgagatgatcattccaaagaacttcgccggacccgtgagccagcacaactacagacctggctatcatactcaaaccgcaggtccatggcacctcggcaaactggaaatggactttgatctatgtgaggggacaactgttgtggtcaccgaagactgcggaaataggggcccctctctgcgcacaacgaccgcttccgggaagctcatcactgagtggtgctgtcggtcatgcacactgccgcctcttagatacaggggagaggatggctgttggtacggtatggaaattcgcccattgaaagagaaggaagagaacctggtgaatagtttagttaccgccgggcatggacagatagacaacttcagcctcggcgtgctgggtatggcgctttttctggaagagatgttgcgaactcggatcggcacaaagcacgccattctcctggtagctgtctcgttcgtgaccctaatcacggggaatatgtcctttcgtgatctgggaagagtgatggtcatggttggcgcaactatgaccgacgatattgggatgggagtgacatatctcgccctgcttgctgccttcaaagtaaggcccacctttgcagcgggcttgctgttacgcaagctcacttctaaagagctgatgatggccacaatcggtatagcacttctgagccagtcaaccatccctgaaacaattctagagctcactgacgccctggcattggggatgatggtgctgaagatcgtccggaacatggaaaaataccaattagctgtgaccattatggccatcagttgcgttcccaatgcagtgatactccagaacgcctggaaggtctcctgtacgattctggctgcggtgtctgttagcccacttctgttgacatcctcacagcagaaggccgactggatccctctcgcactgaccatcaaaggactaaatcccactgctattttcctgaccacacttagcagaacaagtaagaaaaggtcttggccactcaacgaggccataatggccgtgggcatggtctccatcctggctagctcgttgctgaagaatgatattccgatgaccggccctttagtagcagggggactcctgacggtgtgctatgttcttacaggtcgatcagccgacctggaattggagcgcgcggctgatgtgaaatgggaggaccaagccgaaatctctggcagttcccccattctcagcatcaccatatctgaggatgggagcatgtccatcaagaacgaagaggaggaacagactctgacaattctaatccggaccggactgcttgtcatttcaggcgtgtttccagtaagtatccccataactgcagccgcttggtacctctgggaggtgaaaaagcagagagctggtgtcctgtgggacgttcctagcccaccccctgtggaaaaggccgagttggaagatggggcgtataggattaaacagcgtggaatcttaggctactctcaaatcggcgctggggtgtataaggagggaacattccacaccatgtggcatgtcacgcgcggtgccgtgctgatgcaccggggcaaaagaattgagccgtcctgggcagacgttaagaaagatctcatctcatacgggggaggctggaagctggaaggtgagtggaaggaaggggaggaagtacaggtgcttgccctggagccaggcaagaatcccagggctgtccagactaagcctggcatatttaaaaccaacacaggcaccattggggccgtgagtttggacttcagcccaggaacatccggttctcccatcgttgatcgaaagggcaaagtggtcgggctatacggaaatggcgtggtaactcggtcgggtgcatatgtcagcgctattgcccagaccgagaagtcaatcgaagacaaccctgagatagaagatgacatttttcgcaagaaaagactgacgatcatggacctccatccgggggcgggaaagacaaaaaggtacctgcccgccatcgtgcgggaggcaattaagcgaggccttagaactttaatcctggctccaacccgcgttgtggccgctgaaatggaggaggcactcaggggcttgcctattcgttatcaaacacccgccataaaaaccgaacacactgggcgggagatcgtcgatctgatgtgtcatgccaccttcacaatgagactcctgtccccagtgagggttcctaactacaatcttattatcatggacgaagctcacttcacggatcccgcgagtatcgcagcccgcggatatatttctactcgagtggagatgggtgaggctgccggcatatttatgaccgcaacaccaccggggagcagagaccctttcccccagtccaacgccccaatcatggatgaagaacgggaaattcccgagaggtcatggaactctggacacgaatgggtcaccgactttaagggcaagactgtgtggttcgtacctagcatcaaagctggtaacgatattgcggcctgcctgcgcaagaatgggaaaaaggtgatccagttgagtcgtaaaacatttgactccgagtacgttaagaccagagcaaacgattgggacttcgtcgtgacgactgatataagcgagatgggagctaattttaaggccgaacgggtgatcgacccaaggcgctgtatgaaacccgtcattctaacagacggcgaggaacgagtaatcctggcaggccctatgccggtgacccattcttcagccgctcaaagacgggggaggattggacgcaacccaaagaatgagaacgatcagtatatctacatgggtgaacccctcgagaatgacgaggattgcgcccactggaaagaagcgaagatgttactggacaacataaatacccctgagggcattatcccctccatgttcgaaccagagagagaaaaagttgatgcaattgacggggagtacaggcttcggggagaggcccgtaagacttttgtggatctgatgcgccgaggcgacctccctgtctggttggcttataaagtggccgctgaaggtatcaactacgcagatagaaagtggtgtttcgacgggataaagaataaccagatcctggaggaaaacatggaggttgagatttggacaaaagaaggcgagaggaagaaactcaagccccggtggctggatgcccgcatctatagtgacccacttgctctaaaagaatttaaggagttcgccgcaggaagaaagagcctgaccttgaatttaattacagaaatgggcaggctgcctactttcatgacgcagaaagcgcggaacgccctcgataatctggctgtgcttcataccgccgaggcagggggacgagcttacaaccacgccctgtcggagctcccggaaacattggagactctgctactgctcacccttctggcaacagtcaccggtggcatctttttattcttgatgtctgggaagggaataggcaaaatgactctgggtatgtgctgcattatcacggcctccatcctcctgtggtatgctcaaattcagccccactggatcgcggccagcataattcttgaatttttcctgatcgtgctcttgattccagagcctgaaaagcagagaacaccccaggacaatcaactgacatacgtagtgatcgcaatattaactgttgtcgctgccaccatggccaacgagatggggtttctagagaaaacaaagaaggacctgggcctcggatcaatcaccactcaggaaagtgagtctaatattcttgatatcgacctgcgcccagcatccgcttggacattgtatgccgtggcgacgaccttcgtgactcctatgctgaggcatagcattgaaaactcaagtgtcaatgttagcctcacagctatcgccaaccaggcaaccgtgctgatgggccttgggaaaggatggcccctctccaagatggatattggtgtaccgctgttggccatcggctgttactctcaggtgaatccaataaccctgacagctgcattactactgctcgtcgcccactacgcgattatcgggcctggacttcaagctaaagccactcgggaggcacagaagcgtgccgctgccggcatcatgaaaaaccccacggtggacggtattaccgttatagatctggaaccaatcccctatgaccctaagtttgagaagcagttgggacaggtgatgctgctcattctgtgcgtcacacaagtacttatgatgagaactacctgggcattatgtgaggctctgacactcgccaccggcccgatcagcactttgtgggaaggaaatcccggcaggttctggaacacgacaattgcggtgtccatggccaatatctttcgcgggtcatacctggcaggagctggcctactgttctctataatgaaaaacaccactaatacccggcgaggtacagggaacatcggagagactctcggcgaaaagtggaaaagtagacttaacgccctgggtaagtcggagtttcagatttataaaaagagcggcatccaggaggttgataggaccttggcaaaagaagggattaagcgcggagagacagaccatcacgctgtgtcccggggctctgccaagctgagatggttcgtcgaacgtaatatggtgacgccagaggggaaagtcgtggatctcggatgcggcaggggtgggtggtcatactattgtggaggcctgaagaacgttcgggaagtgaaaggtttaaccaagggcgggcctggacatgaggagcccatccctatgagcacttacggctggaatcttgtacgcctgcaatccggggtggacgtctttttcacaccacccgaaaaatgcgataccctcctatgtgacataggagagagttctcctaacccaactattgaagccggccgaacactgagagttttgaatctggtggagaactggctcaataacaatacccagttctgcatcaaggtccttaacccctatatgccgagcgtgatcgaaaagatggaggcgctgcagaggaaatacggtggggctttggtacggaatcctctgtcacgcaactccacgcacgagatgtactgggtgagtaatgcaaccggaaacattgttagctctgtgaatatgatatccagaatgctcatcaacaggtttacaatgaagcacaaaaaggccacttatgaaccagatgtcgacttaggctcaggcacccgaaacattgggatcgagagcgaaattcccaatctggacatcataggaaaacggatcgagaagattaagcaggaacatgagacatcgtggcactacgatcaagaccatccttataaaacttgggcttaccacggttcttatgagaccaagcagacaggcagtgcctccagcatggtgaacggggtcgtgcgtcttctgaccaaaccatgggatgttgtacccatggtgactcagatggcaatgacggacacaaccccgttcggacagcaaagagtctttaaggaaaaagtggatactcgcacccaggagcctaaggaaggcacaaagaaactaatgaagatcacggccgagtggctctggaaagagctgggtaagaaaaagacccccaggatgtgtactcgggaagagttcacaagaaaagttcgctcaaatgctgcgttgggggccatttttaccgacgaaaacaagtggaagtccgcaagggaggctgtggaagatggacgattctgggagctggtcgaccgggagagaaatctccaccttgaaggcaaatgcgagacttgtgtgtacaacatgatgggcaagagggagaaaaagctgggggagtttggaaaagccaagggttctcgcgcaatctggtatatgtggttaggcgcccgtttcctggaatttgaggctttggggttcctcaatgaggatcattggtttagccggggaaacagtctgtccggcgtagaaggtgaggggctacacagacttggatacattctgagggacgtgggcaagaaagaaggcggggccatgtacgcggatgacacagcaggatgggacacccgcataacactcgaggatctgaagaatgaagagatggttactaaccatatgaaaggtgagcacaagaaattggccgaagctatcttcaagctgacctatcagaataaggtcgtgcgagtgcagcggccaacgcctagaggcaccgtcatggacattatcagcaggcgcgatcaaagagggtctggacaggttggcacatacggtctcaacacttttaccaatatggaggcccagcttatccggcaaatggaaggggagggaattttcaaatcaatacagcatctgacagcaactgaggaaatcgctgtgcagaactggttagccagggtaggccgtgagcgactgagtcgcatggctatttccggcgacgattgcgtggtcaagcccatcgacgatagattcgccagcgcattgaccgcgctcaatgacatggggaaagtgcggaaggatattcagcaatgggaaccatctaggggatggaacgactggacgcaggttcccttttgctcgcaccacttccatgagctggtgatgaaagatggtcgcgtcctagtggtaccttgtagaaaccaggacgaacttatcggccgggccaggatatcacagggggctggatggagcctgaaggagacagcctgcctcggcaagtcctatgcacaaatgtggaccctgatgtactttcaccgacgtgatttgagattagctgccaatgcaatctgtagtgccgttccaccgcattgggtgcccacttctcgcacaacctggagcattcacgcgaaacacgagtggatgactaccgaagacatgctggctgtctggaaccgggtgtggatccaggagaatccttggatggaagacaagacaccagtggagtcctgggaagaggtcccctatctcggtaaaagggaggatcagtggtgcgggtcacttattggactgacgagtagagccacctgggcaaagaacatccagactgccataaatcaagttcgctctctaattggcaacgaagagtacacagactatatgcctagcatgaaacggttcaggcgagaagaggaagaggctggcgtgctgtggtga

SEQ ID NO: 14511 - RNA, 9876 nt, synthetic construct
  misc_feature 1..9876: note = derived and/or modified CDS sequence (opt3) from DENV-2__FJ744744__SS-prME
  source 1..9876: mol_type = other RNA
accgccggcgtgatagtaatgctgattccaacagctatggctttccacctcactacgcggaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgaagatggataaacttcaactgaaggggatgagctacagtatgtgtacaggaaagttcaaaatcgtgaaggaaatcgctgagactcagcacggcaccattgtaatccgcgttcagtatgagggtgacgggtctccatgcaaaattcccttcgaaataacggatttggagaagagacatgtgctcggcaggctgatcaccgtcaacccgattgtgacagaaaaagactcccctgtcaacatcgaggccgaacccccatttggagatagctacatcattataggcgtggagcctgggcagttaaagctgaattggttcaagaaaggatcgtctatcggtcaaatgtttgagactaccatgcggggcgctaagcgaatggccattctaggggacacagcatgggatttcggatccctcggcggtgtttttacttcaatcgggaaagccctgcaccaggtgttcggcgctatttacggagcggcatttagtggcgtaagctggaccatgaagatccttataggggtcatcattacgtggatcggaatgaactcccgctctactagcttgtcagtgagtctggttctcgtgggcgtcgtgaccctgtatcttggtgccatggtacaggctgactccgggtgtgtggttagctggaaaaataaggaactgaagtgcggatctggcattttcatcactgataacgtccacacatggaccgagcagtacaaatttcaacccgaatcaccaagtaagttggccagcgcaatacagaaagcccatgaggaaggtatttgtggcatcagatccgtgactaggctcgagaatctgatgtggaagcagattacccccgagttaaaccacatcctgtctgaaaatgaggtgaaactaacaataatgacgggggacatccggggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggtcgaagactacggctttggtgttttcaccacgaacatttggctcaagctgcgtgagaaacaggacgtgttttgtgattctaagttaatgagcgctgccatcaaagacaatcgggcagtgcacgccgatatggggtattggatagaatccgctctgaacgacacatggaagatggagaaggcctcattcattgaggtaaaaagctgccactggcctaagtctcataccctttggtccaatggagtcttggaaagtgagatgatcatccccaaaaatttcgcaggccccgtgagccagcacaactaccgacctggttatcatactcaaaccgctggcccatggcacctcgggaagctggaaatggattttgacctatgtgagggaacaactgttgtggtcaccgaagattgcggcaatagagggccctctctgaggacaacgaccgcctccggaaaactcattactgagtggtgctgtcgctcatgcacactgccgcctcttcggtacagaggcgaggacggttgttggtacgggatggaaatcaggccattgaaggagaaggaagagaacctggtgaatagtttagttaccgcgggacatggccagattgataacttcagcctcggtgtgctgggcatggccctttttctggaagagatgttgcgcactcgaatagggacaaaacacgctatcctcctggtagcagtctcgttcgtgaccctaattacgggaaatatgtcctttcgggacctgggccgtgtgatggtcatggttggggccactatgaccgatgacatcggaatgggcgtgacatatctcgctctgcttgccgcattcaaggtaagacccacctttgcggtgggtttgctgttaaggaaactcacttctaaggagctgatgatggccacaattgggatcgcacttctgagccagtcaaccatacctgaaacaatcctagagctcactgatgccctggcattgggaatgatggtcctgaaaattgtgcgcaacatggaaaagtaccaattagctgttaccatcatggccattagttgcgtgcccaatgcagtcatcctccagaacgcctggaaggtgtcctgtacgatactggctgttgtgtctgtcagcccacttctgttgacatcctcacagcagaaagcggactggattcctctcgccctgaccatcaagggcctaaatcccactgcaatcttcctgaccacacttagccggacaagtaaaaagagatcttggccactcaacgaggctattatggccgtaggcatggtgtccatactggccagctcgttgctgaaaaatgacatcccgatgaccgggcctttagttgctggaggtctcctgacggtgtgctatgtccttacaggcaggtcagcagatctggaattggagcgagccgcggacgtgaagtgggaggatcaagctgaaatttctgggagttcccccatcctcagcattaccatctctgaggacggaagcatgtccatcaaaaacgaagaggaggaacagactctgacaatcctaattcgcaccggcctgcttgtaatctcaggtgtgtttccagtcagtattcccatcactgccgcagcctggtacctctgggaggttaagaagcagcgggctggggtgctgtgggatgtgcctagcccaccccctgtcgaaaaagcagagttggaagacggagcctatagaataaagcagaggggcattttaggctactctcaaatcggggcgggagtgtataaagagggtacattccacaccatgtggcatgttacgcgtggcgctgtactgatgcaccgcgggaagcggatcgagccgtcctgggccgatgtgaaaaaggacctcatttcatacggaggcggttggaagctggaaggggagtggaaagaaggagaggaagtccaggtgcttgcactggagccaggcaagaatcccagagccgttcagactaaacctggcatctttaagaccaacacagggaccataggagctgtgagtttggatttcagcccaggtacatccggctctcccattgtcgacaggaaagggaaggtggtaggactatacggcaatggtgtcgtgactcgatcgggggcctatgttagcgcaatcgctcagaccgagaagtcaattgaagataaccctgagatcgaagacgatatatttcggaaaaagcgcctgacgattatggacctccatccgggagccggcaaaacaaagagatacctgcccgcgatcgtgagggaggccatcaaacggggccttcgaactttaattctggcaccaaccagagtcgtggctgccgaaatggaggaggctctccgcgggttgcctatcaggtatcaaacacccgcaattaagaccgaacacactggacgtgagatagttgacctgatgtgtcatgccaccttcacaatgcggctcctgtccccagtgagagtccctaactacaatcttatcattatggatgaagcccacttcacggaccccgctagtatcgcggcaaggggttatatctctactcgcgtggagatgggcgaggccgctgggatttttatgaccgccacaccaccgggaagccgagatcctttcccccagtccaacgcaccaataatggacgaagagagagaaatccccgagcggtcatggaactctggccacgaatgggtaaccgattttaagggtaaaactgtgtggttcgttcctagcattaaggccgggaacgacatcgctgcgtgcctgaggaaaaatggaaagaaagtcattcagttgagtcgcaagacatttgattccgagtacgtgaagacccgtgccaacgactgggatttcgtggtcacgactgacatcagcgagatgggcgcaaattttaaagctgaaagagtaatagatccacggaggtgtatgaagcccgtgatcctaacagacggcgaggaacgcgttattctggccgggcctatgccggtgacccattcttcagcagcccaacgaagaggacggatcggtaggaaccccaaaaatgagaacgaccagtatatttacatgggcgaacccctcgagaatgatgagaactgcgctcactggaaggaagccaaaatgttactggacaatatcaacacccctgaggggataattccctccatgttcgaaccagagcgcgaaaaggtcgatgcgatcgacggagagtacagacttaggggcgaggcacggaaaacttttgtggatctgatgcgtcgcggtgacctccctgtttggttggcctataaggtggctgccgaagggattaattacgctgatcgaaagtggtgtttcgacggcatcaaaaacaaccagatactggaggaaaatatggaggtcgagatctggacaaaggaaggagagaggaaaaagctcaaacccagatggctggatgcacggatttatagtgacccacttgccctaaaggaatttaaggagttcgctgccggccgcaaaagcctgaccttgaacttaatcacagaaatggggagactgcctactttcatgacgcagaaggcaaggaatgcgctcgataacctggccgtgcttcataccgctgaggccggaggtcgggcatacaatcacgctctgtcggagctcccggaaacattggagactctgctactgctcacccttctggccacagtaaccggcgggatatttttattcttgatgtctggaaaaggcatcggtaagatgactctggggatgtgctgcataattacggcatccatcctcctgtggtatgcccaaatccagccccactggattgctgcgagcatcatacttgaatttttcctgattgtgctcttgatcccagagcctgaaaaacagcgaaccccacaggacaaccaactgacatacgttgtcattgccatcttaactgtggtggcagctaccatggccaatgagatgggctttctagagaagacaaagaaagatctgggactcggctcaataaccactcaggaaagtgagtctaacatccttgacattgacctgagaccagcctccgcatggacattgtatgctgtcgccacgaccttcgttactcctatgctgcgccatagcatcgaaaattcaagtgtgaacgtaagcctcacagcgattgctaatcaggccaccgtgctgatggggcttggaaagggttggcccctctccaaaatggatatcggcgtcccgctgttggcaattgggtgttactctcaggtgaacccaatcaccctgacagccgctttactactgctcgttgcacactacgccataattggacctggccttcaagcgaaggctactagggaggcccagaaacgggcagccgctggtatcatgaagaatcccacggtggacgggatcaccgtcattgatctggaaccaataccctatgaccctaagtttgagaaacagttgggccaggtaatgctgctcatcctgtgcgtgacacaagttcttatgatgcgtactacctgggccttatgtgaggcactgacactcgctaccggaccgattagcactttgtgggaaggcaaccccgggagattctggaatacgacaatcgccgtgtccatggcgaacatttttaggggatcatacctggccggcgcaggtctactgttctctatcatgaagaataccactaacacccgccgggggacaggaaacataggcgagactctcggtgaaaaatggaagagtcgacttaatgctctgggcaaatcggagtttcagatctataagaaaagcgggattcaggaggtcgatagaaccttggccaaggaaggaatcaagaggggcgagacagaccatcacgcagtgtcccgcgggtctgctaaactgcggtggttcgtcgaaagaaacatggtgacgccagagggaaaggttgtggatctcggctgcggtcgtgggggatggtcatactattgtggcggtctgaaaaatgtaagggaagtgaagggcttaaccaaagggggacctggccatgaggagcccattcctatgagcacttacgggtggaaccttgtccggctgcaatccggagttgacgtgtttttcacaccacccgaaaagtgcgataccctcctatgtgacatcggcgagagttctcctaatccaactatagaagccggtcgcacactgcgagtcttgaacctggtggagaattggctcaacaataacacccagttctgcattaaggtacttaatccctatatgccgagcgtgatcgagaaaatggaggccctgcagagaaagtacgggggagcgttggttaggaaccctctgtcaagaaattccacgcacgagatgtactgggtgagtaacgctagcggcaatatcgtctcttccgtgaacatgatttcacgcatgctcataaacagatttaccatgaaacacaagaaagcaacatatgaaccagatgtcgacttaggcagcgggactaggaatatcggaattgagtcggaaatccccaacctggatattatcggtaagcgaatagagaagatcaaacaggaacatgagacctcttggcactacgaccaagaccatccttataagacatgggcctaccacggcagttatgagactaaacagaccgggtccgctagctcaatggtgaatggagttgtacggcttctgacaaagccatgggatgtggtccccatggtgacccagatggccatgactgacacgacaccgttcggccagcaacgtgtttttaaagaaaaggtggataccagaactcaggagcctaaggaaggtaccaaaaagctaatgaaaattacagcagagtggctctggaaggagctggggaaaaagaaaacgccccgcatgtgtaccagggaagagttcactcggaaggtcagatccaacgccgctttgggagcgatctttacagacgaaaataagtggaaatctgcccgcgaggcagtggaagatagcaggttctgggagctggtagaccgagagcggaacctccaccttgaaggcaagtgcgagacctgtgtgtacaatatgatgggcaaaagagaaaagaaactgggggagtttggaaaggctaagggtagtagggccatttggtatatgtggttaggcgcacgcttcctggaatttgaggccttggggttcctcaacgaggatcattggttttcccgtggaaatagcctgtctggcgttgaaggtgaggggctacaccggcttggatacatcctgagagacgtcggcaaaaaggaaggcggggctatgtacgccgatgacactgcgggatgggatacaaggattaccctcgaggacctgaaaaacgaagagatggtgacaaatcatatgaagggtgagcacaaaaagttggcagaagccatattcaagctgacttatcagaacaaagtggtccgcgttcagcgaccaacccctcggggcacggtgatggacatcatttcaagaagggatcaacgcgggagtggacaggtaggcacctacggtctcaatacatttactaacatggaggctcagcttatcagacaaatggaaggggagggaatcttcaagtccattcagcatctgaccgccacagaggaaatagcagtgcagaattggttagctcgggtcggcagggagcgtctgagccgaatggccatctctggcgacgattgcgtggttaaacccattgacgatcgcttcgcttcggccttgactgcactcaacgacatggggaaggtgagaaaagatatccagcaatgggaaccatcacggggatggaacgactggacccaggtccccttttgcagccaccacttccatgagctggtgatgaaggatggtagggtcctagttgtgccttgtcgcaatcaggacgaacttattggcagagcgcggatctcccagggggccggatggagtctgaaggagacggcttgcctcggcaaatcttatgcccaaatgtggacactgatgtactttcacaggcgagatttgcgtttagcagctaacgccatatgtagcgcagtcccaccgcattgggtgcccacctccagaactacatggtcaatccacgccaagcacgagtggatgaccactgaagacatgctggcggtgtggaatcgcgtctggattcaggagaacccttggatggaagataaaaccccagttgagagttgggaagaggtgccctatctcggtaagcgggaggaccagtggtgcgggtctcttatcggactgacaagcagggctacgtgggccaaaaatattcagaccgcaatcaaccaagtaagatccctaataggcaatgaagagtacactgactatatgccttcaatgaagcgcttccggagggaagaggaagaggccggcgtgctgtggtga

SEQ ID NO: 14512 - RNA, 9876 nt, synthetic construct
  misc_feature 1..9876: note = derived and/or modified CDS sequence (opt3) from DENV-2__GQ868646__SS-prME
  source 1..9876: mol_type = other RNA
accgccggcgtgatcgtaatgctgattcccaccgctatggcattccacctcactacgcgtaacggggaacctcatatgatagttggaaggcaggaaaagggtaaaagccttctgtttaagaccgaggacggcgtgaatatgtgcacattgatggccatcgatttaggggaactgtgtgaggacactattacctacaaatgcccattactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggattattcggcaagggcgggatcgtgacctgcgccaaatttacatgcaagaaaaatatggaaggaaaggtggtccagcctgagaacctcgaatacaccattgttataactccacacagcggtgaggagcatgctgtgggcaatgacacggggaaacacggaaaggaaatcaaaattacaccgcagtcctcaatcaccgaggccgaactgactggctatggtaccgtaacaatggagtgtagtcccaggaccgggcttgatttcaacgaaatggtgctgttgcaaatggaggacaaggcatggctcgtccaccggcagtggtttctggatttacctctgccatggctccccggcgctgacactcagggaagcaattggatacagaaggagacacttgtgacgttcaaaaaccctcatgccaagaaacaagacgttgtggtcctgggctctcaggaaggggcgatgcacaccgccttgactggagcaacagagattcagatgtcctcaggtaatctactgtttaccggccatctcaagtgccgtctgcgcatggataaacttcaactgaaggggatgagctacagtatgtgtacaggaaagttcaaaatcgtgaaggaaatcgctgagactcagcacggcaccattgtaatcagagttcagtatgagggtgacgggtctccatgcaaaattcccttcgaaataacggatttggagaagaggcatgtgctcggccggctgatcaccgtcaacccgattgtgacagaaaaagactcccctgtcaacatcgaggccgaacccccatttggagatagctacatcattataggcgtggagcctgggcagttaaagctgaattggttcaagaaaggatcgtctatcggtcaaatgtttgagactaccatgcgaggcgctaagcgcatggccattctaggggacacagcatgggatttcggatccctcggcggtgtttttacttcaatcgggaaagccctgcaccaggtgttcggcgctatttacggagcggcatttagtggcgtaagctggaccatgaagatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaaaaataaggaactgaagtgcggatctggcattttcatcactgataacgtccacacatggaccgagcagtacaaatttcaacccgaatcaccaagtaagttggccagcgcaatacagaaagcccatgaggaaggtatttgtggcatcaggtccgtgactcggctcgagaatctgatgtggaagcagattacccccgagttaaaccacatcctgtctgaaaatgaggtgaaactaacaataatgacgggggacatccgcggaattatgcaggctggcaagagatcgctcaggcctcaaccaaccgaactgaaatatagctggaagacttgggggaaggccaaaatgctttccacagagtcacataaccagaccttcttgatcgatggaccggaaacagcagagtgccccaatactaaccgtgcgtggaatagtctggaggtcgaagactacggctttggtgttttcaccacgaacatttggctcaagctgcgggacaaacaggatgtgttttgtgactctaagttaatgagcgctgccatcaaagataatcgagcagtgcacgccgacatggggtattggatagagtccgctctgaacgatacatggaagatggaaaaggcctcattcattgaggtaaaaagctgccactggcctaagtctcataccctttggtccaatggagtcttggagagtgaaatgatcatccccaagaatttcgcaggccccgtgagccagcacaactacagacctggttatcatactcaaaccgctggcccatggcacctcgggaagctggagatggactttgatctatgtgaaggaacaactgttgtggtcaccgaggactgcggcaatagggggccctctctgcgcacaacgaccgcctccggaaaactcattactgaatggtgctgtcggtcatgcacactgccgcctcttagatacaggggcgaggatggttgttggtacgggatggagatccgcccattgaaggaaaaggaggaaaacctggtgaatagtttagttaccgcgggacatggccagattgacaacttcagcctcggtgtgctgggcatggcccttctgttggaggaaatgctccgaactcggatagggacaaaacacgctatcctgctagtagcagtctcgtttgtgaccctgattacgggaaatatgtccttccgtgatctcggcagagtgatggtcatggttggggccactatgaccgacgatatcggaatgggcgtgacatatctggctcttttggccgcatttaaggtaaggcccaccttcgcggccggtctgttactccgcaaactgacttctaaggagcttatgatggctacaattgggatcgccctgctaagccagtcaaccatacctgagacaatcctcgaactgactgacgcattggctctgggaatgatggtgttaaaaattgtccggaacatggagaagtaccaactcgccgtgaccgttatggcaatcagttgcgtgcccaatgccgtcattctgcagaacgcttggaaggtgtcctgtacgatccttgcggccgtttctgtgagcccactgttgctcacatcctcacagcagaaagcagactggatacctctggctctaaccattaagggcctgaatcccactgccatctttcttaccacactcagcagaacaagtaaaaagaggtcttggccactgaacgaagccatcatggctgtcggcatggtatccattttggcaagctcgctgctcaaaaatgatataccgatgaccgggcctctagtggccggaggtctgcttacggtttgctatgtgctgacaggccgatcagcggacttggagctcgaacgcgctgccgatgtcaagtgggaggaccaagcagagatctctgggagttcccccattctgagcatcaccatttctgaagatggaagcatgtccatcaaaaacgaggaagaggagcagactctaacaatactgatccggaccggccttctcgtgatttcaggtgtattcccagtgagtatccccattactgccgctgcatggtacctgtgggaagtcaagaagcagagagccggggttttgtgggacgtgcctagcccaccccctgtggagaaagcggaattagaggatggagcttataggatcaagcagcgtggcatactgggctactctcaaattggggccggagtctataaagaaggtacatttcacaccatgtggcatgtgacgcgcggcgcagttctcatgcaccgggggaagagaatcgagccgtcctgggccgacgtcaagaaagatctgatctcatacggaggcggttggaaacttgagggggaatggaaagagggagaagaggtgcaggtcctggctttggaaccaggcaaaaatcccagggccgtgcagactaaacctggcattttcaagaccaacacagggaccatcggagcagttagtctagactttagcccaggtacatccggctctcccatagtggatcgaaaagggaaggtcgtgggactgtacggcaatggtgtagtcactcggtcgggggcttatgtgagcgccattgcgcagaccgagaagtcaatcgaggacaaccctgaaattgaggatgacatcttccgcaaaaagagactcacgataatggacctgcatccgggagccggcaaaacaaagaggtaccttcccgcaattgttcgggaagctatcaaacgaggcttaagaactctgatcctcgccccaacccgcgtggtcgctgcagagatggaagaggccttgagggggctgcctattcgttatcaaacaaccgccatcaagactgagcacaccggacgggaaattgtggatctcatgtgtcatgctacatttacgatgagactgctttcccccgttagggtgccaaactacaatctgataatcatggacgaggcgcacttcactgatcctgcaagtattgccgctcgcggttatatctctacccgagtcgaaatgggcgaggccgcagggatcttcatgacagccacaccaccaggaagcagagacccgtttcctcagtccaacgctcccattatggatgaggaacgggagataccagaaaggtcatggaactctggccacgagtgggtgactgacttcaagggtaaaacagtatggtttgtgcccagcatcaaggcggggaacgatattgccgcatgcttgcgcaaaaatggaaagaaagttatccagctaagtcgtaagaccttcgactccgaatacgtcaagacgagagctaacgattgggactttgtggtgactacagatattagcgagatgggcgccaatttcaaagcagagcgggtcatcgaccctaggcgctgtatgaagccagtaatactgaccgacggcgaagaacgagtgatcctcgccgggcccatgcctgttacccattcttcagctgcccaaagacggggaaggattggtcgcaacccgaaaaatgaaaacgatcagtatatctacatgggcgagccattagaaaatgacgaggattgcgcgcactggaaggaggcaaaaatgctgcttgacaacattaatactcccgaagggatcataccttccatgtttgagcccgaaagagagaaggtggatgccattgacggagaatacaggctgcggggcgaggctcgtaaaacattcgtcgatctcatgcgccgaggtgacttgccagtgtggctggcctataaggttgctgcagaggggatcaactacgccgatagaaagtggtgttttgacggcattaaaaataaccagatcctcgaagagaacatggaagtggagatatggaccaaggagggagaaaggaaaaagctgaaacctcggtggcttgatgctcgcatctatagtgaccccctagccctgaaggagttcaaggaatttgcagcgggcagaaagagcttgacattaaatctgattactgagatggggaggctcccaacgttcatgacccagaaggcccggaacgctctggataatcttgccgtcctgcatacagcagaagctggaggtcgagcctacaaccacgcactctcggagttgcctgagactctggaaaccctactgctccttacactgttagccaccgtgactggcgggatcttcttgtttctgatgtctggaaaaggcattggtaagatgacgctcgggatgtgctgcatcataaccgcttccattctgctttggtatgcgcaaatccagccgcactggatcgccgcaagcattatcctggagttctttctcatagtattgctgattcccgaaccagagaaacagagaacacctcaggacaatcaattaacttacgtggttatcgctattctaaccgtcgtggccgccacaatggcaaacgaaatgggcttcctggagaagaccaagaaagacctcggacttggctcaatcactacacaggagagtgaatctaatatactggatatcgacttgcgccccgcttccgcctggacgctgtatgcggtggctaccacttttgtcacaccaatgctcaggcatagcattgagaactcaagtgttaatgtgagcctgaccgccatcgcaaaccaggccaccgtacttatggggctcggaaagggttggcctctgtccaaaatggatattggcgtgcccttgctggctatcgggtgttactctcaggtcaatccgattacattaactgcagccctactgctccttgtggcgcactacgctatcataggaccaggcctgcaagccaaggcaacgcgggaagcccagaaacgtgctgccgcaggtattatgaagaaccctaccgttgacgggatcacagtgatcgatttggagcccattccatatgaccccaagttcgaaaaacagctgggccaggtcatgctcctgatactttgcgtaactcaagtgttaatgatgagaaccacatgggctctgtgtgaggccctcaccttggcgactggacctatcagcacgctgtgggagggcaatccggggaggttttggaacacaaccattgccgtttccatggcaaatatcttccgcggatcatacctagctggcgccggtctgctcttttctattatgaagaacactaccaatacacggcgagggactggaaacatcggcgaaacccttggtgagaaatggaagagtagactgaacgcattgggcaaatcggagttccagatatataagaaaagcgggatccaggaggtggataggacactggctaaggagggaattaagcgcggcgaaacggaccatcacgccgtctcccgggggtctgccaaactcagatggtttgtggagcgtaatatggtcacccccgaaggaaaggtggttgatctgggctgcggtagagggggatggtcatactattgtggcggtcttaaaaacgtgcgggaggtaaagggcctaactaaagggggaccaggccatgaagaacctatccccatgagcacatacgggtggaatctggtgcgcctccaatccggagtcgacgttttctttacccctccagagaagtgcgatactctactgtgtgacattggcgaaagttctcccaaccctacaatcgaggcgggtcgaaccttgagagtgctgaatctcgtcgaaaactggcttaataacaatacgcagttctgcataaaggtgctgaacccatatatgcccagcgtaattgagaaaatggaggctttgcagaggaagtacgggggagcactggtgcggaatccgctctcacgcaactccacccacgagatgtactgggttagtaatgccacaggcaacatcgtgagctctgtcaatatgatctccagaatgttaattaacaggttcactatgaaacacaagaaagctacctatgagcctgatgtggacctgggctcagggacacgaaacataggaatcgaaagcgagattccaaatcttgacatcattggtaagcggatcgaaaagataaaacaggagcatgaaacttcgtggcactacgatcaagaccatccctataagacctgggcctaccacggctcttatgagacaaaacagaccgggagtgcatccagcatggtcaacggagtggttcgtctgctaactaagccttgggatgtagtgccaatggtcacgcagatggccatgacagacaccactccctttggccagcaaagagtgttcaaagagaaggttgatacccgcacacaggaaccgaaggagggtacgaaaaagctcatgaaaatcaccgctgaatggctgtggaaggagttggggaaagagaagactcctaggatgtgtacacgggaagagtttaccagaaaagtgcgctcaaatgcggccctgggagcaattttcactgacgaaaacaagtggaagtccgctagggaggccgtcgaagatggccgattttgggagctcgtggaccgggagagaaatcttcacctggaaggcaaatgcgagacatgtgtatacaacatgatggggaagagggagaaaaagttaggagagttcggtaaagcaaagggctctcgcgccatctggtatatgtggctgggggctagatttttggagttcgaggccctcggatttctgaatgaggatcattggttcagccggggcaacagtctatccggtgtggaaggggagggacttcacagactgggctacattctcagggacgttggcaagaaagaagggggagcgatgtacgcagatgacaccgccggttgggacacacgcatcactctggaggatttgaagaatgaagagatggtcaccaaccatatgaaaggcgagcacaagaaactggctgaagccatttttaagctcacgtatcagaataaggtggtgcgagtccagcggcccaccccaagagggacagttatggacataatcagcaggcgcgatcaaagaggatctggccaggtgggtacttacgggcttaacaccttcacaaatatggaggcacagctgattcggcaaatggaaggagagggcatctttaaatcaatccagcatttaactgctaccgaggaaattgccgtacagaactggctggctagggtgggccgtgagcgattgagtcgcatggccatatccggggacgattgcgtcgtgaagcctatcgacgatagattcgcaagcgcgctcacggccctgaatgacatgggaaaagttcggaaggatattcagcaatgggaaccctctaggggttggaacgactggacacaggtgccattctgctcgcaccactttcatgagctagtcatgaaagatggccgcgtgcttgtagttccctgtagaaaccaggacgaactgatcgggcgggctaggatttcacagggagccggctggagcctcaaggagaccgcatgcctgggtaagtcctatgctcaaatgtggactttgatgtacttccaccgacgtgatttaagactggccgcaaatgccatctgtagtgcggtgccttctcattgggtcccaacaagccgcaccacttggtccatacacgctaaacacgagtggatgaccacagaagacatgctcgccgtgtggaaccgggtgtggatccaggagaatccgtggatggaagacaagacgcccgtcgagtcatgggaagaggttccttatcttgggaaaagggaggatcagtggtgcggaagtctgattggcctaacctctagagcaacttgggccaagaacatccagacagctattaatcaagtgcgcagcctgatcggcaacgaagagtacaccgactatatgccatccatgaaacggtttaggcgagaagaggaagaggccggggtactctggtga

SEQ ID NO: 14513 - RNA, 9876 nt, synthetic construct
  misc_feature 1..9876: note = derived and/or modified CDS sequence (opt3) from DENV-2__FJ906961__SS-prME
  source 1..9876: mol_type = other RNA
accgccggagtgatcgtcatgctgattcccacagctatggcattccacctcactacgagaaatggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaatgaaccggaggatatcgactgttggtgcaattccacatctacctgggtgacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctaccagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatccgcggaattatgcaggctggcaaaagatcgctcaggcctcaaccaaccgaactgaagtatagctggaaaacttgggggaaggccaagatgctttccacagagccgcataaccagaccttcttgatcgatggacccgaaacagcagagtgccctaatactaaccgtgcgtggaactcactggaggtcgaagactacggctttggtgttttcaccacgaacatttggctcaaactgcgggagaagcaggaagtgttttgtgacagtaaattaatgtctgctgccatcaaggataatcgagcagtgcacgccgacatggggtattggatagagagcgctctgaacgatacatggaaaatggagaaggcctccttcattgaagtaaagtcatgccactggccaaaaagccataccctttggtctaatggagtcttggagtccgaaatgatcatccccaagaacttcgcaggccctgtgagtcagcacaactacagaccaggttatcatactcaaaccgctggcccctggcacctcgggaaactggagatggactttgatctatgtgaaggaacaactgttgtggtcaccgaggactgcggcaatagggggccgagcctgcgcacaacgaccgcctctggaaagctcattactgagtggtgctgtcggtcctgcacactgcctccacttagatacaggggcgaagatggttgttggtacgggatggagatccgccccttgaaagaaaaggaggaaaacctggtaaattcattagttaccgcgggacatggccagattgacaacttcagtctcggtgtgctgggcatggccctttttctggaggagatgttgcgaactcggatagggacaaagcacgctatcctcctggtagcagtcagcttcgtgaccctaattacgggaaatatgtcgtttcgtgatctgggcagagtgatggtcatggttggggccactatgaccgacgatatcggaatgggcgtgacatatctcgctctgcttgccgcattcaaagtaaggcctacctttgcggccggtttgctgttacgcaagctcacttccaaagaactgatgatggctacaattgggatcgcccttctgtctcagagcaccatacccgagacaatcctagaactcactgacgcactggctttgggaatgatggtgctgaagattgtccggaacatggagaaataccaattagccgtgaccatcatggcaatttcatgcgttccaaatgccgtgatcctccagaacgcttggaaggtcagttgtacgatactggcggccgtgtccgtttctcctcttctgttgacaagctcccagcagaaggcagattggattcccctcgctctgaccatcaaaggcctaaatccaactgccatcttcctgaccacactttcaagaactagcaagaaaaggagttggccgctcaacgaagccattatggctgtgggcatggtctctatactggcatccagcttgctgaagaatgacatccctatgaccgggcccttagtagccggaggtctcctgacggtgtgctatgttcttacaggccgatcggcggacctggagttggagcgcgctgccgatgtgaaatgggaagaccaagcagagatttcagggtctagtccaatcctctccattaccatcagcgaagatggatctatgagcataaagaacgaggaggaagaacagactctgacaatcctaattcggaccggcctgcttgtcatctccggtgtgtttcccgtatcaattcctatcactgccgctgcatggtacctctgggaagtgaaaaagcagagagccggggtcctgtgggacgttccaagtccccctccggtggagaaggcggaattggaggatggagcttataggataaaacagcgtggcattttaggctacagccaaatcggggccggagtgtataaggagggtacattccacaccatgtggcatgtcacgcgcggcgcagtgctgatgcaccgggggaaaagaatcgaaccatcttgggccgacgttaagaaagatctcatttcctacggaggcggttggaagctggagggggaatggaaggagggagaagaggtacaggtgcttgctctggagcccggcaaaaatcctagggccgtccagactaagccaggcatctttaaaaccaacacagggaccataggagcagtgtcattggacttcagtcccggtacaagcggctcccctattgttgatcgaaaggggaaagtggtcggactatacggcaatggtgtggtaactcggtctggggcttatgtctcggccatcgcgcagaccgaaaagagcattgaggacaacccggaaatcgaggatgacatatttcgcaagaaaagactgacgattatggatctccatcccggagccggcaagacaaaaaggtacctgccagcaatcgtgcgggaagctatcaagcgaggccttagaactttaattctggcccctacccgcgttgtggctgcagagatggaggaagccctcagggggttgcccatccgttatcaaacaaccgccattaaaactgagcacaccggacgggaaatagtcgacctgatgtgtcatgctacattcacgatgagactcctgtcaccagtgagggttcctaactacaatcttatcattatggacgaggcgcacttcactgatcccgcatccatcgccgctcgcggttatatcagtacccgagtggagatgggcgaagccgcagggatttttatgacagccaccccaccgggatctagagaccctttcccccagagcaacgctccaataatggatgaggaacgggagatccccgaaaggtcctggaactcaggccacgagtgggtcactgactttaagggtaagacagtgtggttcgtaccttctattaaagcggggaacgatatcgccgcatgcctgcgcaagaatggcaagaaggtgattcagttgagccgtaaaacctttgacagtgagtacgttaagacgagagctaacgattgggacttcgtcgtgactacagatatctccgaaatgggcgccaattttaaggcagagcgggtgatagacccaaggcgctgtatgaaacccgtcatcctaaccgatggcgaagaacgagtaattctggccgggcctatgccggtgacccatagctctgctgcccaaagacggggaaggatcggtcgcaacccaaagaatgaaaacgaccagtatatttacatgggcgagcccctcgagaatgacgaagattgcgcgcactggaaagaggcaaagatgttactggacaacatcaatactcctgaagggataattccctcaatgttcgagccagaaagagagaaagttgatgccatcgacggagagtacaggcttcggggcgaagctcgtaagacatttgtggatctgatgcgccgaggtgacctccctgtctggttggcctataaagtggctgcagaggggattaactacgccgatagaaagtggtgtttcgacggcatcaagaataaccagatactggaagagaacatggaggttgaaatctggaccaaagagggagaaaggaagaaactcaagccccggtggctggatgctcgcatttattccgacccacttgccctaaaagagtttaaggagttcgcagcgggcagaaagagtctgacattgaatttaatcactgagatggggaggctgcctacgttcatgacccagaaagcccggaacgctctcgataatctggccgtgcttcatacagcagaggctggaggtcgagcctacaaccacgcactgagcgaactcccggagactttggaaaccctgctactgctcacacttctggccaccgtcactggcgggatatttttattcttgatgtcgggaaagggcatcggtaaaatgacgctggggatgtgctgcataattaccgcttctatcctcctgtggtatgcgcaaatccagccccactggattgccgcatccatcatacttgagtttttcctgattgtgctcttgatcccagaacctgagaagcagagaacaccccaggacaatcaactgacttacgtagtgattgctatcttaaccgttgtcgccgccacaatggcaaacgagatgggctttctagagaagacaaagaaggatctgggactcggcagcataactacacaggagtcagaaagtaatatccttgacattgacctgcgcccagcttctgcctggacgttgtatgcggtggctaccactttcgtgacacctatgctgaggcattccatcgagaacagctcagtcaatgttagtctcaccgccattgcaaaccaggccaccgtgctgatggggcttggaaaaggttggcccctcagcaagatggatatcggcgtaccgctgttggctattgggtgttactcccaggtgaatccaatcacactgactgcagccttactactgctcgtcgcgcactacgctataattggacctggccttcaagccaaagcaacgcgggaagcccagaagcgtgctgccgcaggtatcatgaaaaaccccaccgtggacgggatcacagttattgatctggagccaataccctatgaccctaagtttgagaagcagttgggccaggtgatgctgctcatcctgtgcgtcactcaagtacttatgatgagaaccacatgggctttatgtgaagccctgaccctcgcgactggaccgatttctacgttgtgggagggcaatcccgggaggttctggaacacaaccatcgccgtgagcatggcaaatatttttcgcggatcctacctggctggcgccggtctactgttctcaatcatgaaaaacactaccaatacacggcgagggactggaaacataggcgaaaccctcggtgagaagtggaaatctagacttaacgcactgggcaagagtgagtttcagatctataaaaagtcggggattcaggaagttgataggacattggctaaagagggaatcaagcgcggcgaaacggaccatcacgccgtgagccgggggtccgccaagctgagatggttcgtcgagcgtaatatggtgaccccagaaggaaaagtcgtggatctcggctgcggtaggggagggtggtcttactattgtggcggtctgaagaacgttcgggaggtgaaaggcttaactaaagggggacctggccatgaggaacccattcctatgtcaacatacgggtggaatcttgtacgcctgcaaagcggagtggacgtctttttcaccccacccgagaaatgcgatactctcctatgtgacatcggcgaatccagtcctaacccaacaatagaggcgggtcgaaccctgagagttttgaatctggtggaaaactggctcaataacaatacgcagttctgcattaaggtccttaacccctatatgccgtctgtgatcgagaagatggaggctctgcagaggaaatacgggggagcattggtacggaatcctctgagccgcaactcaacccacgaaatgtactgggtgtccaatgccacaggcaacatcgttagtagcgtgaatatgatttctagaatgctcataaacaggtttactatgaagcacaaaaaggctacctatgagccagatgtcgacttaggctccgggacacgaaacatcggaattgaatcagagatccccaatctggatattatcggtaaacggatagaaaagatcaagcaggagcatgagactagctggcactacgaccaagaccatccttataaaacctgggcctaccacggctcgtatgaaacaaagcagaccgggtctgcaagttccatggtgaacggagtcgtgcgtcttctgactaaaccatgggatgttgtacccatggtgacgcagatggccatgacagacaccactccgttcggccagcaaagagtctttaaggagaaagtggatacccgcacacaggaacctaaggagggtacgaagaaactaatgaagattaccgctgagtggctctggaaagaactggggaagaaaaagactcccaggatgtgtacacgggaggagttcaccagaaaagttcgcagcaatgcggccttgggagcaatctttactgacgagaacaagtggaagtcagctagggaagccgtggaggatggccgattctgggagctggtcgaccgggaaagaaatctccaccttgagggcaaatgcgaaacatgtgtgtacaacatgatggggaagagggagaaaaagctgggagaatttggtaaagcaaagggctcccgcgccatttggtatatgtggttaggggctcgtttcctggagtttgaggccttgggattcctcaatgaagatcattggttttctcggggcaacagcctgagtggtgtagagggggaaggactacacagacttggctacatcctgagggacgtgggcaagaaagaagggggagcgatgtacgcagatgacaccgccggttgggatacacgcattactctcgaagacctgaagaatgaggagatggttaccaaccatatgaaaggcgaacacaagaaattggctgaggccatattcaagctgacgtatcagaataaggtcgtgcgagtgcagcggccaacccctagagggacagtcatggacatcatttccaggcgcgatcaaagaggaagcggccaggttggtacttacgggctcaacacctttacaaatatggaagcacagcttatccggcaaatggagggagagggcatcttcaaatctattcagcatctgactgctaccgaagagatagccgtgcagaactggttagctagggtaggccgtgaacgactgtcacgcatggccatcagtggggacgattgcgtggtcaagcccattgacgatagattcgcatccgcgttgacggccctcaatgacatgggaaaagtgcggaaggatatccagcaatgggagccaagcaggggttggaacgactggacacaggttcccttttgctctcaccacttccatgaactggtgatgaaagatggccgcgtcctagtggtaccttgtagaaaccaggacgagcttattgggcgggctaggatctcgcagggagccggctggtcactgaaggagaccgcatgcctcggtaagagctatgctcaaatgtggactctgatgtactttcaccgacgtgatttgagattagccgcaaatgccatatgttccgcggttccaagtcattgggtgccgacatctcgcaccacttggagcatccacgctaaacacgaatggatgaccacagaggacatgctggccgtctggaaccgggtgtggattcaggaaaatccctggatggaggataagacgcctgtggaatcctgggaggaggtcccatatctcgggaaaagggaagaccagtggtgcggatcacttatcggcctgaccagtagagcaacttgggccaagaacattcagacagctatcaatcaagttcgctctctaataggcaacgaggaatacaccgactatatgcccagcatgaaacggttcaggcgagaggaagaggaggccggggtgctgtggtga

SEQ ID NO: 14514 - RNA, 9876 nt, synthetic construct
  misc_feature 1..9876: note = derived and/or modified CDS sequence (opt3) from DENV-2__FJ906962__SS-prME
  source 1..9876: mol_type = other RNA
acagccggagtgatcgtaatgctgattcccacggctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtggacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctaccagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgagataaagctaacaatcatgacgggggacattcgcggaatcatgcaggctggcaaaagatcgctcaggcctcaaccaaccgaactgaagtatagctggaaaacttgggggaaggccaagatgctttccacagagtcacataaccagaccttcttgattgatggaccggaaacagcagagtgccccaatactaaccgtgcgtggaatagtctggaggtggaagactacggctttggtgtcttcaccacgaacatctggctcaaactgcgggagaagcaggacgtattttgtgattctaaattaatgagcgctgccataaaggacaatcgagcagtgcacgccgatatggggtattggattgaatccgctctgaacgacacatggaaaatggagaaggcctcattcatcgaggtaaagagctgccactggcctaaatctcataccctttggtccaatggagtattggaaagtgagatgatcattccaaagaacttcgcaggccccgtcagccagcacaactacagacctggttatcatactcaaaccgctggcccatggcacctcgggaaactggaaatggattttgacctatgtgagggaacaactgtggttgtgaccgaagattgcggcaatagggggccctctctgcgcacaacgaccgcctccggaaagctcatcactgagtggtgctgtcggtcatgcacactgccgcctcttagatacaggggcgaggacggttgttggtacgggatggaaattcgcccattgaaagagaaggaagagaacctggtcaatagtttagtgaccgcgggacatggccagatagataacttcagcctcggtgttctgggcatggccctttttctggaagagatgttgcgaactcggatcgggacaaagcacgctattctcctggtggcagtatcgttcgtcaccctaatcacgggaaatatgtcctttcgtgacctgggcagagtgatggtgatggtcggggccactatgaccgatgacattggaatgggcgttacatatctcgctctgcttgccgcattcaaagtgaggcccacctttgcggccggtttgctgttacgcaagctcacttctaaagagctgatgatggctacaatcgggatagcccttctgagccagtcaaccatccctgaaaacattctagagctcacagatgcactggctttgggaatgatggtactgaagatcgtgcggaatatggaaaaataccaattagccgtcactattatggcaatcagttgcgtgcccaacgccgttatactccagaatgcttggaaggtgtcctgtaccattctggcggccgtctctgtgagcccacttctgttgacgtcctcacagcagaaggcagactggatccctctcgctctgacaatcaaaggcctaaaccccaccgccattttcctgactacccttagcagaacaagtaagaaaaggtcttggccactcaatgaggccataatggctgttggcatggtgtccatcctggcaagctcgttgctgaagaacgacattccgatgactgggcctttagtcgccggaggtctcctgaccgtatgctatgtgcttacgggccgatcagcggatctggaattggagcgcgctgccgacgttaaatgggaggatcaagcagaaatctctgggagttcccccattctcagcatcacaatatctgaggacggaagcatgtccatcaagaatgaagaggaggaacagaccctgactattctaatccggacaggcctgcttgtgatttcaggtgtctttccagtgagtatccccataaccgccgctgcatggtacctctgggaggtcaagaagcagagagccggggtgctgtgggatgtccctagcccaccccctgttgaaaaggcggagttggaagacggagcttataggattaaacagcgtggcatcttaggctactctcaaatcggggccggagtgtataaggagggtactttccacacaatgtggcatgtgacccgcggcgcagtcctgatgcaccgggggaaaagaattgagccgtcctgggccgatgtgaagaaagacctcatctcatacggaggcggttggaagctggaaggggagtggaaggaaggagaggaagttcaggtacttgctctggagccaggcaaaaaccccagggccgtgcagacgaagcctggcatatttaaaactaataccgggacaattggagcagtcagtttggatttcagcccaggtacctccggctctcccatcgtggaccgaaaggggaaagttgtgggactatacggcaacggtgtcgtgacacggtcgggggcttatgtaagcgccattgcgcagactgagaagtcaatcgaagataaccctgagatagaagacgatatttttcgcaagaaaagactgaccatcatggacctccatccgggagccggcaagacgaaaaggtacctgcccgcaatcgtccgggaggctattaagcgaggccttagaacattaatcctggccccaactcgcgtggttgctgcagaaatggaggaggccctcagggggttgcctattcgttatcaaaccacagccataaaaaccgaacacactggacgggagatcgtggacctgatgtgtcatgctaccttcacaatgagactcctgtcccccgtcagggtgccaaattacaaccttattatcatggatgaagcgcacttcacggaccctgcaagtatcgccgctcgcggttatatttctactcgagttgagatgggcgaggccgcagggatatttatgaccgccacacccccaggaagcagagatccgttccctcagtccaatgctcccatcatggacgaagaacgggaaattccagagaggtcatggaactctggccacgaatgggtgaccgattttaagggtaagactgtctggttcgtgcccagcatcaaagcggggaatgacattgccgcatgcctgcgcaagaacggcaagaaggtaatccagttgagtcgtaaaacatttgattccgagtacgtgaagaccagagctaatgactgggatttcgttgtcacgactgacataagcgagatgggcgccaactttaaggcagaacgggtgatcgatcctaggcgctgtatgaaaccagtgattctaacagacggcgaggaacgagtcatcctggccgggcccatgcctgtaacccattcttcagctgcccaaagacggggaaggattggtcgcaatccgaagaacgagaatgaccagtatatctacatgggcgaaccactcgagaacgatgaggactgcgcgcactggaaagaagcaaagatgttactggataatataaacacccccgaggggattatcccttccatgttcgaacccgagagagaaaaagtggacgccattgatggagagtacaggcttcggggcgaggctcgtaagacttttgttgacctgatgcgccgaggtgatctcccagtgtggttggcctataaagtcgctgcagaagggatcaattacgccgacagaaagtggtgtttcgatggcataaagaacaaccagatcctggaggaaaatatggaggtggagatttggacaaaagaaggagagaggaagaaactcaagcctcggtggctggacgctcgcatctatagtgatccccttgccctaaaagaatttaaggagttcgcagcgggcagaaagagcctgaccttgaacttaattacagaaatggggaggctgccaactttcatgacgcagaaagcccggaatgctctcgacaacctggccgttcttcataccgcagaggctggaggtcgagcctacaatcacgcactgtcggagctccctgaaacattggagactctgctactgctcacccttctggccacagtgaccggcgggatctttttattcttgatgtctggaaagggcataggtaaaatgactctggggatgtgctgcattatcacggcttccatcctcctgtggtatgcgcaaattcagccgcactggatcgccgcaagcataattcttgaatttttcctgatcgtcctcttgattcccgagccagaaaagcagagaacccctcaggataaccaactgacatacgtggtaatcgctatattaactgtggttgccgccaccatggcaaatgagatgggctttctagagaaaacaaagaaggacctgggactcggctcaatcaccactcaggaaagtgagtctaacattcttgacatcgatctgcgccccgcttccgcctggacattgtatgcggtcgctacgaccttcgtgactccaatgctgaggcatagcattgaaaattcaagtgtgaacgtcagcctcacagccatcgcaaatcaggccaccgttctgatggggcttggaaaaggttggcctctctccaagatggacattggcgtgcccctgttggctatcgggtgttactctcaggtaaacccgataaccctgacagcagccttactactgctcgtggcgcactacgctattatcggaccaggccttcaagccaaagcaactcgggaggcccagaagcgtgctgccgcaggtatcatgaaaaatcctacggtcgatgggattaccgtgatagacctggaacccatcccatatgatcccaagtttgagaagcagttgggccaggttatgctgctcattctgtgcgtgacacaagtccttatgatgagaactacctgggctttatgtgaggccctgacactcgcgaccggacctatcagcactttgtgggaaggcaacccggggaggttctggaatacgacaattgccgtatccatggcaaacatctttcgcggatcatacctggctggcgccggtctactgttctctataatgaaaaataccactaacacccggcgagggacaggaaacatcggcgagactctcggtgaaaagtggaaaagtagacttaatgcactgggcaagtcggagtttcagatttataaaaagagcgggatccaggaggtggacaggaccttggctaaagaaggaattaagcgcggcgagacagatcatcacgccgtttcccgggggtctgccaagctgagatggttcgtggaacgtaacatggtcacgcccgagggaaaagtggtcgacctcggctgcggtagagggggatggtcatactattgtggcggtctgaagaatgtgcgggaagttaaaggcttaaccaaagggggaccaggccatgaggagcctatccccatgagcacttacgggtggaaccttgtgcgcctgcaatccggagtagatgtgtttttcacacctccagaaaaatgcgacaccctcctatgtgatataggcgagagttctcccaatcctactattgaagcgggtcgaacactgagagtcttgaacctggttgagaattggctcaacaataacacccagttctgcatcaaggtgcttaatccatatatgcccagcgtcatcgaaaagatggaggctctgcagaggaaatacgggggagcattggtgcggaacccgctgtcacgcaattccacgcacgagatgtactgggtaagtaacgccaccggcaatattgtgagctctgttaacatgatatccagaatgctcatcaacaggtttacaatgaagcacaaaaaggctacttatgaacctgacgtggatttaggctcagggacccgaaatattggaatcgagagcgaaattccaaacctggacatcataggtaaacggatcgagaagattaagcaggaacatgagacatcgtggcactacgaccaagatcatccctataaaacttgggcctaccacggctcttatgagaccaagcagacagggagtgcatccagcatggtcaatggagtggtccgtcttctgaccaaaccttgggacgtggttccaatggtaactcagatggccatgacggatacaacccccttcggccagcaaagagtgtttaaggaaaaagtcgacactcgcacccaggagccgaaggaaggtacaaagaaactaatgaagatcacggctgagtggctctggaaagagctggggaagaaaaagacccctaggatgtgtactcgggaagagttcacaagaaaagtgcgctcaaacgcggccttgggagcaatttttaccgatgaaaataagtggaagtccgctagggaggccgttgaagacggccgattctgggagctggtggatcgggagagaaacctccaccttgaaggcaaatgcgagacttgtgtctacaatatgatggggaagagggagaaaaagctgggagagtttggtaaagcaaagggctctcgcgccatctggtatatgtggttaggggctcgtttcctggaatttgaggccttgggattcctcaacgaggaccattggtttagccggggcaatagtctgtccggtgtggaaggggagggactacacagacttggctacattctgagggatgtaggcaagaaagaagggggagcgatgtacgcagacgatacagccggttgggacacccgcataacactcgaggacctgaagaacgaagagatggtgactaatcatatgaaaggcgagcacaagaaattggctgaagccatcttcaagctgacctatcagaacaaggttgtccgagtgcagcggcccacgccaagagggaccgtgatggatattatcagcaggcgcgaccaaagaggatctggccaggtcggtacatacgggctcaatacttttaccaacatcgaggcacagcttattcggcaaatggaaggagagggcatattcaaatcaatccagcatctgacagctactgaggaaattgccgttcagaattggttagctagggtgggccgtgagcgactgagtcgcatggccatctccggggatgactgcgtagtgaagcctattgatgacagattcgcaagcgcgttgaccgccctcaacgatatgggaaaagtccggaaggacatccagcaatgggaaccctctaggggttggaacgattggacacaggtgccattttgctcgcaccacttccatgagctggttatgaaagacggccgcgtgctagtcgtgccctgtagaaatcaggatgaacttatagggcgggctaggatctcacagggagccggctggagcctgaaggagacagcatgcctcggtaagtcctatgctcaaatgtggaccctgatgtactttcaccgacgtgacttgagattagccgcaaacgccatttgtagtgcggtaccttctcattgggttccaactagccgcacaacctggtccatccacgctaaacacgagtggatgactaccgaagatatgctggccgtgtggaatcgggtctggattcaggagaacccgtggatggaagacaagacacccgtggagtcatgggaagaggtgccttatctcgggaaaagggaggaccagtggtgcggaagtcttatcggcctgacgtctagagcaacctgggccaagaatatacagactgctattaaccaagtccgcagcctaatcggcaatgaagagtacacagattatatgccatccatgaaacggttcaggcgagaagaggaagaggccggggttctgtggtga

SEQ ID NO: 14515 - RNA, 9876 nt, synthetic construct
  misc_feature 1..9876: note = derived and/or modified CDS sequence (opt3) from DENV-2__FJ850053__SS-prME
  source 1..9876: mol_type = other RNA
acagccggagtgatcgtcatgctgattcccacagctatggcattccacctcactacgagaaatggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaatgaaccggaggatatcgactgttggtgcaattccacatctacctgggtgacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctaccagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatccgcggaattatgcaggctggcaaaagatcgctcaggcctcaaccaaccgaactgaagtatagctggaaaacttgggggaaggccaagatgctttccacagagccgcataaccagaccttcttgatcgatggacccgaaacagcagagtgccctaatactaaccgtgcgtggaactcactggaggtcgaagactacggctttggtgttttcaccacgaacatttggctcaaactgcgggagaagcaggacgtgttttgtgatagtaaattaatgtctgctgccatcaaggacaatcgagcagtgcacgccgatatggggtattggatagaaagcgctctgaacgacacatggaaaatggagaaggcctccttcattgaggtaaagtcatgccactggccaaaaagccataccctttggtctaatggagtcttggaatccgagatgatcatccccaagaacttcgcaggccctgtgagtcagcacaactacagaccaggttatcatactcaaaccgctggcccctggcacctcgggaaactggaaatggattttgacctatgtgagggaacaactgttgtggtcaccgaagattgcggcaatagggggccgagcctgcgcacaacgaccgcctctggaaagctcattactgagtggtgctgtcggtcctgcacactgcctccacttagatacaggggcgaggacggttgttggtacgggatggaaatccgccccttgaaagagaaggaagagaacctggtaaattcattagttaccgcgggacatggccagattgataacttcagtctcggtgtgctgggcatggccctttttctggaagagatgttgcgaactcggatagggacaaagcacgctatcctcctggtagcagtcagcttcgtgaccctaattacgggaaatatgtcgtttcgtgacctgggcagagtgatggtcatggttggggccactatgaccgatgacatcggaatgggcgtgacatatctcgctctgcttgccgcattcaaagtaaggcctacctttgcggccggtttgctgttacgcaagctcacttccaaagagctgatgatggctacaattgggatcgcccttctgtctcagagcaccatacccgaaacaatcctagagctcactgatgcactggctttgggaatgatggtgctgaagattgtccggaacatggaaaaataccaattagccgtgaccatcatggcaatttcatgcgttccaaatgccgtgatcctccagaacgcttggaaggtcagttgtacgatactggcggccgtgtccgtttctcctcttctgttgacaagctcccagcagaaggcagactggattcccctcgctctgaccatcaaaggcctaaatccaactgccatcttcctgaccacactttcaagaactagcaagaaaaggagttggccgctcaacgaggccattatggctgtgggcatggtctctatactggcatccagcttgctgaagaatgacatccctatgaccgggcccttagtagccggaggtctcctgacggtgtgctatgttcttacaggccgatcggcggatctggaattggagcgcgctgccgacgtgaaatgggaggatcaagcagaaatttcagggtctagtccaatcctctccattaccatcagcgaggacggatctatgagcataaagaacgaagaggaggaacagactctgacaatcctaattcggaccggcctgcttgtcatctccggtgtgtttcccgtatcaattcctatcactgccgctgcatggtacctctgggaggtgaaaaagcagagagccggggtcctgtgggatgttccaagtccccctccggtggaaaaggcggagttggaagacggagcttataggataaaacagcgtggcattttaggctacagccaaatcggggccggagtgtataaggagggtacattccacaccatgtggcatgtcacgcgcggcgcagtgctgatgcaccgggggaaaagaatcgagccatcttgggccgatgttaagaaagacctcatttcctacggaggcggttggaagctggaaggggagtggaaggaaggagaggaagtacaggtgcttgctctggagcccggcaaaaatcctagggccgtccagactaagccaggcatctttaaaaccaacacagggaccataggagcagtgtcattggatttcagtcccggtacaagcggctcccctattgttgaccgaaaggggaaagtggtcggactatacggcaatggtgtggtaactcggtctggggcttatgtctcggccatcgcgcagaccgaaaagagcattgaagataacccggagatcgaagacgatatatttcgcaagaaaagactgacgattatggacctccatcccggagccggcaagacaaaaaggtacctgccagcaatcgtgcgggaggctatcaagcgaggccttagaactttaattctggcccctacccgcgttgtggctgcagaaatggaggaggccctcagggggttgcccatccgttatcaaacaaccgccattaaaactgaacacaccggacgggagatagtcgacctgatgtgtcatgctacattcacgatgagactcctgtcaccagtgagggttcctaactacaatcttatcattatggatgaagcgcacttcactgaccccgcatccatcgccgctcgcggttatatcagtacccgagtggagatgggcgaggccgcagggatttttatgacagccaccccaccgggatctagagatcctttcccccagagcaacgctccaataatggacgaggagcgggaaatccccgagaggtcctggaactcaggccacgaatgggtcactgattttaagggtaagacagtgtggttcgtaccttctattaaagcggggaacgacatcgccgcatgcctgcgcaagaatggcaagaaggtgattcagttgagccgtaaaacctttgatagtgagtacgttaagacgagagctaacgactgggatttcgtcgtgactacagacatctccgagatgggcgccaattttaaggcagaacgggtgatagatccaaggcgctgtatgaaacccgtcatcctaaccgacggcgaggaacgagtaattctggccgggcctatgccggtgacccatagctctgctgcccaaagacggggaaggatcggtcgcaacccaaagaatgagaacgaccagtatatttacatgggcgaacccctcgagaatgatgaggactgcgcgcactggaaagaagcaaagatgttactggataacatcaatactcctgaggggataattccctcaatgttcgaaccagagagagaaaaagttgacgccatcgatggagagtacaggcttcggggcgaggctcgtaagacatttgtggacctgatgcgccgaggtgatctccctgtctggttggcctataaagtggctgcagaagggattaactacgccgacagaaagtggtgtttcgatggcatcaagaataaccagatactggaggaaaacatggaggttgagatctggaccaaagaaggagagaggaagaaactcaagccccggtggctggacgctcgcatttattccgatccacttgccctaaaagaatttaaggagttcgcagcgggcagaaagagtctgacattgaatttaatcactgaaatggggaggctgcctacgttcatgacccagaaagcccggaacgctctcgacaatctggccgtgcttcatacagcagaggctggaggtcgagcctacaaccacgcactgagcgagctcccggaaactttggagaccctgctactgctcacacttctggccaccgtcactggcgggatatttttattcttgatgtcgggaaagggcatcggtaaaatgacgctggggatgtgctgcataattaccgcttctatcctcctgtggtatgcgcaaatccagccccactggattgccgcatccatcatacttgaatttttcctgattgtgctcttgatcccagagcctgaaaagcagagaacaccccaggataatcaactgacttacgtagtgattgctatcttaaccgttgtcgccgccacaatggcaaacgagatgggctttctagagaaaaccaagaaggacctgggactcggcagcataactacacaggaatcagagagtaatatccttgacattgatctgcgcccagcttctgcctggacgttgtatgcggtggctaccactttcgtgacacctatgctgaggcattccatcgaaaacagctcagtcaatgttagtctcaccgccattgcaaaccaggccaccgtgctgatggggcttggaaaaggttggcccctcagcaagatggacatcggcgtaccgctgttggctattgggtgttactcccaggtgaatccaatcacactgactgcagccttactactgctcgtcgcgcactacgctataattggacctggccttcaagccaaagcaacgcgggaggcccagaagcgtgctgccgcaggtatcatgaaaaaccccaccgtggatgggatcacagttattgacctggaaccaataccctatgatcctaagtttgagaagcagttgggccaggtgatgctgctcatcctgtgcgtcactcaagtacttatgatgagaaccacatgggctttatgtgaggccctgaccctcgcgactggaccgatttctacgttgtgggaaggcaatcccgggaggttctggaacacaaccatcgccgtgagcatggcaaatatttttcgcggatcctacctggctggcgccggtctactgttctcaatcatgaaaaacactaccaatacacggcgagggactggaaacataggcgagaccctcggtgaaaagtggaaatctagacttaacgcactgggcaagagtgagtttcagatctataaaaagtcggggattcaggaggttgacaggacattggctaaagaaggaatcaagcgcggcgagacggatcatcacgccgtgagccgggggtccgccaagctgagatggttcgtcgaacgtaatatggtgaccccagagggaaaagtcgtggacctcggctgcggtaggggagggtggtcttactattgtggcggtctgaagaacgttcgggaagtgaaaggcttaactaaagggggacctggccatgaggagcccattcctatgtcaacatacgggtggaatcttgtacgcctgcaaagcggagtggatgtctttttcaccccacccgaaaaatgcgacactctcctatgtgatatcggcgagtccagtcctaacccaacaatagaagcgggtcgaaccctgagagttttgaatctggtggagaactggctcaataacaatacgcagttctgcattaaggtccttaacccctatatgccgtctgtgatcgaaaagatggaggctctgcagaggaaatacgggggagcattggtacggaatcctctgagccgcaactcaacccacgagatgtactgggtgtccaatgccacaggcaacatcgttagtagcgtgaatatgatttctagaatgctcataaacaggtttactatgaagcacaaaaaggctacctatgaaccagacgtcgatttaggctccgggacacgaaacatcggaattgagtcagaaatccccaatctggacattatcggtaaacggatagagaagatcaagcaggaacatgagactagctggcactacgaccaagatcatccttataaaacctgggcctaccacggctcgtatgagacaaagcagaccgggtctgcaagttccatggtgaacggagtcgtgcgtcttctgactaaaccatgggacgttgtacccatggtgacgcagatggccatgacagataccactccgttcggccagcaaagagtctttaaggaaaaagtggacacccgcacacaggagcctaaggaaggtacgaagaaactaatgaagattaccgctgagtggctctggaaagagctggggaagaaaaagactcccaggatgtgtacacgggaagagttcaccagaaaagttcgcagcaatgcggccttgggagcaatctttactgatgaaaacaagtggaagtcagctagggaggccgtggaagacggccgattctgggagctggtcgatcgggagagaaatctccaccttgaaggcaaatgcgagacatgtgtgtacaacatgatggggaagagggagaagaagctgggagagtttggtaaagcaaagggctcccgcgccatttggtatatgtggttaggggctcgtttcctggaatttgaggccttgggattcctcaatgaggaccattggttttctcggggcaacagcctgagtggtgtagaaggggagggactacacagacttggctacatcctgagggatgtgggcaagaaagaagggggagcgatgtacgcagacgataccgccggttgggacacacgcattactctcgaggacctgaagaatgaagagatggttaccaaccatatgaaaggcgagcacaagaaattggctgaagccatattcaagctgacgtatcagaataaggtcgtgcgagtgcagcggccaacccctagagggacagtcatggatatcatttccaggcgcgaccaaagaggaagcggccaggttggtacttacgggctcaacacctttacaaatatggaggcacagcttatccggcaaatggaaggagagggcatcttcaaatctattcagcatctgactgctaccgaggaaatagccgtgcagaactggttagctagggtaggccgtgagcgactgtcacgcatggccatcagtggggatgactgcgtggtcaagcccattgatgacagattcgcatccgcgttgacggccctcaatgatatgggaaaagtgcggaaggacatccagcaatgggaaccaagcaggggttggaacgattggacacaggttcccttttgctctcaccacttccatgagctggtgatgaaagacggccgcgtcctagtggtaccttgtagaaaccaggatgaacttattgggcgggctaggatctcgcagggagccggctggtcactgaaggagaccgcatgcctcggtaagagctatgctcaaatgtggactctgatgtactttcaccgacgtgacttgagattagccgcaaatgccatatgttccgcggttccaagtcattgggtgccgacatctcgcaccacttggagcatccacgctaaacacgagtggatgaccacagaagatatgctggccgtctggaaccgggtgtggattcaggagaatccctggatggaagacaagacgcctgtggagtcctgggaagaggtcccatatctcgggaaaagggaggaccagtggtgcggatcacttatcggcctgaccagtagagcaacttgggccaagaacattcagacagctatcaatcaagttcgctctctaataggcaacgaagagtacaccgattatatgcccagcatgaaacggttcaggcgagaagaggaagaggccggggtgctgtggtga

SEQ ID NO: 14516 - RNA, 9876 nt, synthetic construct
  misc_feature 1..9876: note = derived and/or modified CDS sequence (opt3) from DENV-2__JN819420__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctacaagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatagaatccgctctgaacgacacatggaagatggagcgagcctcattcattgaggtcaagagctgccactggcctaaatctcataccctttggtccaatggagtgttggaaagtgagatgatcatcccaaagaacttcgcaggccccgttagccagcacaactacagacctggttatcatactcaaaccgctggcccatggcacctcgggaaactggaaatggattttgacttctgtgagggaacaactgtggtcgtgaccgaagattgcggcaatagggggccctctctacgcacaacgaccgcctccggaaagctgattactgagtggtgctgtcggtcatgcacactcccgcctctgagatacaggggcgaggacggttgttggtacgggatggaaatccgcccacttaaagagaaggaagagaacttggttaatagtctggtgaccgcgggacatggccagattgataactttagcttaggtgtactcggcatggccctgttccttgaagagatgctgcgaactcggatagggacaaagcacgctatcttgctcgtcgcagtgtcgtttgtgaccctgattacgggaaatatgtccttccgtgacctaggcagagtcatggttatggtgggggccactatgaccgatgacatcggaatgggcgtaacatatctggctctcctggccgcatttaaagtgaggcccaccttcgcggccggtcttttgctgcgcaagttaacttctaaagagctcatgatggctacaattgggatcgccctgcttagccagtcaaccatacctgaaacaatcctggagctaactgatgcactcgctctgggaatgatggtcttgaagattgtgcggaacatggaaaaataccaactggccgttaccatcatggcaattagttgcgtgcccaatgccgtcatcttacagaacgcttggaaggtgtcctgtacgatactcgcggccgtttctgtgagcccactgcttctgacatcctcacagcagaaggcagactggattcctttggctctcaccatcaaaggcctgaatcccactgccatctttctaaccacactgagcagaactagtaagaaaaggtcttggccacttaacgaggccattatggctgtcggcatggtatccatactcgcaagctcgctgttgaagaatgacatcccgatgaccgggcctctggtggccggaggtttactcacggtttgctatgtgctgacaggccgatcagcggatcttgaactggagcgcgctgccgacgtcaaatgggaggatcaagcagaaatttctgggagttcccccatcttgagcattaccatctctgaggacggaagcatgtccataaagaacgaagaggaggaacagactctcacaatcctgattcggaccggcctactggtgatctcaggtgtattcccagtgagtattcccatcactgccgctgcatggtacctttgggaggtcaaaaagcagagagccggggttctctgggatgtgcctagcccaccccctgtggaaaaggcggagctggaagacggagcttataggataaaacagcgtggcattttgggctactctcaaatcggggccggagtctataaggagggtacatttcacaccatgtggcatgtgacgcgcggcgcagttttaatgcaccgggggaaaagaatcgagccgtcctgggccgatgtaaagaaagacctgatttcatacggaggcggttggaagctcgaaggggagtggaaggaaggagaggaagtgcaggtcctggctcttgagccaggcaaaaatcccagggccgtgcagactaagcctggcatcttcaaaaccaacacagggaccataggagcagttagtctggattttagcccaggtacatccggctctcccattgtggaccgaaaggggaaagtcgtgggattgtacggcaatggtgtagtcactcggtcgggggcttatgtgagcgccatcgcgcagaccgagaagtcaattgaagataaccctgagatcgaagacgatatattccgcaagaaaagactaacgattatggacctgcatccgggagccggcaagacaaaaaggtacctccccgcaatcgttcgggaggctatcaagcgaggcctgagaactcttattttagccccaacccgcgtggtcgctgcagaaatggaggaggccctgagggggctccctatccgttatcaaacacccgccattaaaaccgaacacactggacgggagatagtggacttgatgtgtcatgctaccttcacaatgagactgctctccccagttagggtgcctaactacaatctgatcattatggatgaagcgcactttacggaccccgcaagtatcgccgctcgcggttatatctctactcgagtcgagatgggcgaggccgcagggattttcatgaccgccacaccaccgggaagcagagatccttttccccagtccaacgctccaataatggacgaagagcgggaaatccccgagaggtcatggaattctggccacgaatgggtgaccgatttcaagggtaagactgtatggtttgtgcctagcattaaagcggggaacgacatcgccgcatgccttcgcaagaatggaaaaaaggttattcagctgagtcgtaaaacattcgattccgagtacgtcaagaccagagctaacgactgggattttgtggtgacgactgacatcagcgagatgggcgccaatttcaaggcagaacgggtcatagatccaaggcgctgtatgaaacccgtaatcttgacagactctgaggaacgagtgattctagccggccctatgccggttacccattcatccgctgcccaaagacgggggaggatcggacgcaacccaaagaatgagaacgaccagtatatttacatgggtgaacccctggagaatgatgaggactgcgcgcactggaaagaagcaaagatgctcttagataacatcaatacccctgagggcataattcccagtatgtttgaaccagagagagaaaaagtggacgccatcgatggggagtacaggctgcggggagaggctcgtaagactttcgtcgaccttatgcgccgaggcgatctgcctgtgtggctcgcctataaagttgctgcagaaggtattaactacgccgacagaaagtggtgttttgatgggatcaagaataaccagatattggaggaaaacatggaggtggagatctggacaaaagaaggcgagaggaagaaactgaagccccggtggctcgacgctcgcatttatagcgatccactggcccttaaagaattcaaggagttcgcagcgggaagaaagtcgctaaccctgaatttgatcacagaaatgggcaggttacctacttttatgacgcagaaagcccggaacgctctggacaatctcgccgtcctgcataccgcagaggctgggggacgagcctacaaccacgcactttctgagctgccggaaacactcgagactttgctgctactgaccctccttgccacagtgaccggtggcattttcctgtttttaatgtccgggaagggaatcggcaaaatgactttgggtatgtgctgcataattacggctagcatcctgctctggtatgcgcaaatccagccccactggattgccgcatcaatcatactggaattctttcttattgtactgctcatcccagagcctgaaaagcagagaaccccccaggataatcaattgacatacgtggttattgctatcctgactgtcgtggccgccaccatggcaaacgagatggggttcttagagaaaacaaagaaggacctaggcctgggaagtataaccactcaggaatctgagtccaatatcctcgacattgatcttcgcccagctagcgcctggacactgtatgcggtggctacgacctttgtcactcctatgttgaggcattcaatcgaaaacagtagcgttaatgtgtccctgacagccattgcaaaccaggccaccgtactcatgggcctggggaaaggatggcccctttctaagatggacatcggtgtgccgctcctggctatgggctgttacagccagttcaaaccaattaccttgacagcagccctgttactactggtcgcgcactacgctatcatagggcctggactccaagccaaggcaactcgggaggcccagaaacgtgctgccgcaggcattatgaagaatcccacggtggatggtatcaccgttatcgaccttgaaccaattccctatgatcctaagtttgagaaacagctggggcaggtgatgttgctgatactctgcgtcacacaagtactgatgatgagaactacctgggctctttgtgaggccttaacactggcgaccggcccgatctccactctctgggaaggaaaccccggcaggttctggaatacgacaattgccgtgtcaatggcaaacatctttcgcgggtcttacttggctggagccggcctgctattcagtattatgaagaataccacttcgacccggcgaggtacagggaacatcggagagactctgggcgaaaaatggaagagcagactcaatgcacttggtaaatccgagtttcagatatataagaaatctggcatccaggaggttgacaggaccctggctaaggaagggattaagcgcggagagacagatcatcacgccgtgtcacggggcagcgccaaattgagatggttcgtcgaacgtaacatggtgacgccagaggggaaggtcgtggacctgggatgcggcaggggtgggtggtcctactattgtggaggcctcaaaaacgttcgggaagtgaagggtctgaccaaaggcgggcctggacatgaggagcccatccctatgagtacttacggctggaatttagtacgccttcaatctggggtggatgtcttctttacaccacccgaaaagtgcgacaccctgctctgtgatattggagagagctcacctaacccaactatcgaagcgggccgaacactaagagttctgaatttggtggagaactggctgaataacaatacccagttctgcataaaggtcctcaacccctatatgccgtccgtgattgaaaaaatggaggctcttcagaggcagtacggtggggcactggtacggaatcctttgagtcgcaacagcacgcacgagatgtactgggtgtctaatgccaccggaaacatcgtttcctcagtgaatatgatcagcagaatgctgattaacaggtttacaatgaagcacaaaaaggctacttatgaaccagacgtcgatctcggctcgggcacccgaaatatagggatcgagtctgaaattcccaacttagacatcattggaaaacggatcgagaagataaagcaagaacatgagatcagttggcactacgaccaggatcatccttataaaacatgggcctaccacggttcctatgagactaagcagaccggcagcgcatcatccatggtgaacggggtcgtgcgtctgcttacaaaaccatgggacgttgtacccatggtgacccagatggccatgactgatacgacaccgttcggacaacagagagtctttaaggaaaaagtggacacccgcactcaggagcctaaggaaggcaccaagaaactgatgaagattacagctgagtggctatggaaagagctcggtaagaaaaagacgcccaggatgtgtacccgggaagagttcactaaaaaggttagatctaatgcggccctgggggcaatctttacagatgaaaacaagtggaaaagcgctcgcgaggccgtggaagacggaaggttctgggagttggtcgatcgagagcggaatctgcacctcgaaggcaagtgcgagacctgtgtgtacaacatgatgggcaaaagagaaaagaaacttggggagtttggaaaggcaaagggtagtagggccatttggtatatgtggctgggcgctcgcttcttagaatttgaggccctggggttcttgaatgaggaccattggttttcccgtggaaacagcctctctggcgtagaaggtgaggggctgcaccggctaggatacatccttagagatgtgggcaaaaaggaaggcggggcgatgtacgcagacgatactgccggatgggacacaaggattaccctggaggacctcaaaaatgaagagatggttacaaaccatatgaagggtgagcacaaaaagctggctgaagccatattcaagttgacttatcagaataaagtcgtgcgcgtgcaacgaccaacccctcggggcacggtcatggatatcatttcaagaagggaccagcgcgggagtggacaggttggcacctacggtctgaacacattcactaatatggaggcacaactcatcagacagatggaaggggagggaatctttaagtccattcagcatcttaccgctacagaggaaatagccgtgcagaactggctggctcgggtaggcagggagcgtttaagccgaatggccatctctggcgatgactgcgtggtcaaacccattgatgaccgcttcgcatcggcgctgactgccttgaatgatatggggaaggtgagaaaagacatccaacagtgggaaccatcacggggatggaacgattggacccaggttcccttttgcagccaccacttccatgagctcgtgatgaaggacggtagggtcctggtggtaccttgtcgcaatcaggatgaactaattggcagagctcggatctcccaaggggccggatggagtcttaaggagacggcatgcctgggcaaatcttatgctcagatgtggacactcatgtactttcacaggcgagacctgcgtttggccgcaaacgccatatgtagcgcggttccatcccattgggtgccgacctcaagaactacatggagtatccacgctaagcacgagtggatgaccactgaagatatgttagccgtctggaaccgcgtgtggattcaggagaatccctggatggaagacaaaacccctgtggagtcttgggaagaggtcccatatctgggtaagcgggaggaccagtggtgcgggagcctcatcggacttacatccagggcaacgtgggccaaaaacattcaaaccgctatcaatcaggttagatcactgataggcaacgaagagtacactgattatatgcccagcatgaagcgcttccggagggaagaggaagaggccggcgtgctatggtga

SEQ ID NO: 14517 - RNA, 9876 nt, synthetic construct
  misc_feature 1..9876: note = derived and/or modified CDS sequence (opt3) from DENV-2__FJ850118__SS-prME
  source 1..9876: mol_type = other RNA
accgccggagtgatcgtcatgctgattcccaccgctatggcattccacctcactacgagaaatggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatccgcggaattatgcaggctggcaaaagatcgctcaggcctcaaccaaccgaactgaagtatagctggaaaacttgggggaaggccaagatgctttccacagagtcacataaccagaccttcttgatcgatggaccggaaacagcagagtgccccaatactaaccgtgcgtggaatagtctggaggtcgaagactacggctttggtgttttcaccacgaacatttggctcaaactgcgggagaagcaggacgtgttttgtgattctaaattaatgagcgctgccatcaaggacaatcgagcagtgcacgccgatatggggtattggatagaatccgctctgaacgacacatggaaaatggagaaggcctcattcattgaggtaaagagctgccactggcctaaatctcataccctttggtccaatggagtcttggaaagtgagatgatcatcccaaagaacttcgcaggccccgtgagccagcacaactacagacctggttatcatactcaaaccgctggcccatggcacctcgggaaactggaaatggattttgacctatgtgagggaacaactgttgtggtcaccgaagattgcggcaatagggggccctctctgcgcacaacgaccgcctccggaaagctcattactgagtggtgctgtcggtcatgcacactgccgcctcttagatacaggggcgaggacggttgttggtacgggatggaaatccgcccattgaaagagaaggaagagaacctggtgaatagtttagttaccgcgggatatggccagattgataacttcagcctcggtgtgctgggcatggccctttttctggaagagatgttgcgaactcggatagggacaaagcatgctatcctcctggtagcagtctcgttcgtgaccctaattacgggaaatatgtcctttcgtgacctgggcagagtgatggtcatggttggggccactatgaccgatgacatcggaatgggcgtgacatacctcgctctgcttgccgcattcaaagtaaggcccacctttgcggccggtttgctgttacgcaagctcacttctaaagagctgatgatggctacaattgggatcgcccttctgagccagtcaaccatacctgaaacaatcctagagctcactgatgcactggctttgggaatgatggtgctgaagattgtccggaacatggaaaaatatcaattagccgtgaccatcatggcaattagttgcgttcccaatgccgtgatcctccagaacgcttggaaggtctcctgtacgatactggcggccgtgtctgttagcccacttctgttgacatcctcacagcagaaggcagactggattcctctcgctctgaccatcaaaggcctaaatcccactgccatcttcctgaccacacttagcagaacaagtaagaaaaggtcttggccactcaacgaggccattatggctgtgggcatggtctccatactggcaagctcgttgctgaagaatgacatcccgatgaccgggcctttagtagccggaggtctcctgacggtgtgctacgttcttacaggccgatcagcggatctggaattggagcgcgctgccgacgtgaaatgggaggatcaagcagaaatttctgggagttcccccatcctcagcattaccatctctgaggacggaagcatgtccataaagaacgaagaggaggaacagactctgacaatcctaattcggaccggcctgcttgtcatctcaggtgtgtttccagtaagtattcccatcactgccgctgcatggtatctctgggaggtgaaaaagcagagagccggggtcctgtgggatgttcctagcccaccccctgtggaaaaggcggagttggaagacggagcttacaggataaaacagcgtggcattttaggctattctcaaatcggggccggagtgtacaaggagggtacattccacaccatgtggcacgtcacgcgcggcgcagtgctgatgcatcgggggaaaagaatcgagccgtcctgggccgatgttaagaaagacctcatttcatacggaggcggttggaagctggaaggggagtggaaggaaggagaggaagtacaggtgcttgctctggagccaggcaaaaatcccagggccgtccagactaagcctggcatctttaaaaccaacacagggaccataggagcagtgagtttggatttcagcccaggtacatccggctctcccattgttgaccgaaaggggaaagtggtcggactatatggcaatggtgtggtaactcggtcgggggcttacgtcagcgccatcgcgcagaccgagaagtcaattgaagataaccctgagatcgaagacgatatatttcgcaagaaaagactgacgattatggacctccacccgggagccggcaagacaaaaaggtatctgcccgcaatcgtgcgggaggctatcaagcgaggccttagaactttaattctggccccaacccgcgttgtggctgcagaaatggaggaggccctcagggggttgcctatccgttaccaaacacccgccattaaaaccgaacatactggacgggagatagtcgacctgatgtgtcacgctaccttcacaatgagactcctgtccccagtgagggttcctaactataatcttatcattatggatgaagcgcatttcacggaccccgcaagtatcgccgctcgcggttacatctctactcgagtggagatgggcgaggccgcagggatttttatgaccgccacaccaccgggaagcagagatcctttcccccagtccaacgctccaataatggacgaagaacgggaaatccccgagaggtcatggaactctggccacgaatgggtcaccgattttaagggtaagactgtgtggttcgtacctagcattaaagcggggaacgacatcgccgcatgcctgcgcaagaatggcaagaaggtgattcagttgagtcgtaaaacatttgattccgagtatgttaagaccagagctaacgactgggatttcgtcgtgacgactgacatcagcgagatgggcgccaattttaaggcagaacgggtgatagatccaaggcgctgtatgaaacccgtcatcctaacagacggcgaggaacgagtaattctggccgggcctatgccggtgacccactcttcagctgcccaaagacggggaaggatcggtcgcaacccaaagaatgagaacgaccagtacatttacatgggcgaacccctcgagaatgatgaggactgcgcgcattggaaagaagcaaagatgttactggataacatcaatacccctgaggggataattccctccatgttcgaaccagagagagaaaaagttgacgccatcgatggagagtataggcttcggggcgaggctcgtaagacttttgtggacctgatgcgccgaggtgatctccctgtctggttggcctacaaagtggctgcagaagggattaactatgccgacagaaagtggtgtttcgatggcatcaagaataaccagatactggaggaaaacatggaggttgagatctggacaaaagaaggagagaggaagaaactcaagccccggtggctggacgctcgcatttacagtgatccacttgccctaaaagaatttaaggagttcgcagcgggcagaaagagcctgaccttgaatttaatcacagaaatggggaggctgcctactttcatgacgcagaaagcccggaacgctctcgacaatctggccgtgcttcacaccgcagaggctggaggtcgagcctataaccatgcactgtcggagctcccggaaacattggagactctgctactgctcacccttctggccacagtcaccggcgggatatttttattcttgatgtctggaaagggcatcggtaaaatgactctggggatgtgctgcataattacggcttccatcctcctgtggtacgcgcaaatccagccccactggattgccgcaagcatcatacttgaatttttcctgattgtgctcttgatcccagagcctgaaaagcagagaacaccccaggataatcaactgacatatgtagtgattgctatcttaactgttgtcgccgccaccatggcaaacgagatgggctttctagagaaaacaaagaaggacctgggactcggctcaataaccactcaggaaagtgagtctaatatccttgacattgatctgcgcccagcttccgcctggacattgtacgcggtggctacgaccttcgtgactcctatgctgaggcacagcatcgaaaactcaagtgtcaatgttagcctcacagccattgcaaaccaggccaccgtgctgatggggcttggaaaaggttggcccctctccaagatggacatcggcgtaccgctgttggctattgggtgttactctcaggtgaatccaatcaccctgacagcagccttactactgctcgtcgcgcattatgctataattggacctggccttcaagccaaagcaactcgggaggcccagaagcgtgctgccgcaggtatcatgaaaaaccccacggtggatgggatcaccgttattgacctggaaccaataccctacgatcctaagtttgagaagcagttgggccaggtgatgctgctcatcctgtgcgtcacacaagtacttatgatgagaactacctgggctttatgtgaggccctgacactcgcgaccggaccgattagcactttgtgggaaggcaatcccgggaggttctggaacacgacaatcgccgtgtccatggcaaatatttttcgcggatcatatctggctggcgccggtctactgttctctatcatgaaaaacaccactaatacccggcgagggacaggaaacataggcgagactctcggtgaaaagtggaaaagtagacttaacgcactgggcaagtcggagtttcagatctacaaaaagagcgggattcaggaggttgacaggaccttggctaaagaaggaatcaagcgcggcgagacagatcaccatgccgtgtcccgggggtctgccaagctgagatggttcgtcgaacgtaatatggtgacgccagagggaaaagtcgtggacctcggctgcggtagagggggatggtcatattactgtggcggtctgaagaacgttcgggaagtgaaaggcttaaccaaagggggacctggccacgaggagcccattcctatgagcacttatgggtggaatcttgtacgcctgcaatccggagtggatgtctttttcacaccacccgaaaaatgcgacaccctcctatgtgatatcggcgagagttctcctaacccaactatagaagcgggtcgaacactgagagttttgaatctggtggagaactggctcaataacaatacccagttctgcattaaggtccttaacccctacatgccgagcgtgatcgaaaagatggaggctctgcagaggaaatacgggggagcattggtacggaatcctctgtcacgcaactccacgcatgagatgtattgggtgagtaatgccaccggcaacatcgttagctctgtgaatatgatttccagaatgctcataaacaggtttacaatgaagcacaaaaaggctacttacgaaccagacgtcgatttaggctcagggacccgaaacatcggaattgagagcgaaatccccaatctggacattatcggtaaacggatagagaagatcaagcaggaacacgagacatcgtggcattatgaccaagatcacccttacaaaacttgggcctatcatggctcttacgagaccaagcagacagggagtgcatccagcatggtgaacggagtcgtgcgtcttctgaccaaaccatgggacgttgtacccatggtgactcagatggccatgacggatacaaccccgttcggccagcaaagagtctttaaggaaaaagtggacactcgcacccaggagcctaaggaaggtacaaagaaactaatgaagattacggctgagtggctctggaaagagctggggaagaaaaagacccccaggatgtgtactcgggaagagttcacaagaaaagttcgctcaaatgcggccttgggagcaatctttaccgatgaaaacaagtggaagtccgctagggaggccgtggaagacggccgattctgggagctggtcgatcgggagagaaatctccaccttgaaggcaaatgcgagacttgtgtgtataacatgatggggaagagggagaagaagctgggagagtttggtaaagcaaagggctctcgcgccatttggtacatgtggttaggggctcgtttcctggaatttgaggccttgggattcctcaatgaggaccactggtttagccggggcaacagtctgtccggtgtagaaggggagggactacatagacttggctacatcctgagggatgtgggcaagaaagaagggggagcgatgtatgcagacgatacagccggttgggacacccgcattacactcgaggacctgaagaatgaagagatggttactaaccacatgaaaggcgagcataagaaattggctgaagccatattcaagctgacctaccagaataaggtcgtgcgagtgcagcggccaacgcctagagggaccgtcatggatatcattagcaggcgcgaccaaagaggatctggccaggttggtacatatgggctcaacacttttaccaatatggaggcacagcttatccggcaaatggaaggagagggcatcttcaaatcaattcagcacctgacagctactgaggaaatagccgtgcagaactggttagctagggtaggccgtgagcgactgagtcgcatggccatctccggggatgactgcgtggtcaagcccattgatgacagattcgcaagcgcgttgaccgccctcaatgatatgggaaaagtgcggaaggacatccagcaatgggaaccatctaggggttggaacgattggacgcaggttcccttttgctcgcatcacttccacgagctggtgatgaaagacggccgcgtcctagtggtaccttgtagaaaccaggatgaacttattgggcgggctaggatctcacagggagccggctggagcctgaaggagacagcatgcctcggtaagtcctacgctcaaatgtggaccctgatgtattttcatcgacgtgacttgagattagccgcaaatgccatatgtagtgcggttccaccgcactgggtgcccacttctcgcacaacctggagcatccatgctaaacacgagtggatgactaccgaagatatgctggccgtctggaaccgggtgtggattcaggagaatccttggatggaagacaagacaccagtggagtcctgggaagaggtcccctacctcgggaaaagggaggaccagtggtgcggatcacttatcggcctgacgagtagagcaacctgggccaagaacattcagactgctatcaatcaagttcgctctctaataggcaacgaagagtatacagattacatgcctagcatgaaacggttcaggcgagaagaggaagaggccggggtgctgtggtga

SEQ ID NO: 14518 - RNA, 9876 nt, synthetic construct
  misc_feature 1..9876: note = derived and/or modified CDS sequence (opt3) from DENV-2__JN819416__SS-prME
  source 1..9876: mol_type = other RNA
accgccggcgtgatagtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggtcgaagactacggctttggtgttttcaccacgaacatttggctcaagctgcgtgagaaacaggacgtgttttgtgattctaagttaatgagcgctgccatcaaagacaatcgggcagtgcacgccgatatggggtattggatagaatccgctctgaacgacacatggaagatggagaaggcctcattcattgaggtaaaaagctgccactggcctaagtctcataccctttggtccaatggagtcttggaaagtgagatgatcatccccaagaatttcgcaggccccgtgagccagcacaactaccgacctggttatcatactcaaaccgctggcccatggcacctcgggaagctggaaatggattttgacctatgtgagggaacaactgttgtggtcaccgaagattgcggcaatagagggccctctctgaggacaacgaccgcctccggaaaactcattactgagtggtgctgtcgctcatgcacactgccgcctcttcggtacagaggcgaggacggttgttggtacgggatggaaatcaggccattgaaggagaaggaagagaacctggtgaatagtttagttaccgcgggacatggccagattgataacttcagcctcggtgtgctgggcatggccctttttctggaagagatgttgcgcactcgaatagggacaaaacacgctatcctcctggtagcagtctcgttcgtgaccctaattacgggaaatatgtcctttcgggacctgggccgtgtgatggtcatggttggggccactatgaccgatgacatcggaatgggcgtgacatatctcgctctgcttgccgcattcaaggtaagacccacctttgcggccggtttgctgttaaggaaactcacttctaaggagctgatgatggctacaattgggatcgcccttctgagccagtcaaccatacctgaaacaatcctagagctcactgatgcactggctttgggaatgatggtgctgaaaattgtccgcaacatggaaaagtaccaattagccgtgaccatcatggcaattagttgcgttcccaatgccgtgatcctccagaacgcttggaaggtctcctgtacgatactggcggccgtgtctgttagcccacttctgttgacatcctcacagcagaaagcagactggattcctctcgctctgaccatcaagggcctaaatcccactgccatcttcctgaccacacttagccggacaagtaaaaagagatcttggccactcaacgaggccattatggctgtgggcatggtctccatactggcaagctcgttgctgaaaaatgacatcccgatgaccgggcctttagtagccggaggtctcctgacggtgtgctatgttcttacaggcaggtcagcggatctggaattggagcgagctgccgacgtgaagtgggaggatcaagcagaaatttctgggagttcccccatcctcagcattaccatctctgaggacggaagcatgtccatcaaaaacgaagaggaggaacagactctgacaatcctaattcgcaccggcctgcttgtcatctcaggtgtgtttccagtaagtattcccatcactgccgctgcatggtacctctgggaggtgaagaagcagcgggccggggtcctgtgggatgttcctagcccaccccctgtggaaaaagcggagttggaagacggagcttatagaataaagcagaggggcattttaggctactctcaaatcggggccggagtgtataaagagggtacattccacaccatgtggcatgtcacgcgtggcgcagtgctgatgcaccgcgggaagcggatcgagccgtcctgggccgatgttaaaaaggacctcatttcatacggaggcggttggaagctggaaggggagtggaaagaaggagaggaagtacaggtgcttgctctggagccaggcaagaatcccagagccgtccagactaaacctggcatctttaagaccaacacagggaccataggagcagtgagtttggatttcagcccaggtacatccggctctcccattgttgacaggaaagggaaggtggtcggactatacggcaatggtgtggtaactcgatcgggggcttatgtcagcgccatcgcgcagaccgagaagtcaattgaagataaccctgagatcgaagacgatatatttcggaaaaagcgcctgacgattatggacctccatccgggagccggcaaaacaaagagatacctgcccgcaatcgtgagggaggctatcaaacggggccttcgaactttaattctggccccaaccagagttgtggctgcagaaatggaggaggccctccgcgggttgcctatcaggtatcaaacacccgccattaagaccgaacacactggacgtgagatagtcgacctgatgtgtcatgctaccttcacaatgcggctcctgtccccagtgagagttcctaactacaatcttatcattatggatgaagcgcacttcacggaccccgcaagtatcgccgctaggggttatatctctactcgcgtggagatgggcgaggccgcagggatttttatgaccgccacaccaccgggaagccgagatcctttcccccagtccaacgctccaataatggacgaagagagagaaatccccgagcggtcatggaactctggccacgaatgggtcaccgattttaagggtaaaactgtgtggttcgtacctagcattaaggcggggaacgacatcgccgcatgcctgaggaaaaatggaaagaaagtgattcagttgagtcgcaagacatttgattccgagtacgttaagacccgtgctaacgactgggatttcgtcgtgacgactgacatcagcgagatgggcgccaattttaaagcagaaagagtgatagatccacggaggtgtatgaagcccgtcatcctaacagacggcgaggaacgcgtaattctggccgggcctatgccggtgacccattcttcagctgcccaacgaagaggacggatcggtaggaaccccaaaaatgagaacgaccagtatatttacatgggcgaacccctcgagaatgatgaggactgcgcgcactggaaggaagcaaaaatgttactggataacatcaatacccctgaggggataattccctccatgttcgaaccagagcgcgaaaaggttgacgccatcgatggagagtacagacttaggggcgaggctcggaaaacttttgtggacctgatgcgtcgcggtgatctccctgtctggttggcctataaggtggctgcagaagggattaactacgccgaccgaaagtggtgtttcgatggcatcaaaaataaccagatactggaggaaaacatggaggttgagatctggacaaaggaaggagagaggaaaaagctcaaacccagatggctggacgctcggatttatagtgatccacttgccctaaaggaatttaaggagttcgcagcgggccgcaaaagcctgaccttgaatttaatcacagaaatggggagactgcctactttcatgacgcagaaggccaggaacgctctcgacaatctggccgtgcttcataccgcagaggctggaggtcgggcctacaaccacgcactgtcggagctcccggaaacattggagactctgctactgctcacccttctggccacagtcaccggcgggatatttttattcttgatgtctggaaaaggcatcggtaagatgactctggggatgtgctgcataattacggcttccatcctcctgtggtatgcgcaaatccagccccactggattgccgcaagcatcatacttgaatttttcctgattgtgctcttgatcccagagcctgaaaaacagcgaaccccacaggataatcaactgacatacgtagtgattgctatcttaactgttgtcgccgccaccatggcaaacgagatgggctttctagagaagacaaagaaagacctgggactcggctcaataaccactcaggaaagtgagtctaatatccttgacattgatctgagaccagcttccgcctggacattgtatgcggtggctacgaccttcgtgactcctatgctgcgccatagcatcgaaaactcaagtgtcaatgttagcctcacagccattgcaaaccaggccaccgtgctgatggggcttggaaagggttggcccctctccaaaatggacatcggcgtaccgctgttggctattgggtgttactctcaggtgaatccaatcaccctgacagcagccttactactgctcgtcgcgcactacgctataattggacctggccttcaagccaaggcaactagggaggcccagaaacgggctgccgcaggtatcatgaagaaccccacggtggatgggatcaccgttattgacctggaaccaataccctatgatcctaagtttgagaaacagttgggccaggtgatgctgctcatcctgtgcgtcacacaagtacttatgatgcgtactacctgggctttatgtgaggccctgacactcgcgaccggaccgattagcactttgtgggaaggcaatcccgggagattctggaacacgacaatcgccgtgtccatggcaaatatttttaggggatcatacctggctggcgccggtctactgttctctatcatgaagaacaccactaatacccgccgggggacaggaaacataggcgagactctcggtgaaaaatggaagagtcgacttaacgcactgggcaaatcggagtttcagatctataagaaaagcgggattcaggaggttgacagaaccttggctaaggaaggaatcaagaggggcgagacagatcatcacgccgtgtcccgcgggtctgccaaactgcggtggttcgtcgaaagaaatatggtgacgccagagggaaaggtcgtggacctcggctgcggtcgtgggggatggtcatactattgtggcggtctgaaaaacgttagggaagtgaagggcttaaccaaagggggacctggccatgaggagcccattcctatgagcacttacgggtggaatcttgtacggctgcaatccggagtggatgtctttttcacaccacccgaaaagtgcgacaccctcctatgtgatatcggcgagagttctcctaacccaactatagaagcgggtcgcacactgcgagttttgaatctggtggagaactggctcaataacaatacccagttctgcattaaggtccttaacccctatatgccgagcgtgatcgagaaaatggaggctctgcagagaaagtacgggggagcattggtaaggaatcctctgtcacggaactccacgcacgagatgtactgggtgagtaatgccaccggcaacatcgttagctctgtgaatatgatttcccgcatgctcataaacagatttacaatgaaacacaagaaagctacttatgaaccagacgtcgatttaggctcagggaccaggaacatcggaattgagagcgaaatccccaatctggacattatcggtaagcgaatagagaagatcaaacaggaacatgagacatcgtggcactacgaccaagatcatccttataagacttgggcctaccacggctcttatgagaccaaacagacagggagtgcatccagcatggtgaacggagtcgtgcggcttctgaccaagccatgggacgttgtacccatggtgactcagatggccatgacggatacaaccccgttcggccagcaacgtgtctttaaagaaaaggtggacactagaacccaggagcctaaggaaggtacgaaaaagctaatgaaaattacagctgagtggctctggaaggagctggggaaaaagaaaaccccacgcatgtgtactagggaagagttcacacggaaggttagatcaaatgcggccttgggagcaatctttaccgatgaaaacaagtggaaatccgctcgcgaggccgtggaagactctaggttctgggagctggtcgatcgagagcggaatctccaccttgaaggcaagtgcgagacttgtgtgtacaacatgatgggcaaaagagaaaagaaactgggggagtttggaaaggcaaagggtagcagggccatttggtatatgtggttaggcgctcgcttcctggaatttgaggccttggggttcctcaatgaggaccattggtttagtcgtggaaactccctgagcggcgtagaaggtgaggggctacaccggcttggatacatcctgagagatgtgggcaaaaaggaaggcggggcgatgtacgcagacgatacagccggatgggacaccaggattacactcgaggacctgaaaaatgaagagatggttactaaccatatgaagggtgagcacaaaaagttggctgaagccatattcaagctgacctatcagaataaagtcgtgcgcgtgcagcgaccaacgcctcggggcaccgtcatggatatcatttctagaagggaccaacgcgggtcaggacaggttggcacatacggtctcaacacttttaccaatatggaggcacagcttatcagacaaatggaaggggagggaatcttcaagagtattcagcatctgacagctactgaggaaatagccgtgcagaactggttagctcgggtaggcagggagcgtctgtcccgaatggccatcagcggcgatgactgcgtggtcaaacccattgatgaccgcttcgcatctgcgttgaccgccctcaatgatatggggaaggtgagaaaagacatccagcaatgggaaccatcgcggggatggaacgattggacgcaggttcccttttgctcacaccacttccatgagctggtgatgaaggacggtagggtcctagtggtaccttgtcgcaaccaggatgaacttattggcagagctcggatcagccagggggccggatggtccctgaaggagacagcatgcctcggcaaaagttatgctcaaatgtggaccctgatgtactttcacaggcgagacttgcgtttagccgcaaatgccatatgttctgcggttccaccgcattgggtgcccactagcagaacaacctggtccatccacgctaagcacgagtggatgactaccgaagatatgctggccgtctggaaccgcgtgtggattcaggagaatccttggatggaagacaaaacaccagtggagtcatgggaagaggtcccctatctcggtaagcgggaggaccagtggtgcgggagtcttatcggactgacgtctagggcaacctgggccaaaaacattcagactgctatcaatcaagttagaagcctaataggcaacgaagagtacacagattatatgccttccatgaagcgcttccggagggaagaggaagaggccggcgtgctgtggtga

SEQ ID NO: 14519 - RNA, 9876 nt, synthetic construct
  misc_feature 1..9876: note = derived and/or modified CDS sequence (opt3) from DENV-2__FJ850119__SS-prME
  source 1..9876: mol_type = other RNA
accgccggcgtgatagtcatgctgattcccacggctatggcattccacctcactacgagaaacggggagcctcatatgatagttggaaggcaggaaaagggtaaaagccttctgtttaagaccgaggacggcatcaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtcctcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggactattcggcaagggcgggattgtaacctgcgccatgtttacatgcaaaaagaatatggaaggaaaagtggtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtcaaagaaattgctgagactcagcacggcaccatcgtgattagagtacagtatgagggtgacgggtctccatgcaagatacccttcgaaatcacggatttggagaaaaggcatgttctcggccggctgattaccgtgaacccgatcgtcacagaaaaggactcccctgtgaacatcgaggccgaacccccatttggagatagctacattataatcggcgtcgagcctgggcagttaaaactgaattggttcaagaagggatcgtctattggtcaaatgtttgagactaccatgcgaggcgctaaacgcatggccatcctaggggacacagcatgggatttcggatccctcggcggtgtgtttacttcaattgggaaggccctgcaccaggttttcggcgctatctacggagcggcatttagtggcgtgagctggaccatgaaaatacttatcggggtaattatcacgtggattggaatgaactccagatctactagcttgtcagtcagtctggtgctcgttggcgtggtcaccctgtatcttggtgccatggtgcaggctgactccgggtgtgtagtgagctggaagaataaagaactgaagtgcggatctggcatcttcataactgataacgttcacacatggaccgagcagtacaagtttcaacccgaatcaccaagtaaattggccagcgcaattcagaaggcccatgaggaaggtatctgtggcattaggtccgtcactcggctcgagaatctgatgtggaaacagatcacccccgagttaaaccacatactgtctgaaaatgaggtgaagctaacaatcatgacgggggacattaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggtggaagactacggctttggtgtcttcaccacgaacatctggctcaagctgcgtgagaaacaggacgtattttgtgattctaagttaatgagcgctgccataaaagacaatcgggcagtgcacgccgatatggggtattggattgaatccgctctgaacgacacatggaagatggagaaggcctcattcatcgaggtgaaaagctgccactggcctaagtctcataccctttggtccaatggagtattggaaagtgagatgatcattcccaagaatttcgcaggccccgtcagccagcacaactaccgacctggttatcatactcaaaccgctggcccatggcacctcgggaagctggaaatggattttgacctatgtgagggaacaactgtggttgtgaccgaagattgcggcaatagagggccctctctgaggacaacgaccgcctccggaaaactcatcactgagtggtgctgtcgctcatgcacactgccgcctcttcggtacagaggcgaggacggttgttggtacgggatggaaattaggccattgaaggagaaggaagagaacctggtcaatagtttagtgaccgcgggacatggccagatagataacttcagcctcggtgttctgggcatggccctttttctggaagagatgttgcgcactcgaatcgggacaaaacacgctattctcctggtggcagtatcgttcgtcaccctaatcacgggaaatatgtcctttcgggacctgggccgtgtgatggtgatggtcggggccactatgaccgatgacattggaatgggcgttacatatctcgctctgcttgccgcattcaaggtgagacccacctttgcggccggtttgctgttaaggaaactcacttctaaggagctgatgatggctacaatcgggatagcccttctgagccagtcaaccatccctgaaacaattctagagctcactgatgcactggctttgggaatgatggtactgaaaatcgtgcgcaacatggaaaagtaccaattagccgtcaccattatggcaatcagttgcgtgcccaatgccgttatactccagaacgcttggaaggtgtcctgtacgattctggcggccgtctctgtgagcccacttctgttgacatcctcacagcagaaagcagactggatccctctcgctctgaccatcaagggcctaaatcccactgccattttcctgaccacacttagccggacaagtaaaaagagatcttggccactcaacgaggccataatggctgttggcatggtgtccatcctggcaagctcgttgctgaaaaatgacattccgatgaccgggcctttagtcgccggaggtctcctgacggtatgctatgtgcttacaggcaggtcagcggatctggaattggagcgagctgccgacgttaagtgggaggatcaagcagaaatctctgggagttcccccattctcagcatcaccatatctgaggacggaagcatgtccatcaaaaacgaagaggaggaacagactctgacaattctaatccgcaccggcctgcttgtgatttcaggtgtctttccagtgagtatccccataactgccgctgcatggtacctctgggaggtaaagaagcagcgggccggggtgctgtgggatgtccctagcccaccccctgttgaaaaagcggagttggaagacggagcttatagaattaagcagaggggcatcttaggctactctcaaatcggggccggagtgtataaagagggtacattccacaccatgtggcatgtgacgcgtggcgcagtcctgatgcaccgcgggaagcggattgagccgtcctgggccgatgtgaaaaaggacctcatctcatacggaggcggttggaagctggaaggggagtggaaagaaggagaggaagttcaggtacttgctctggagccaggcaagaatcccagagccgtgcagactaaacctggcatatttaagaccaacacagggaccattggagcagtcagtttggatttcagcccaggtacatccggctctcccatcgtggacaggaaagggaaggttgtgggactatacggcaatggtgtcgtgactcgatcgggggcttatgtaagcgccattgcgcagaccgagaagtcaatcgaagataaccctgagatagaagacgatatttttcggaaaaagcgcctgacgatcatggacctccatccgggagccggcaaaacaaagagatacctgcccgcaatcgtcagggaggctattaaacggggccttcgaactttaatcctggccccaaccagagtggttgctgcagaaatggaggaggccctccgcgggttgcctattaggtatcaaacacccgccataaagaccgaacacactggacgtgagatcgtggacctgatgtgtcatgctaccttcacaatgcggctcctgtccccagtcagagtgcctaactacaatcttattatcatggatgaagcgcacttcacggaccccgcaagtatcgccgctaggggttatatttctactcgcgttgagatgggcgaggccgcagggatatttatgaccgccacaccaccgggaagccgagatcctttcccccagtccaacgctccaatcatggacgaagagagagaaattcccgagcggtcatggaactctggccacgaatgggtgaccgattttaagggtaaaactgtctggttcgtgcctagcatcaaggcggggaacgacattgccgcatgcctgaggaaaaatggaaagaaagtaatccagttgagtcgcaagacatttgattccgagtacgtgaagacccgtgctaacgactgggatttcgttgtcacgactgacataagcgagatgggcgccaattttaaagcagaaagagtgatcgatccacggaggtgtatgaagcccgtgattctaacagacggcgaggaacgcgtcatcctggccgggcctatgccggtaacccattcttcagctgcccaacgaagaggacggattggtaggaaccccaaaaatgagaacgaccagtatatctacatgggcgaacccctcgagaatgatgaggactgcgcgcactggaaggaagcaaaaatgttactggataacataaatacccctgaggggattatcccctccatgttcgaaccagagcgcgaaaaggtggacgccattgatggagagtacagacttaggggcgaggctcggaaaacttttgttgacctgatgcgtcgcggtgatctccctgtgtggttggcctataaggtcgctgcagaagggatcaactacgccgaccgaaagtggtgtttcgatggcatcaaaaataaccagatcctggaggaaaacatggaggtggagatttggacaaaggaaggagagaggaaaaagctcaaacccagatggctggacgctcggatctatagtgatccacttgccctaaaggaatttaaggagttcgcagcgggccgcaaaagcctgaccttgaatttaattacagaaatggggagactgcctactttcatgacgcagaaggccaggaacgctctcgacaatctggccgttcttcataccgcagaggctggaggtcgggcctacaaccacgcactgtcggagctcccggaaacattggagactctgctactgctcacccttctggccacagtgaccggcgggatctttttattcttgatgtctggaaaaggcataggtaagatgactctggggatgtgctgcattatcacggcttccatcctcctgtggtatgcgcaaattcagccccactggatcgccgcaagcataattcttgaatttttcctgatcgtcctcttgattccagagcctgaaaaacagcgaaccccacaggataatcaactgacatacgtggtaatcgctatattaactgtggttgccgccaccatggcaaacgagatgggctttctagagaagacaaagaaagacctgggactcggctcaatcaccactcaggaaagtgagtctaatattcttgacatcgatctgagaccagcttccgcctggacattgtatgcggtcgctacgaccttcgtgactcctatgctgcgccatagcattgaaaactcaagtgtgaatgtcagcctcacagccatcgcaaaccaggccaccgttctgatggggcttggaaagggttggcccctctccaaaatggacattggcgtgccgctgttggctatcgggtgttactctcaggtaaatccaataaccctgacagcagccttactactgctcgtggcgcactacgctattatcggacctggccttcaagccaaggcaactagggaggcccagaaacgggctgccgcaggtatcatgaagaaccccacggtcgatgggattaccgtgatagacctggaaccaatcccctatgatcctaagtttgagaaacagttgggccaggttatgctgctcattctgtgcgtgacacaagtccttatgatgcgtactacctgggctttatgtgaggccctgacactcgcgaccggaccgatcagcactttgtgggaaggcaatcccgggagattctggaacacgacaattgccgtatccatggcaaatatctttaggggatcatacctggctggcgccggtctactgttctctataatgaagaacaccactaatacccgccgggggacaggaaacatcggcgagactctcggtgaaaaatggaagagtcgacttaacgcactgggcaaatcggagtttcagatttataagaaaagcgggatccaggaggtggacagaaccttggctaaggaaggaattaagaggggcgagacagatcatcacgccgtttcccgcgggtctgccaaactgcggtggttcgtggaaagaaatatggtcacgccagagggaaaggtggtcgacctcggctgcggtcgtgggggatggtcatactattgtggcggtctgaaaaacgtgagggaagttaagggcttaaccaaagggggacctggccatgaggagcccatccctatgagcacttacgggtggaatcttgtgcggctgcaatccggagtagatgtgtttttcacaccacccgaaaagtgcgacaccctcctatgtgatataggcgagagttctcctaacccaactattgaagcgggtcgcacactgcgagtcttgaatctggttgagaactggctcaataacaatacccagttctgcatcaaggtgcttaacccctatatgccgagcgtcatcgagaaaatggaggctctgcagagaaagtacgggggagcattggtgaggaatcctctgtcacggaactccacgcacgagatgtactgggtaagtaatgccaccggcaacattgtgagctctgttaatatgatatcccgcatgctcatcaacagatttacaatgaaacacaagaaagctacttatgaaccagacgtggatttaggctcagggaccaggaacattggaatcgagagcgaaattcccaatctggacatcataggtaagcgaatcgagaagattaaacaggaacatgagacatcgtggcactacgaccaagatcatccttataagacttgggcctaccacggctcttatgagaccaaacagacagggagtgcatccagcatggtcaacggagtggtccggcttctgaccaagccatgggacgtggttcccatggtaactcagatggccatgacggatacaaccccgttcggccagcaacgtgtgtttaaagaaaaggtcgacactagaacccaggagcctaaggaaggtacgaaaaagctaatgaaaatcacagctgagtggctctggaaggagctggggaaaaagaaaaccccacgcatgtgtactagggaagagttcacacggaaggtgagatcaaatgcggccttgggagcaatttttaccgatgaaaacaagtggaaatccgctcgcgaggccgttgaagacggcaggttctgggagctggtggatcgagagcggaatctccaccttgaaggcaagtgcgagacttgtgtctacaacatgatggggaaaagagaaaagaaactgggagagtttggtaaggcaaagggctctagggccatctggtatatgtggttaggggctcgcttcctggaatttgaggccttgggattcctcaatgaggaccattggtttagccgtggcaacagtctgtccggtgtggaaggggagggactacaccggcttggctacattctgagagatgtaggcaaaaaggaagggggagcgatgtacgcagacgatacagccggttgggacaccaggataacactcgaggacctgaaaaatgaagagatggtgactaaccatatgaagggcgagcacaaaaagttggctgaagccatcttcaagctgacctatcagaataaagttgtccgcgtgcagcgaccaacgcctcgggggaccgtgatggatattatcagcagaagggaccaacgcggatctggccaggtcggtacatacgggctcaacacttttaccaatatggaggcacagcttatcagacaaatggaaggagagggcattttcaagtcaatacagcatctgacagctagtgaggaaactgccgttcagaactggttagctcgggtgggcagggagcgtctgtcccgaatggccatcagcggggatgactgcgtagtgaaacccattgatgaccgcttcgcatctgcgttgaccgccctcaatgatatgggaaaggtcagaaaagacatccagcaatgggaaccatcgcggggttggaacgattggacacaggtgcccttttgctcacaccacttccatgagctggttatgaaggacggcagggtgctagtcgtgccttgtcgcaaccaggatgaacttattgggagagctcggatcagccagggagccggctggtccctgaaggagacagcatgcctcggtaaaagttatgctcaaatgtggaccctgatgtactttcacaggcgagacttgcgtttagccgcaaatgccatatgttctgcggtaccaccgcattgggttcccactagcagaacaacctggtccatccacgctaagcacgagtggatgactaccgaagatatgctggccgtgtggaaccgcgtctggattcaggagaatccttggatggaagacaaaacaccagtggagtcatgggaagaggtgccctatctcgggaagcgggaggaccagtggtgcggaagtcttatcggcctgacgtctagggcaacctgggccaaaaacattcagactgctatcaatcaagtcagaagcctaataggcaacgaagagtacacagattatatgccttccatgaagcgcttccggagggaagaggaagaggccggggttctgtggtga

SEQ ID NO: 14520 - RNA, 9876 nt, synthetic construct
  misc_feature 1..9876: note = derived and/or modified CDS sequence (opt3) from DENV-2__FJ850064__SS-prME
  source 1..9876: mol_type = other RNA
accgccggcgtgatagtcatgctgattcccaccgctatggcattccacctcactacgagaaacggggagcctcatatgatagttggaaggcaggaaaagggtaaaagccttctgtttaagaccgaggacggcgtgaatatgtgcacgttgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgctactaccatgcgaggcgccaaacgcatggcaattctaggggacacagcctgggatttcggatccctcggcggtgtttttacttcaatcgggaaggctctgcaccaggtgttcggcgcgatttacggagcagcctttagtggcgtaagctggaccatgaaaatccttataggggtcatcattacgtggatcggaatgaactccagatctactagcttgtcagtgagtctggttctcgtgggcgtcgtgaccctgtatcttggtgctatggtacaggccgactccgggtgtgtggttagctggaagaataaagagctgaagtgcggatctggcattttcatcactgataacgtccacacatggaccgaacagtacaagtttcaacccgagtcaccaagtaaattggcaagcgccatacagaaggctcatgaagagggtatttgtggcatcaggtccgtgactcggctcgaaaatctgatgtggaaacagattacccccgagttaaaccacatcctgtctgagaatgaagtgaagctaacaataatgacgggggacatcaaaggaattatgcaggccggcaagcgctcgctcagacctcaaccaaccgagctgaaatatagctggaagacttgggggaaggcaaaaatgctttccacagaatcacataaccagaccttcttgatcgatggaccggagacagcggaatgccccaatactaacagggcttggaatagtctggaggtcgaggactacggctttggtgttttcaccacgaacatttggctcaagctgcgtgaaaaacaggacgtgttttgtgattctaagttaatgagcgccgcaatcaaagacaatcgggccgtgcacgctgatatggggtattggatagagtccgccctgaacgacacatggaagatggaaaaggcatcattcattgaggtaaaaagctgccactggcctaagtctcataccctttggtccaatggagtcttggagagtgaaatgatcatccccaagaatttcgctggccccgtgagccagcacaactaccgacctggttatcatactcaaaccgccggcccatggcacctcgggaagctggagatggattttgacctatgtgaaggaacaactgttgtggtcaccgaggattgcggcaatagagggccctctctgaggacaacgaccgcgtccggaaaactcattactgaatggtgctgtcgctcatgcacactgccgcctcttcggtacagaggcgaggacggttgttggtacgggatggagatcaggccattgaaggaaaaggaggaaaacctggtgaatagtttagttaccgccggacatggccagattgataacttcagcctcggtgtgctgggcatggctctttttctggaggaaatgttgcgcactcgaatagggacaaaacacgcaatcctcctggtagccgtctcgttcgtgaccctaattacgggaaatatgtcctttcgggacctgggccgtgtgatggtcatggttggggctactatgaccgatgacatcggaatgggcgtgacatatctcgccctgcttgcagcgttcaaggtaagacccacctttgccgctggtttgctgttaaggaaactcacttctaaggagctgatgatggccacaattgggatcgcacttctgagccagtcaaccatacctgagacaatcctagaactcactgatgctctggccttgggaatgatggtgctgaaaattgtccgcaacatggagaagtaccaattagcagtgaccatcatggccattagttgcgttcccaatgctgtgatcctccagaacgcgtggaaggtctcctgtacgatactggccgcagtgtctgttagcccacttctgttgacatcctcacagcagaaagctgactggattcctctcgccctgaccatcaagggcctaaatcccactgccatcttcctgaccacacttagccggacaagtaaaaagagatcttggccactcaacgaagctattatggcagtgggcatggtctccatactggccagctcgttgctgaaaaatgacatcccgatgaccgggcctttagtagcgggaggtctcctgacggtgtgctatgttcttacaggcaggtcagctgatctggagttggaacgagccgcagacgtgaagtgggaggatcaagccgagatttctgggagttcccccatcctcagcattaccatctctgaagacggaagcatgtccatcaaaaacgaggaagaggagcagactctgacaatcctaattcgcaccggcctgcttgtcatctcaggtgtgtttccagtaagtattcccatcactgctgcagcctggtacctctgggaagtgaagaagcagcgggcgggggtcctgtgggatgttcctagcccaccccctgtggagaaagctgaattggaggacggagcctatagaataaagcagaggggcattttaggctactctcaaatcggggcaggagtgtataaagaaggtacattccacaccatgtggcatgtcacgcgtggcgccgtgctgatgcaccgcgggaagcggatcgagccgtcctgggctgatgttaaaaaggacctcatttcatacggaggcggttggaagctggagggggaatggaaagagggagaagaggtacaggtgcttgccctggaaccaggcaagaatcccagagcagtccagactaaacctggcatctttaagaccaacacagggaccataggagctgtgagtttggatttcagcccaggtacatccggctctcccattgttgacaggaaagggaaggtggtcggactatacggcaatggtgtggtaactcgatcgggggcctatgtcagcgcgatcgcccagaccgagaagtcaattgaggataaccctgaaatcgaggacgatatatttcggaaaaagcgcctgacgattatggacctccatccgggagcaggcaaaacaaagagatacctgcccgctatcgtgagggaagccatcaaacggggccttcgaactttaattctggctccaaccagagttgtggcagccgagatggaagaggccctccgcgggttgcctatcaggtatcaaacacccgctattaagaccgagcacactggacgtgaaatagtcgacctgatgtgtcatgcgaccttcacaatgcggctcctgtccccagtgagagttcctaactacaatcttatcattatggatgaggcacacttcacggaccccgccagtatcgctgccaggggttatatctctactcgcgtggaaatgggcgaggcagccgggatttttatgaccgctacaccaccgggaagccgagatcctttcccccagtccaacgcgccaataatggacgaggaaagagagatccccgaacggtcatggaactctggccacgagtgggtcaccgattttaagggtaaaactgtgtggttcgtacctagcattaaggccgggaacgacatcgcagcttgcctgaggaaaaatggaaagaaagtgattcagttgagtcgcaagacatttgattccgaatacgttaagacccgtgccaacgactgggatttcgtcgtgacgactgacatcagcgagatgggcgcaaattttaaagccgagagagtgatagatccacggaggtgtatgaagcccgtcatcctaacagacggcgaagaacgcgtaattctggctgggcctatgccggtgacccattcttcagccgcgcaacgaagaggacggatcggtaggaaccccaaaaatgaaaacgaccagtatatttacatgggcgagcccctcgaaaatgatgaggactgcgcacactggaaggaggccaaaatgttactggataacatcaatacccctgaagggataattccctccatgttcgagccagaacgcgagaaggttgacgctatcgatggagaatacagacttaggggcgaggcccggaaaacttttgtggacctgatgcgtcgcggtgatctccctgtctggttggcttataaggtggcagccgaggggattaactacgctgaccgaaagtggtgtttcgatggcatcaaaaataaccagatactggaagagaacatggaagttgagatctggacaaaggagggagaaaggaaaaagctcaaacccagatggctggacgcccggatttatagtgatccacttgcactaaaggagtttaaggagttcgcggccggccgcaaaagcctgaccttgaatttaatcacagagatggggagactgcctactttcatgacgcagaaggctaggaacgccctcgacaatctggcagtgcttcataccgctgaagccggaggtcgggcatacaaccacgccctgtcggagctcccggagacattggaaactctgctactgctcacccttctggctacagtcaccggcgggatatttttattcttgatgtctggaaaaggcatcggtaagatgactctggggatgtgctgcataattacggcgtccatcctcctgtggtatgcccaaatccagccccactggattgcagctagcatcatacttgagtttttcctgattgtgctcttgatcccagaacctgagaaacagcgaaccccacaggataatcaactgacatacgtagtgattgccatcttaactgttgtcgccgcaaccatggctaacgaaatgggctttctagagaagacaaagaaagacctgggactcggctcaataaccactcaggagagtgaatctaatatccttgacattgatctgagaccagcctccgcgtggacattgtatgctgtggccacgaccttcgtgactcctatgctgcgccatagcatcgagaactcaagtgtcaatgttagcctcacagcaattgccaaccaggctaccgtgctgatggggcttggaaagggttggcccctctccaaaatggacatcggcgtaccgctgttggcaattgggtgttactctcaggtgaatccaatcaccctgacagccgcgttactactgctcgtcgctcactacgccataattggacctggccttcaagcaaaggccactagggaagctcagaaacgggccgcagctggtatcatgaagaaccccacggtggatgggatcaccgttattgacctggagccaataccctatgatcctaagtttgaaaaacagttgggccaggtgatgctgctcatcctgtgcgtcacacaagtacttatgatgcgtactacctgggccttatgtgaggcgctgacactcgccaccggaccgattagcactttgtgggagggcaatcccgggagattctggaacacgacaatcgcagtgtccatggctaatatttttaggggatcatacctggccggcgcaggtctactgttctctatcatgaagaacaccactaatacccgccgggggacaggaaacataggcgaaactctcggtgagaaatggaagagtcgacttaacgctctgggcaaatcggaatttcagatctataagaaaagcgggattcaggaggttgacagaaccttggccaaggagggaatcaagaggggcgaaacagatcatcacgccgtgtcccgcgggtctgcgaaactgcggtggttcgtcgagagaaatatggtgacgccagaaggaaaggtcgtggacctcggctgcggtcgtgggggatggtcatactattgtggcggtctgaaaaacgttagggaggtgaagggcttaaccaaagggggacctggccatgaggaaccaattcctatgagcacttacgggtggaatcttgtacggctgcaatccggagtggatgtctttttcacaccacccgagaagtgcgacaccctcctatgtgatatcggcgaaagttctcctaacccaactatagaggctggtcgcacactgcgagttttgaatctggtggaaaactggctcaataacaatacccagttctgcattaaggtccttaacccctatatgccgagcgtgatcgagaaaatggaagcactgcagagaaagtacgggggagccttggtaaggaatcctctgtcacggaactccacgcacgagatgtactgggtgagtaatgctaccggcaacatcgttagctctgtgaatatgatttcccgcatgctcataaacagatttacaatgaaacacaagaaagccacttatgagccagacgtcgatttaggctcagggaccaggaacatcggaattgaaagcgaggtgcccaatctggacatcattggtaagcgaatcgaaaagataaaacaggagcatgaaacatcgtggcactacgaccaagatcatccttataagacttgggcataccacggctcttatgagaccaaacagacagggagtgcctccagcatggtcaacggagtggttcggcttctgaccaagccatgggacgtagtgcccatggtcactcagatggctatgacggatacaaccccgttcggccagcaacgtgtgtttaaagagaaggttgacactagaacccaggaacctaaggagggtacgaaaaagctaatgaaaatcacagcggaatggctctggaaggagctggggaaaaagaaaacaccccgcatgtgtactagggaggagttcacacggaaggtgagatcaaatgccgcattgggagctatttttaccgatgagaacaagtggaaatccgcccgcgaagcagtcgaggacggcaggttctgggaactggtggatcgagagcggaatctccaccttgagggcaagtgcgaaacttgtgtatacaacatgatggggaaaagagagaagaaactgggagaatttggtaaggccaagggctctagggctatctggtatatgtggttaggggcccgcttcctggagtttgaagcgttgggattcctcaatgaggaccattggtttagccgtggcaacagtctgtccggtgtggagggggaaggactacaccggcttggctacattctgagagatgttggcaaaaaggaagggggagcaatgtacgccgacgatacagctggttgggacaccaggatcacactcgaagacctgaaaaatgaggaaatggtcactaaccatatgaagggcgagcacaaaaagttggccgaggcaattttcaagctgacctatcagaataaagtggtgcgcgtccagcgaccaacgcctcgggggaccgttatggatataatcagcagaagggaccaacgcggatctggccaggtgggtacatacgggctcaacacttttaccaatatggaagctcagcttattagacaaatggagggagaaggcatcttcaagtcaatccagcatctgacagccactgaggagattgctgtacagaactggttagcccgggtgggcagggaacgtctgagtcgaatggcaatatccggggatgactgcgtcgtgaaacccatcgatgaccgcttcgcgagcgccttgaccgctctcaatgatatgggaaaggttagaaaagacattcagcaatgggagccatctcggggttggaacgattggacacaggtgcccttttgctcgcaccacttccatgaactggtcatgaaggacggcagggtgctagtagttccttgtcgcaaccaggatgagcttatcgggagagcccggatttcacagggagcaggctggagcctgaaggaaacagcttgcctcggtaaatcctatgcccaaatgtggaccctgatgtactttcacaggcgagacttgcgtttagcagccaatgcgatctgtagtgctgtgccaccgcattgggtccccacttctagaacaacctggagcatacacgccaagcacgagtggatgactaccgaggatatgctggcagtgtggaaccgcgtgtggatccaggaaaatccttggatggaggacaaaacaccagtcgaatcctgggaggaagttccctatctcgggaagcgggaggaccagtggtgcggatcacttattggcctgacgagtagggccacctgggctaaaaacatccagactgccattaatcaagtgagatctctaatcggcaacgaggaatacacagattatatgcctagcatgaagcgcttccggagggaggaagaggaagcaggggtactgtggtga

SEQ ID NO: 14521 - RNA, 9876 nt, synthetic construct
  misc_feature 1..9876: note = derived and/or modified CDS sequence (opt3) from DENV-2__FJ850065__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcacagaagcaaagttgactaacaccacaactgagagtcgctgtccaacccaaggagagccctccctgaatgaagagcaggacaaacgatttatttgcaagcattctatggtcgatagaggctggggtaacgggtgtggactattcggcaagggcgggatcgtgacatgcgccatgtttacctgcaaaaagaatatggaaggaaaagtggtccagcctgagaacctcgaatacactatcgttattacgccacacagcggtgaggagcatgctgtgggcaatgacacagggaagcacggaaaagaaataaagatcaccccgcagtcctcaattactgaggccgaactgaccggctatggtacagtaaccatggagtgtagtcccaggactgggcttgatttcaacgaaatggtgctgttgcaaatggaggacaaagcatggctcgtccaccggcagtggtttctggatttacctctgccatggctccccggcgctgacacacagggaagcaattggatccagaaggagacgcttgtgaccttcaagaaccctcatgccaaaaagcaagacgttgtggtcctgggctctcaggaaggggcgatgcacactgccttgacaggagcaaccgagatacagatgtcctcaggtaatctactgtttacaggccatctcaaatgccgtctgcgcatggataagcttcaactgaaagggatgagctacagtatgtgtactggaaagttcaagattgtgaaagaaatcgctgagacccagcacggcacgatcgtaattagagttcagtatgagggtgacgggtctccatgcaagatccccttcgaaattaccgatttggagaaaaggcatgtgctcggccggctgataacagtcaacccgatcgtgactgaaaaggactcccctgtcaacattgaggccgaacccccatttggagatagctacatcatcattggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtgtggttagctggaagaataaagaactgaagtgcggatctggcatcttcattacagataacgtccacacctggactgagcagtacaagtttcaacccgaatcaccaagtaaattggccagcgcaatccagaaggcccatgaggaaggtatatgtggcattaggtccgtgacccggctcgagaatctgatgtggaaacagatcacacccgagttaaaccacattctgtctgaaaatgaggtgaagctaacgatcatgaccggggacataaaaggaatcatgcaggctggcaagcgctcgctcagacctcaaccaactgaactgaaatatagctggaagacatgggggaaggccaaaatgctttccaccgagtcacataaccagacattcttgattgatggaccggaaactgcagagtgccccaataccaacagggcgtggaatagtctggaggtcgaagactacggctttggtgttttcacgacaaacatctggctcaagctgcgtgagaaacaggacgtgttttgtgattctaagttaatgagcgctgccattaaagacaatcgggcagtgcacgccgatatggggtattggatcgaatccgctctgaacgacacctggaagatggagaaggcctcattcatagaggtaaaaagctgccactggcctaagtctcatactctttggtccaatggagtcttggaaagtgagatgattatcccaaaaaacttcgcaggccccgtgagccagcacaactaccgacctggttatcatacccaaacagctggcccatggcacctcgggaagctggaaatggattttgacctatgtgagggaactaccgttgtggtcacagaagattgcggcaatagagggccctctctgaggacgaccactgcctccggaaaactcatcacagagtggtgctgtcgctcatgcaccctgccgcctcttcggtacagaggcgaggacggttgttggtacgggatggaaattaggccattgaaggagaaggaagagaacctggtgaatagtttagttactgcgggacatggccagatcgataacttcagcctcggtgtgctgggcatggccctttttctggaagagatgttgcgcacacgaattgggaccaaacacgctatactcctggtagcagtctcgttcgtgacgctaatcactggaaatatgtcctttcgggacctgggccgtgtgatggtcatggttggggccaccatgacagatgacattggaatgggcgtgacctatctcgctctgcttgccgcattcaaggtaagacccacttttgcggccggtttgctgttaaggaaactcacatctaaggagctgatgatggctaccatcgggattgcccttctgagccagtcaacaatccctgaaactatactagagctcaccgatgcactggctttgggaatgatggtgctgaaaatcgtccgcaacatggaaaagtaccaattagccgtgacgattatggcaatcagttgcgttcccaatgccgtgattctccagaacgcttggaaggtctcctgtacaatcctggcggccgtgtctgttagcccacttctgttgacctcctcacagcagaaagcagactggatacctctcgctctgactattaagggcctaaatcccaccgccatcttcctgacaactcttagccggaccagtaaaaagagatcttggccactcaacgaggccatcatggctgtgggcatggtctccattctggcaagctcgttgctgaaaaatgacataccgatgacggggcctttagtagccggaggtctcctgacagtgtgctatgttcttaccggcaggtcagcggatctggaattggagcgagctgccgacgtgaagtgggaggatcaagcagaaatctctgggagttcccccattctcagcatcactatttctgaggacggaagcatgtccatcaaaaacgaagaggaggaacagacactgaccatactaatccgcactggcctgcttgtcatttcaggtgtgtttccagtaagtatccccattacagccgctgcatggtacctctgggaggtgaagaagcagcgggccggggtcctgtgggatgttcctagcccaccccctgtggaaaaagcggagttggaagacggagcttatagaatcaagcagaggggcatattaggctactctcaaattggggccggagtgtataaagagggtaccttccacacgatgtggcatgtcactcgtggcgcagtgctgatgcaccgcgggaagcggatcgagccgtcctgggccgatgttaaaaaggacctcatctcatacggaggcggttggaagctggaaggggagtggaaagaaggagaggaagtacaggtgcttgctctggagccaggcaagaatcccagagccgtccagaccaaacctggcatttttaagacaaacaccgggacaatcggagcagtgagtttggatttcagcccaggtacttccggctctcccatagttgacaggaaagggaaggtggtcggactatacggcaatggtgtggtaacccgatcgggggcttatgtcagcgccattgcgcagacggagaagtcaatcgaagataaccctgagattgaagaggacatctttcggaaaaagcgcctgacaataatggatctccatccgggagccggcaaaactaagagatacctgcccgcaattgtgagggaagctatcaaacggggccttcgaaccttaatcctggccccaacaagagttgtggctgcagagatggaggaagccctccgcgggttgcctattaggtatcaaacccccgccatcaagactgagcacaccggacgtgaaattgtcgacctgatgtgtcatgctacattcacgatgcggctcctgtccccagtgagagttcctaactacaatcttataatcatggacgaggcgcacttcactgatcccgcaagtattgccgctaggggttatatctctacccgcgtggagatgggcgaagccgcagggatctttatgacagccaccccaccgggaagccgagaccctttcccccagtccaacgctccaattatggatgaggaaagagagatacccgaacggtcatggaattctggccacgagtgggtcactgactttaagggtaaaacagtgtggttcgtacctagcatcaaggcggggaacgatattgccgcatgcctgaggaaaaatggaaagaaagtgatccagttgagtcgcaagacctttgactccgagtacgttaagacgcgtgctaacgattgggacttcgtcgtgactacagatattagcgaaatgggcgccaattttaaagcagagagagtgatcgacccacggaggtgtatgaagcccgtcatactaaccgatggcgaagagcgcgtaatcctggccgggcctatgccggtgacccattcttcagctgcccaacgaagaggacggattggtaggaacccaaaaaatgaaaacgaccagtatatctacatgggcgagcccctcgagaatgacgaagattgcgcgcactggaaggaggcaaaaatgttactggacaacattaatactcctgaagggatcataccctccatgttcgagccagaacgcgagaaggttgatgccattgacggagagtacagacttaggggcgaagctcggaaaacatttgtggatctgatgcgtcgcggtgacctccctgtctggttggcctataaggtggctgcagaggggatcaactacgccgatcgaaagtggtgtttcgacggcattaaaaataaccagatcctggaagagaacatggaggttgaaatatggaccaaggagggagaaagaaaaaagctcaaacccaggtggctggatgctcggatctatagtgacccacttgccctaaaggagtttaaggaattcgcagcgggccgcaaaagcctgacattgaatttaattactgagatggggagactgcctacgttcatgacccagaaggccaggaacgctctcgataatctggccgtgcttcatacagcagaggctggaggtcgggcctacaaccacgcactgtcggaactcccggagactttggaaaccctgctactgctcacacttctggccaccgtcactggcgggatctttttattcttgatgtctggaaaaggcattggtaagatgacgctggggatgtgctgcatcataaccgcttccattctcctgtggtatgcgcaaatccagccccactggatcgccgcaagcattatccttgagtttttcctgatagtgctcttgattccagaacctgagaaacagcgaacaccccaggacaatcaactgacttacgtagtgatcgctattttaaccgttgtcgccgccacaatggcaaacgagatgggctttctagaaaagaccaagaaagatctgggactcggctcaatcactacacaggagagtgaatctaatatacttgacatcgacctgagaccagcttccgcctggacgttgtatgcggtggctaccactttcgtgacacctatgctgcgccatagcattgagaactcaagtgtcaatgttagcctcaccgccatcgcaaaccaggccaccgtgctgatggggcttggaaagggttggcccctctccaaaatggatattggcgtaccgctgttggctatcgggtgttactctcaggtgaatccaattacactgactgcagccttactactgctcgtcgcgcactacgctatcataggacctggccttcaagccaaggcaacgagggaagcccagaaacgggctgccgcaggtattatgaagaaccccaccgtggacgggatcacagttatcgatctggagccaattccctatgaccctaagtttgagaaacagttgggccaggtgatgctgctcatactgtgcgtcactcaagtacttatgatgcgtaccacatgggctttatgtgaagccctgaccctcgcgactggaccgatcagcacgttgtgggagggcaatcccgggagattctggaacacaaccattgccgtgtccatggcaaatatctttaggggatcatacctggctggcgccggtctactgttctctattatgaagaacactaccaatacacgccgggggactggaaacatcggcgaaaccctcggtgagaaatggaagagtcgacttaacgcactgggcaaatcggagtttcagatatataagaaaagcgggatccaggaagttgatagaacattggctaaggagggaattaagaggggcgaaacggaccatcacgccgtgtcccgcgggtctgccaaactgcggtggttcgtcgagagaaatatggtgaccccagaaggaaaggtcgtggatctcggctgcggtcgtgggggatggtcatactattgtggcggtctgaaaaacgttagggaggtgaagggcttaactaaagggggacctggccatgaggaacccatccctatgagcacatacgggtggaatcttgtacggctgcaatccggagtggacgtctttttcaccccacccgagaagtgcgatactctcctatgtgacattggcgaaagttctcctaacccaacaatcgaggcgggtcgcaccctgcgagttttgaatctggtggaaaactggctcaataacaatacgcagttctgcataaaggtccttaacccctatatgccgagcgtgattgagaaaatggaggctctgcagagaaagcacgggggagcattggtaaggaatcctctgtcacggaactccacccacgaaatgtactgggtgagtaatgccacaggcaacatcgttagctctgtgaatatgatctcccgcatgctcattaacagatttactatgaaacataagaaagctacctacgagccagatgtcgacttaggctcagggacaaggaacataggaatcgaaagcgagattcccaatctggatatcattggtaagcgaatcgaaaagataaaacaggagcacgagacttcgtggcattatgaccaagaccacccttacaagacctgggcctatcacggctcttacgaaacaaaacagaccgggagtgcatccagcatggtgaacggagtcgtgcggcttctgactaagccatgggatgttgtacccatggtgacgcagatggccatgacagacaccactccgttcggccagcaacgtgtctttaaagagaaggtggataccagaacacaggaacctaaggagggtacgaaaaagctaatgaaaatcaccgctgagtggctctggaaggaactggggaaaaagaaaactccccgcatgtgtacaagggaggaattcacccggaaggttagatcaaatgcggccttgggagcaatttttactgacgagaacaagtggaaatccgctcgcgaagccgtggaggatggcaggttctgggagctggtcgaccgagaacggaatctccatcttgagggcaagtgcgaaacatgtgtgtataacatgatggggaaaagagagaagaaactgggagaatttggtaaggcaaagggctctagggccatctggtacatgtggttaggggctcgcttcctggagtttgaggccttgggattcctcaatgaagatcactggtttagccgtggcaacagtctgtccggtgtagagggggaaggactacatcggcttggctatattctgagagacgtgggcaaaaaggaggggggagcgatgtacgcagatgacaccgccggttgggatacaaggatcactctcgaagacctgaaaaatgaggagatggttaccaaccacatgaagggcgaacataaaaagttggctgaggccattttcaagctgacgtaccagaataaagtcgtgcgcgtgcagcgaccaacccctcgggggacagtcatggacataatcagcagaagggatcaacgcggatctggccaggttggtacttatgggctcaacacctttacaaatatggaagcacagcttattagacaaatggagggagagggcatcttcaagtcaatccagcacctgactgctaccgaagagattgccgtgcagaactggttagctcgggtaggcagggaacgtctgagtcgaatggccatatccggggacgattgcgtggtcaaacccatcgacgatcgcttcgcaagcgcgttgacggccctcaatgacatgggaaaggtgagaaaagatattcagcaatgggagccatctcggggttggaacgactggacacaggttcccttttgctcgcaccatttccacgaactggtgatgaaggatggcagggtcctagtggtaccttgtcgcaaccaggacgagcttatcgggagagctcggatttcacagggagccggctggagcctgaaggagaccgcatgcctcggtaaatcctacgctcaaatgtggactctgatgtattttcataggcgagatttgcgtttagccgcaaatgccatctgtagtgcggttccaccgcactgggtgcccacatctagaaccacttggagcatacacgctaagcatgaatggatgaccacagaggacatgctggccgtctggaaccgcgtgtggatccaggaaaatccttggatggaggataaaacgccagtggaatcctgggaggaggtcccctacctcgggaagcgggaagaccagtggtgcggatcacttattggcctgaccagtagggcaacttgggccaaaaacatccagacagctattaatcaagttagatctctaatcggcaacgaggaatataccgactacatgcctagcatgaagcgcttccggagggaggaagaggaggccggggtgctgtggtga

SEQ ID NO: 14522 - RNA, 9876 nt, synthetic construct
  misc_feature 1..9876: note = derived and/or modified CDS sequence (opt3) from DENV-2__FJ873808__SS-prME
  source 1..9876: mol_type = other RNA
acagccggagtgatcgtcatgctgattccaacagctatggcattccacctcactacgagaaacggggaacctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctaccagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggtcgaagactacggctttggtgttttcaccacgaacatttggctcaagctgcgtgagaaacaggacgtgttttgtgattctaagttaatgagcgctgccatcaaagacaatcgggcagtgcacgccgatatggggtattggatagaatccgctctgaacgacacatggaagatggagaaggcctcattcattgaggtaaaaagctgccactggcctaagtctcataccctttggtccaatggagtcttggaaagtgagatgatcatccccaagaatttcgcaggccccgtgagccagcacaactaccgacctggttatcatactcaaaccgctggcccatggcacctcgggaagctggaaatggattttgacctatgtgagggaacaactgttgtggtcaccgaagattgcggcaatagagggccctctctgaggacaacgaccgcctccggaaaactcattactgagtggtgctgtcgctcatgcacactgccgcctcttcggtacagaggcgaggacggttgttggtacgggatggaaatcaggccattgaaggagaaggaagagaacctggtgaatagtttagttaccgcgggacatggccagattgataacttcagcctcggtgtgctgggcatggccctttttctggaagagatgttgcgcactcgaatagggacaaaacacgctatcctcctggtagcagtctcgttcgtgaccctaattacgggaaatatgtcctttcgggacctgggccgtgtgatggtcatggttggggccactatgaccgatgacatcggaatgggcgtgacatatctcgctctgcttgccgcattcaagattagacccacctttgcggccggtttgctgttaaggaaactcacttctaaggagctgatgatggctacaatcgggatagcccttctgagccagtcaaccatccctgaaacaattctagagctcactgatgcactggctttgggaatgatggtactgaaaatcgtgcgcaacatggaaaagtaccaattagccgtcaccattatggcaatcagttgcgtgcccaatgccgttatactccagaacgcttggaaggtgtcctgtgcgattctggccgcagtctctgtgagcccacttctgttgacgtcctcaaaacagaaggctgactggatccctctcgccctgacaatcaaaggcctaaatcccaccgccattttcctgactacccttagccggacaagtaagaaaagatcttggccactcaacgaggctgttatggcagtgggcatggtctccatactggccagctcgttgctgaagaatgacatcccgatgactgggcctttagtagcgggaggtctcctgaccgtgtgctatgttcttacgggcaggtcagctgatctggaattggagcgagccgcagacgtgaaatgggaggatcaggccgaaatttctgggagttcccccatcctcagcattacaatctctgaggacggaagcatgtccataaagaacgaagaggaggaacaaaccctgactatcctaattcgcacaggcctgcttgtcatctcaggtgtgtttccagtaagtattcccatcaccgctgcagcctggtacctctgggaggtgaagaaacagcgggcgggggtcctgtgggatgttcctagcccaccccctgtggaaaaggctgagttggaagacggagcctatagaataaaacagaggggcattttaggctactctcagatcggggcaggagtgtataaggagggtactttccacacaatgtggcatgtcacccgtggcgccgtgctgatgcaccgcgggaaacggatcgagccgtcctgggctgatgttaagaaggacctcatttcatacggaggcggttggaaactggaaggggagtggaaggaaggagaggaagtacaagtgcttgccctggagccaggcaaaaatcccagagcagtccagacgaagcctggcatctttaaaactaacaccgggacaataggagctgtgagtttggatttcagcccaggtacctccggctctcccattgttgacaggaaggggaaggtggtcggactatacggcaatggtgtggtaacacgatcgggggcctatgtcagcgcgatcgcccagactgagaaatcaattgaagataaccctgagatcgaagacgatatatttcggaagaaacgcctgaccattatggacctccatccgggagcaggcaagacgaaaagatacctgcccgctatcgtgagggaggccatcaagcggggccttcgaacattaattctggctccaactagagttgtggcagccgaaatggaggaggccctccgcgggttgcctatcaggtatcagacccccgctattaagacagaacacaccggacgtgagatagtcgacctgatgtgtcatgcgactttcaccatgcggctcctgtccccagtgagagttcctaactacaatcttatcattatggatgaagcacacttcacagaccccgccagtatcgctgccaggggttatatctctacgcgcgtggagatgggcgaggcagccgggatttttatgactgctaccccaccgggaagccgagatcctttcccccaatccaacgcgccaataatggacgaagagagagaaatccccgagcggtcatggaactctggccacgaatgggtcacagattttaaaggtaagaccgtgtggttcgtacctagcattaaagccgggaacgacatcgcagcttgcctgaggaagaatggcaagaaggtgattcagttgagtcgcaagacttttgattccgagtacgttaaaacacgtgccaacgactgggatttcgtcgtgaccacggacatcagcgagatgggcgcaaattttaaggccgaaagagtgatagatccacggaggtgtatgaaacccgtcatcctaactgacggcgaggaacgcgtaattctggctgggcctatgccggtgacacattcttcagccgcgcagcgaagaggacggatcggtaggaacccaaagaatgagaacgaccaatatatttacatgggcgaacccctcgagaatgatgaggactgcgcacactggaaagaagccaagatgttactggataacatcaatacccctgaggggataattccctccatgttcgaaccagagcgcgaaaaagttgacgctatcgatggagagtacagacttaggggcgaggcccggaagacctttgtggacctgatgcgtcgcggtgatctccctgtctggttggcttataaggtggcagccgaagggattaactacgctgaccgaaaatggtgtttcgatggcatcagaaataaccagatactggaggaaaacatggaggttgagatctggactaaggaaggagagaggaaaaagctcaaaccccggtggctggacgcccgcatttatagtgatccacttgcactaaaggaatttaaggagttcgcggccggcagaaaaagcctgacattgaatttaatcaccgaaatggggaagctgcctacattcatgactcagaaagctaggaacgccctcgacaatctggcagtgcttcatacggctgaggccggaggtcgggcatacaaccacgccctgtcggagctcccggaaaccttggagacactgctactgctcactcttctggctaccgtcacaggcgggatatttttattcttgatgtctggaaagggcatcggtaaaatgaccctggggatgtgctgcataattactgcgtccatcctcctgtggtatgcccagatccaaccccactggattgcagctagcatcatacttgaatttttcctgattgtgctcttgatcccagagcctgaaaagcagcgaacgccccaggataatcagctgacctacgtagtgattgccatcttaacagttgtcgccgcaactatggctaacgagatgggctttctagagaagaccaaaaaggacctgggactcggctcaataacaacccaagaaagtgagtctaatatccttgacattgatctgagaccagcctccgcgtggactttgtatgctgtggccacaacgttcgtgacccctatgctgcgccatagcatcgaaaactcaagtgtcaatgttagcctcactgcaattgccaaccaggctacagtgctgatggggcttggaaaaggttggcccctctccaagatggacatcggcgtaccgctgttggcaattgggtgttactctcaggtgaatccaatcaccctgaccgccgcgttactactgctcgtcgctcactacgccataattggacctggccttcaggcaaaagccacaagggaggctcaaaagcgggccgcagctggtatcatgaagaaccccactgtggatgggatcacggttattgacctggaaccaataccctatgatcctaaatttgagaagcagttgggccaggtgatgctgctcatcctgtgcgtcacccaggtacttatgatgcgtacaacttgggccttatgtgaggcgctgaccctcgccacaggaccgattagcaccttgtgggaaggcaatcccgggagattctggaacactacgatcgcagtgtccatggctaatatttttaggggatcatacctggccggcgcaggtctactgttctctatcatgaaaaacacaaccaatactcgccgggggaccggaaacataggcgagacactcggtgaaaagtggaaaagtcgacttaacgctctgggcaagtcggagtttcaaatctataaaaagagcgggattcaggaggttgacagaactttggccaaggaaggaatcaaaaggggcgagaccgatcatcacgccgtgtcccgcgggtctgcgaagctgcggtggttcgtcgaaagaaatatggtgacaccagagggaaaagtcgtggacctcggctgcggtcgtgggggatggtcatactattgtggcggtctgaagaacgttagggaagtgaaaggcttaacgaaagggggacctggccatgaggagcccattcctatgagcacctacgggtggaatcttgtacggctgcagtccggagtggatgtctttttcactccacccgaaaagtgcgacacactcctatgtgatatcggcgagagttctcctaacccaaccatagaagctggtcgcactctgcgagttttgaatctggtggagaactggctcaataacaatacacaattctgcattaaagtccttaacccctatatgccgagcgtgatcgaaaagatggaggcactgcagagaaaatacgggggagccttggtaaggaatcctctgtcacggaactccacccacgagatgtactgggtgagtaatgctacgggcaacatcgttagctctgtgaatatgatttcccgcatgctcataaacagatttaccatgaagcacaaaaaggccacatatgaaccagacgtcgatttaggctcagggactaggaacatcggaattgagagcgaaatccccaatctggacattatcggtaagcgaatagagaaaatcaagcaggaacatgagacctcgtggcactacgaccaggatcatccttataaaacatgggcataccacggctcttatgagactaagcaaaccgggagtgcctccagcatggtgaacggagtcgtgcggcttctgacaaaaccatgggacgttgtacccatggtgacccagatggctatgactgatacgacaccgttcggccagcagcgtgtctttaaggaaaaggtggacaccagaactcaagagcctaaagaaggtaccaagaaactaatgaagattacagcggagtggctctggaaagagctggggaagaaaaagacgccccgcatgtgtaccagggaagagttcactcggaaggttagatcaaatgccgcattgggagctatctttacagatgaaaacaaatggaagtccgcccgcgaggcagtggaagacggcaggttctgggagctggtcgatcgagagcggaatctccaccttgaaggcaaatgcgagacctgtgtgtacaacatgatggggaagagagagaaaaagctgggagagtttggtaaggccaaaggctctagggctatttggtatatgtggttaggggcccgcttcctggaatttgaggcgttgggattcctcaatgaggaccattggtttagccgtggcaacagtctgtccggtgtagaaggggagggactacaccggcttggctacatcctgagagatgtgggcaagaaagaagggggagcaatgtacgccgacgatactgctggttgggacacaaggattaccctcgaggacctgaagaatgaagagatggttacaaaccatatgaaaggcgagcacaagaagttggccgaagcaatattcaaactgacttatcagaataaggtcgtgcgcgtgcagcgaccaacccctcgggggacggtcatggatatcattagcagaagggaccagcgcggatctggccaagttggtacctacgggctcaacacatttactaatatggaggctcagcttatcagacagatggaaggagagggcatcttcaaatcaattcaacatctgaccgccacagaggaaatagctgtgcagaactggttagcccgggtaggcagggagcgtctgagtcgaatggcaatctccggggatgactgcgtggtcaagcccattgatgaccgcttcgcgagcgccttgactgctctcaatgatatgggaaaagtgagaaaggacatccagcagtgggaaccatctcggggttggaacgattggacccaagttcccttttgctcgcaccacttccatgagctggtgatgaaggacggcagggtcctagtggtaccttgtcgcaaccaggatgaacttattgggagagcccggatctcacagggagcaggctggagcctgaaagagacggcttgcctcggtaagtcctatgcccagatgtggacactgatgtactttcacaggcgagacttgcgtttagcagccaatgcgatatgtagtgctgttccaccgcattgggtgcccacctctagaactacatggagcatccacgccaaacacgagtggatgaccactgaagatatgctggcagtctggaaccgcgtgtggattcaagggaatccttggatggaggacaagaccccagtggaatcctgggaggaagtcccctatctcggaaaacgggaggaccagtggtgcggctcacttatcggcctgacaagtagggccacgtgggctaagaacattcagaccgccatcaatcaggttagatctctaatagggaacgaggaatacactgattatatgcctagcatgaagcgcttccggagggaggaagaggaagcaggagtgctgtggtga

SEQ ID NO: 14523 - RNA, 9876 nt, synthetic construct
  misc_feature 1..9876: note = derived and/or modified CDS sequence (opt3) from DENV-2__FJ850120__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcagtaaccgaggccgaactgactggctatggtaccgtgacaatggagtgtagtcccaggaccgggcttgatttcaacgaaatggtcctgttgcaaatggaggacaaagcatggctcgtgcaccggcagtggtttctggatttacctctgccatggctccccggcgctgacactcagggaagcaattggatccagaaggagacacttgttacgttcaagaaccctcatgccaaaaagcaagacgtggtcgtgctgggctctcaggaaggggcgatgcacaccgccttgactggagcaacagagatacagatgtcctcaggtaatctactgtttaccggccatctcaaatgccgtctgcgcatggataagcttcaactgaaagggatgagctacagtatgtgtacaggaaagttcaagattgtaaaagaaatcgctgagactcagcacggcaccatcgttattagagtgcagtatgagggtgacgggtctccatgcaagatccccttcgaaattacggatttggagaaaaggcatgtcctcggccggctgataaccgtgaacccgatcgtcacagaaaaggactcccctgtgaacattgaggccgaacccccatttggagatagctacatcatcattggcgttgagcctgggcagttaaaactgaattggttcaagaagggatcgtctataggtcaaatgtttgagactaccatgcgaggcgctaaacgcatggccatcctaggggacacagcatgggatttcggatccctcggcggtgtgtttacttcaattgggaaggccctgcaccaggtattcggcgctatctacggagcggcatttagtggcgtcagctggaccatgaaaattcttatcggggtgataatcacgtggattggaatgaactccagatctacaagcttgtcagttagtctggtgctcgtcggcgtggtaaccctgtatcttggtgccatggtgcaggctgactccgggtgtgttgtcagctggaagaataaagaactgaagtgcggatctggcatcttcattactgataacgtgcacacatggaccgagcagtacaagtttcaacccgaatcaccaagtaaattggccagcgcaatccagaaggcccatgaggaaggtatatgtggcattaggtccgtgactcggctcgagaatctgatgtggaaacagatcacccccgagttaaaccacattctgtctgaaaatgaggtcaagctaacaatcatgacgggggacatacgcggaatcatgcaggctggcaaaagatcgctcaggcctcaaccaaccgaactgaagtatagctggaaaacttgggggaaggccaagatgctttccacagagtcacataaccagaccttcttgattgatggaccggaaacagcagagtgccccaatactaaccgtgcgtggaatagtctggaggttgaagactacggctttggtgtgttcaccacgaacatctggctcaaactgcgggagaagcaggacgtgttttgtgattctaaattaatgagcgctgccattaaggacaatcgagcagtacacgccgatatggggtattggatcgaatccgctctgaacgacacatggaaaatggagaaggcctcattcatagaggtcaagagctgccactggcctaaatctcataccctttggtccaatggagtgttggaaagtgagatgattatcccaaagaacttcgcaggccccgttagccagcacaactacagacctggttatcatactcaaaccgctggcccatggcacctcgggaaactggaaatggattttgacctatgtgagggaacaactgtggtcgtgaccgaagattgcggcaatagggggccctctctgcgcacaacgaccgcctccggaaagctcatcactgagtggtgctgtcggtcatgcacactgccgcctcttagatacaggggcgaggacggttgttggtacgggatggaaattcgcccattgaaagagaaggaagagaacctggttaatagtttagtgaccgcgggacatggccagatcgataacttcagcctcggtgtactgggcatggccctttttctggaagagatgttgcgaactcggattgggacaaagcacgctatactcctggtcgcagtgtcgttcgtgaccctaatcacgggaaatatgtcctttcgtgacctgggcagagtcatggttatggtgggggccactatgaccgatgacattggaatgggcgtaacatatctcgctctgcttgccgcattcaaagtgaggcccacctttgcggccggtttgctgttacgcaagctcacttctaaagagctgatgatggctacaatcgggattgcccttctgagccagtcaaccatccctgaaacaatactagagctcactgatgcactggctttgggaatgatggtcctgaagatcgtgcggaacatggaaaaataccaattagccgttaccattatggcaatcagttgcgtgcccaatgccgtcattctccagaacgcttggaaggtgtcctgtacgatcctggcggccgtttctgtgagcccacttctgttgacatcctcacagcagaaggcagactggatacctctcgctctgaccattaaaggcctaaatcccactgccatcttcctgaccacacttagcagaactagtaagaaaaggtcttggccactcaacgaggccatcatggctgtcggcatggtatccattctggcaagctcgttgctgaagaatgacataccgatgaccgggcctttagtggccggaggtctcctgacggtttgctatgtgcttacaggccgatcagcggatctggaattggagcgcgctgccgacgtcaaatgggaggatcaagcagaaatctctgggagttcccccattctcagcatcaccatttctgaggacggaagcatgtccatcaagaacgaagaggaggaacagactctgacaatactaatccggaccggcctgcttgtgatttcaggtgtatttccagtgagtatccccattactgccgctgcatggtacctctgggaggtcaaaaagcagagagccggggttctgtgggatgtgcctagcccaccccctgtggaaaaggcgaaattggaggacggagcttataggatcaagcagcgtggcatattaggctactctcaaattggggccggagtctataaagaaggtacattccacaccatgtggcatgtgacgcgcggcgcagttctgatgcaccgggggaagagaatcgagccgtcctgggccgatgtaaaaaaggacctcatctcatacggaggcggttggaagctggagggggaatggaaagagggagaagaggtgcaggtccttgctctggaaccaggcaagaatcccagggccgtgcagactaaacctggcatttttaagaccaacacagggaccatcggagcagttagtttggatttcagcccaggtacatccggctctcccatagtggaccgaaaagggaaggtcgtgggactatacggcaatggtgtagtcactcggtcgggggcttatgtgagcgccattgcgcagaccgagaagaacatcgaggataaccctgaaattgaggacgatatctttcgcaaaaagagactgacgataatggacctccatccgggagccggcaaaacaaagaggtacctgcccgcaattgttcgggaagctatcaaacgaggccttagaactttaatcctggccccaacccgcgtggtcgctgcagagatggaagaggccctcagggggttgcctattcgttatcaaacacccgccatcaagaccgagcacactggacgggaaattgtggacctgatgtgtcatgctaccttcacaatgagactcctgtcaccagttagggtgcctaattacaaccttataatcatggatgaggcgcacttcacggaccccgcatccattgccgctcgcggttatatcagtactcgagtcgaaatgggcgaggccgcagggatctttatgaccgccacaccaccgggatctagagatcctttcccccagagcaatgctccaattatggacgaggaacgggagatacccgaaaggtcctggaactcaggccacgagtgggtgaccgattttaagggtaaaactgtatggttcgtgccttctatcaaggcggggaatgacattgccgcatgcctgcgcaaaaacggaaagaaagttatccagttgagccgtaagacatttgatagtgaatacgtcaagaccagagctaatgactgggatttcgtggtgacgactgacatttccgagatgggcgccaactttaaagcagagcgggtcatcgatccaaggcgctgtatgaagcccgtaatactaacagacggcgaagagcgagtgatcctggccgggcctatgccggttacccatagctctgctgcccaaagacggggaaggattggtcgcaatccaaaaaacgaaaatgaccagtatatctacatgggcgagcccctcgaaaacgatgaggactgcgcgcactggaaggaggcaaaaatgttactggataatattaacacccctgaagggatcataccctcaatgttcgagccagaaagagagaaggtggacgccattgatggagaatacaggcttcggggcgaggctcgtaaaacttttgtcgacctgatgcgccgaggtgatctccctgtgtggttggcctataaggttgctgcagaggggatcaattacgccgacagaaagtggtgtttcgatggcattaaaaacaaccagatcctggaagagaatatggaagtggagatatggacaaaggagggagaaaggaaaaagctcaaaccccggtggctggacgctcgcatctattccgatccacttgccctaaaggagtttaaggaattcgcagcgggcagaaaaagtctgaccttgaacttaattacagagatggggaggctgcctactttcatgacgcagaaggcccggaatgctctcgacaacctggccgtccttcataccgcagaagctggaggtcgagcctacaatcacgcactgagcgagctcccggagacattggaaactctgctactgctcacccttctggccacagtgaccggcgggatctttttattcttgatgtcgggaaaaggcattggtaagatgactctggggatgtgctgcatcataacggcttctattctcctgtggtatgcgcaaatccagccccactggatcgccgcatccattatccttgagtttttcctgatagtactcttgattccagaacctgagaaacagagaaccccccaggataaccaactgacatacgtggttatcgctattttaactgtcgtggccgccaccatggcaaatgaaatgggctttctagagaagacaaagaaagacctgggactcggcagcatcaccactcaggagtcagaaagtaacatacttgacatcgatctgcgcccagcttctgcctggacattgtatgcggtggctacgaccttcgtcactcctatgctgaggcattccattgagaatagctcagttaacgtgagtctcacagccatcgcaaatcaggccaccgtactgatggggcttggaaagggttggcccctcagcaaaatggacattggcgtgccgctgttggctatcgggtgttactcccaggtcaacccaattaccctgacagcagccttactactgctcgtggcgcactacgctatcataggacctggccttcaagccaaggcaactcgggaagcccagaaacgtgctgccgcaggtattatgaagaatcccacggttgatgggatcaccgtgatcgacctggagccaattccctatgatcctaagtttgaaaaacagttgggccaggtcatgctgctcatactgtgcgtaacacaagtgcttatgatgagaactacctgggctttatgtgaggccctgacactcgcgaccggaccgatctctactttgtgggagggcaaccccgggaggttctggaatacgacaattgccgttagcatggcaaacatctttcgcggatcctacctggctggcgccggtctactgttctcaattatgaagaataccactaacacccggcgagggacaggatctatcggcgaaactctcggtgagaaatggaagagtagacttaacgcactgggcaaatcggaatttcagatatataagaaaagcgggatccaggaggtggacaggaccttggctaaggagggaattaagcgcggcgaaacagatcatcacgccgtctcccgggggtctgccaaactgagatggttcgtggagcgtaatatggtcacgccagaaggaaaggtggttgacctcggctgcggtagggggggatggtcatactattgtggcggtctgaaaaacgtgcgggaggtaaagggcttaaccaaagggggacctggccatgaagagcccatccctatgagcacttacgggtggaatcttgtgcgcctgcaatccggagtcgatgtttttttcacaccacccgagaagtgcgacaccctcctatgtgatattggcgaaagttctcctaacccaactatcgaggcgggtcgaacactgagagtgttgaatctggtcgaaaactggctcaataacaatacccagttctgcataaaggtgcttaacccctatatgccgagcgtaattgagaaaatggaagctctgcagaggaagtacgggggagcattggtgcggaatcctctgtcacgcaactccacgcacgagatgtactgggttagtaatgccaccggcaacatcgtgagctctgtcaatatgatctccagaatgctcattaacaggtttacaatgaaacacaagaaagctacttatgagccagacgtggatttaggctcagggacccgaaacataggaatcgaaaatgagattcccaacctggacatcattggtaagcggatcgaaaagataaaacaggagcatgaaacaagctggcactacgaccaagatcatccttataagacttgggcctaccacggctcgtatgagaccaaacagacagggtctgcaagttccatggtcaatggagtggttcgtcttctgaccaagccatgggacgtagtgcccatggtcactcagatggccatgacggatacaaccccgttcggccagcaaagagtgtttaaagagaaggttgacactcgcacccaggaacctaaggagggtacaaaaaagctaatgaaaatcacggctgaatggctctggaaggagctggggaaaaagaaaacccccaggatgtgtactcgggaggaattcacaagaaaggtgcgcagcaacgcggccttgggagcaatttttaccgatgagaataagtggaaatcagctagggaagccgtcgaggactcccgattctgggaactggtggatcgggagagaaacctccaccttgagggcaagtgcgaaacttgtgtatacaatatgatgggcaaaagggagaagaaactgggggaatttggaaaggcaaagggttctcgcgccatctggtatatgtggttaggcgctcgtttcctggagtttgaagccttggggttcctcaacgaggaccattggtttagccggggaaatagtctgtccggcgtggagggtgaagggctacacagacttggatacattctgagggatgttggcaaaaaggagggcggggcgatgtacgcagacgatacagccggatgggacacccgcatcacactcgaagacctgaaaaacgaggaaatggtcactaatcatatgaagggtgagcacaaaaagttggctgaggccattttcaagctgacctatcagaacaaagtggtgcgagtccagcggccaacgcctagaggcaccgttatggatataatcagcaggcgcgaccaaagagggtctggacaggtgggcacatacggtctcaatacttttaccaacatggaagcacagcttattcggcaaatggagggggaaggaatcttcaagtcaatccagcatctgacagctactgaggagattgccgtacagaattggttagctagggtgggccgtgaacgactgagtcgcatggccatatccggcgatgactgcgtcgtgaaacccatcgatgacagattcgcaagcgcgttgaccgccctcaacgatatggggaaggttcggaaagacattcagcaatgggagccatctaggggatggaacgattggacgcaggtgcccttttgctcgcaccacttccatgaactggtcatgaaggacggtcgcgtgctagtagttccttgtagaaatcaggatgagcttatcggccgggctaggatttcacagggggccggatggagcctgaaggaaacagcatgcctcggcaaatcctatgctcaaatgtggaccctgatgtactttcaccgacgtgacttgagattagccgcaaacgccatctgtagtgcggtgccatctcattgggtcccgactagccgcacaacctggtccatacacgctaagcacgagtggatgactaccgaggatatgctggccgtgtggaatcgggtgtggatccaggaaaacccctggatggaggacaaaacacctgtcgaatcatgggaggaagttccatatctcggtaagagggaggaccagtggtgcgggagtcttattggactgacgtctagagcaacctgggccaaaaatatccagactgctattaaccaagtgcgcagcctaatcggcaatgaggaatacacagattatatgccctccatgaagcggttcaggcgagaggaagaggaagccggcgtactgtggtga

SEQ ID NO: 14524 - RNA, 9876 nt, synthetic construct
  misc_feature 1..9876: note = derived and/or modified CDS sequence (opt3) from DENV-2__FJ850121__SS-prME
  source 1..9876: mol_type = other RNA
acagcaggcgtgatagtcatgctgattccaacagctatggctttccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccacatgtgggtatggggcttgagaccagaacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtcaaagaaattgctgagactcagcacggcaccatcgtgattagagtacagtatgagggtgacgggtctccatgcaagatacccttcgaaatcacggatttggagaaaaggcatgttctcggccggctgattaccgtgaacccgatcgtcacagaaaaggactcccctgtgaacatcgaggccgaacccccatttggagatagctacattataatcggcgtcgagcctgggcagttaaaactgaattggttcaagaagggatcgtctattggtcaaatgtttgagactaccatgcgaggcgctaaacgcatggccatcctaggggacacagcatgggatttcggatccctcggcggtgtgtttacttcaattgggaaggccctgcaccaggttttcggcgctatctacggagcggcatttagtggcgtgagctggaccatgaaaatacttatcggggtaattatcacgtggattggaatgaactccagatctaccagcttgtcagtcagtctggtgctcgttggcgtggtcaccctgtatcttggtgccatggtgcaggctgactccgggtgtgtagtgagctggaagaataaagaactgaagtgcggatctggcatcttcataactgataacgttcacacatggaccgagcagtacaagtttcaacccgaatcaccaagtaaattggccagcgcaattcagaaggcccatgaggaaggtatctgtggcattaggtccgtcactcggctcgagaatctgatgtggaaacagatcacccccgagttaaaccacatactgtctgaaaatgaggtgaagctaacaatcatgacgggggacattaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggtggaagactacggctttggtgtcttcaccacgaacatctggctcaagctgcgtgagaaacaggacgtattttgtgattctaagttaatgagcgctgccataaaagacaatcgggcagtgcacgccgatatggggtattggattgaatccgctctgaacgacacatggaagatggagaaggcctcattcatcgaggtgaaaagctgccactggcctaagtctcataccctttggtccaatggagtattggaaagtgagatgatcattcccaagaatttcgcaggccccgtcagccagcacaactaccgacctggttatcatactcaaaccgctggcccatggcacctcgggaagctggaaatggattttgacctatgtgagggaacaactgtggttgtgaccgaagattgcggcaatagagggccctctctgaggacaacgaccgcctccggaaaactcatcactgagtggtgctgtcgctcatgcacactgccgcctcttcggtacagaggcgaggacggttgttggtacgggatggaaattaggccattgaaggagaaggaagagaacctggtcaatagtttagtgaccgcgggacatggccagatagataacttcagcctcggtgttctgggcatggccctttttctggaagagatgttgcgcactcgaatcgggacaaaacacgtgaccctcctggtagctgtctcgttcgtgacgctaattactggaaatatgtcctttcgggacctgggccgtgtgatggtcatggttggggcaaccatgacagatgacatcggaatgggcgtgacctatctcgccctgcttgctgccttcaaggtaagacccacttttgcagcgggtttgctgttaaggaaactcacatctaaggagctgatgatggccaccattgggatcgcacttctgagccagtcaacaatacctgaaactatcctagagctcaccgatgccctggcattgggaatgatggtgctgaaaattgtccgcaacatggaaaagtaccaattagctgtgacgatcatggccattagttgcgttcccaatgcagtgatcctccagaacgcctggaaggtctcctgtacaatactggctgcggtgtctgttagcccacttctgttgacctcctcacagcagaaagccgactggattcctctcgcactgactatcaagggcctaaatcccaccgctatcttcctgacaactcttagccggaccagtaaaaagagatcttggccactcaacgaggccattatggccgtgggcatggtctccatactggctagctcgttgctgaaaaatgacatcccgatgacggggcctttagtagcaggaggtctcctgacagtgtgctatgttcttaccggcaggtcagccgatctggaattggagcgagcggctgacgtgaagtgggaggatcaagccgaaatttctgggagttcccccatcctcagcattactatctctgaggacggaagcatgtccatcaaaaacgaagaggaggaacagacactgaccatcctaattcgcactggcctgcttgtcatctcaggtgtgtttccagtaagtattcccatcacagcagccgcttggtacctctgggaggtgaagaagcagcgggcaggggtcctgtgggatgttcctagcccaccccctgtggaaaaagccgagttggaagacggagcgtatagaataaagcagaggggcattttaggctactctcaaatcggggctggagtgtataaagagggtaccttccacacgatgtggcatgtcactcgtggcgccgtgctgatgcaccgcgggaagcggatcgagccgtcctgggcagatgttaaaaaggacctcatttcatacggaggcggttggaagctggaaggggagtggaaagaaggagaggaagtacaggtgcttgccctggagccaggcaagaatcccagagctgtccagaccaaacctggcatctttaagacaaacaccgggacaataggagccgtgagtttggatttcagcccaggtacttccggctctcccattgttgacaggaaagggaaggtggtcggactatacggcaatggtgtggtaacccgatcgggggcatatgtcagcgctatcgcccagacggagaagtcaattgaagataaccctgagatcgaagacgatatatttcggaaaaagcgcctgacaattatggacctccatccgggagcgggcaaaactaagagatacctgcccgccatcgtgagggaggcaatcaaacggggccttcgaaccttaattctggctccaacaagagttgtggccgctgaaatggaggaggcactccgcgggttgcctatcaggtatcaaacccccgccattaagactgaacacaccggacgtgagatagtcgacctgatgtgtcatgccacattcacgatgcggctcctgtccccagtgagagttcctaactacaatcttatcattatggatgaagctcacttcactgaccccgcgagtatcgcagccaggggttatatctctacccgcgtggagatgggcgaggctgccgggatttttatgacagcaaccccaccgggaagccgagatcctttcccccagtccaacgccccaataatggacgaagagagagaaatccccgagcggtcatggaactctggccacgaatgggtcactgattttaagggtaaaacagtgtggttcgtacctagcattaaggctgggaacgacatcgcggcctgcctgaggaaaaatggaaagaaagtgattcagttgagtcgcaagacctttgattccgagtacgttaagacgcgtgcaaacgactgggatttcgtcgtgactacagacatcagcgagatgggcgctaattttaaagccgaaagagtgatagatccacggaggtgtatgaagcccgtcatcctaaccgacggcgaggaacgcgtaattctggcagggcctatgccggtgacccattcttcagccgctcaacgaagaggacggatcggtaggaaccccaaaaatgagaacgaccagtatatttacatgggcgaacccctcgagaatgatgaggactgcgcccactggaaggaagcgaaaatgttactggataacatcaatactcctgaggggataattccctccatgttcgaaccagagcgcgaaaaggttgacgcaatcgatggagagtacagacttaggggcgaggcccggaaaacatttgtggacctgatgcgtcgcggtgatctccctgtctggttggcttataaggtggccgctgaagggattaactacgcagaccgaaagtggtgtttcgatggcatcaaaaataaccagatactggaggaaaacatggaggttgagatctggaccaaggaaggagagaggaaaaagctcaaacccagatggctggacgcccggatttatagtgatccacttgctctaaaggaatttaaggagttcgccgcaggccgcaaaagcctgacattgaatttaatcactgaaatggggagactgcctacgttcatgacccagaaggcgaggaacgccctcgacaatctggctgtgcttcatacagccgaggcaggaggtcgggcttacaaccacgccctgtcggagctcccggaaactttggagaccctgctactgctcacacttctggcaaccgtcactggcgggatatttttattcttgatgtctggaaaaggcatcggtaagatgacgctggggatgtgctgcataattaccgcctccatcctcctgtggtatgctcaaatccagccccactggattgcggccagcatcatacttgaatttttcctgattgtgctcttgatcccagagcctgaaaaacagcgaacaccccaggataatcaactgacttacgtagtgattgcaatcttaaccgttgtcgctgccacaatggccaacgagatgggctttctagagaagaccaagaaagacctgggactcggctcaataactacacaggaaagtgagtctaatatccttgacattgatctgagaccagcatccgcttggacgttgtatgccgtggcgaccactttcgtgacacctatgctgcgccatagcatcgaaaactcaagtgtcaatgttagcctcaccgctattgccaaccaggcaaccgtgctgatggggcttggaaagggttggcccctctccaaaatggacatcggcgtaccgctgttggccattgggtgttactctcaggtgaatccaatcacactgactgctgcattactactgctcgtcgcccactacgcgataattggacctggccttcaagctaaggccacgagggaggcacagaaacgggccgctgccggtatcatgaagaaccccaccgtggatgggatcacagttattgacctggaaccaataccctatgatcctaagtttgagaaacagttgggccaggtgatgctgctcatcctgtgcgtcactcaagtacttatgatgcgtaccacatgggcattatgtgaggctctgaccctcgccactggaccgattagcacgttgtgggaaggcaatcccgggagattctggaacacaaccatcgcggtgtccatggccaatatttttaggggatcatacctggcaggcgctggtctactgttctctatcatgaagaacactaccaatacacgccgggggactggaaacataggcgagaccctcggtgaaaaatggaagagtcgacttaacgccctgggcaaatcggagtttcagatctataagaaaagcgggattcaggaggttgacagaacattggcaaaggaaggaatcaagaggggcgagacggatcatcacgctgtgtcccgcgggtctgccaaactgcggtggttcgtcgaaagaaatatggtgaccccagagggaaaggtcgtggacctcggctgcggtcgtgggggatggtcatactattgtggcggtctgaaaaacgttagggaagtgaagggcttaactaaagggggacctggccatgaggagcccattcctatgagcacatacgggtggaatcttgtacggctgcaatccggagtggatgtctttttcaccccacccgaaaagtgcgacactctcctatgtgatatcggcgagagttctcctaacccaacaatagaagccggtcgcaccctgcgagttttgaatctggtggagaactggctcaataacaatacgcagttctgcattaaggtccttaacccctatatgccgagcgtgatcgagaaaatggaggcgctgcagagaaagtacgggggagctttggtaaggaatcctctgtcacggaactccacccacgagatgtactgggtgagtaatgcaacaggcaacatcgttagctctgtgaatatgatttcccgcatgctcataaacagatttactatgaaacacaagaaagccacctatgaaccagacgtcgatttaggctcagggacaaggaacatcggaattgagagcgaaatccccaatctggacattatcggtaagcgaatagagaagatcaaacaggaacatgagacttcgtggcactacgaccaagatcatccttataagacctgggcttaccacggctcttatgagacaaaacagaccgggagtgcctccagcatggtgaacggagtcgtgcggcttctgactaagccatgggacgttgtacccatggtgacgcagatggcaatgacagataccactccgttcggccagcaacgtgtctttaaagaaaaggtggacaccagaacacaggagcctaaggaaggtacgaaaaagctaatgaaaattaccgccgagtggctctggaaggagctggggaaaaagaaaactccccgcatgtgtacaagggaagagttcacccggaaggttagatcaaatgctgcgttgggagccatctttactgatgaaaacaagtggaaatccgcacgcgaggctgtggaagacggcaggttctgggagctggtcgatcgagagcggaatctccaccttgaaggcaagtgcgagacatgtgtgtacaacatgatggggaaaagagaaaagaaactgggagagtttggtaaggccaagggctctagggcaatttggtatatgtggttaggggcccgcttcctggaatttgaggctttgggattcctcaatgaggaccattggtttagccgtggcaacagtctgtccggtgtagaaggggagggactacaccggcttggctacatcctgagagatgtgggcaaaaaggaagggggagccatgtacgcggacgataccgcaggttgggacacaaggattactctcgaggacctgaaaaatgaagagatggttaccaaccatatgaagggcgagcacaaaaagttggccgaagctatattcaagctgacgtatcagaataaagtcgtgcgcgtgcagcgaccaacccctcgggggacagtcatggatatcattagcagaagggaccaacgcggatctggccaggttggtacttacgggctcaacacctttacaaatatggaggcccagcttatcagacaaatggaaggagagggcatcttcaagtcaattcagcatctgactgcaaccgaggaaatagctgtgcagaactggttagcccgggtaggcagggagcgtctgagtcgaatggctatctccggggatgactgcgtggtcaaacccattgatgaccgcttcgccagcgcattgacggcgctcaatgatatgggaaaggtgagaaaagacatccagcaatgggaaccatctcggggttggaacgattggacacaggttcccttttgctcgcaccacttccatgagctggtgatgaaggacggcagggtcctagtggtaccttgtcgcaaccaggatgaacttattgggagagcccggatctcacagggagctggctggagcctgaaggagaccgcctgcctcggtaaatcctatgcacaaatgtggactctgatgtactttcacaggcgagacttgcgtttagctgccaatgcaatatgtagtgccgttccaccgcattgggtgcccacatctagaaccacttggagcatccacgcgaagcacgagtggatgaccacagaagatatgctggctgtctggaaccgcgtgtggattcaggagaatccttggatggaagacaaaacgccagtggagtcctgggaagaggtcccctatctcgggaagcgggaggaccagtggtgcggatcacttatcggcctgaccagtagggccacttgggccaaaaacattcagacagccatcaatcaagttagatctctaataggcaacgaagagtacaccgattatatgcctagcatgaagcgcttccggagggaagaggaagaggctggggtgctgtggtga

SEQ ID NO: 14525 - RNA, 9876 nt, synthetic construct
  misc_feature 1..9876: note = derived and/or modified CDS sequence (opt3) from DENV-2__GQ199897__SS-prME
  source 1..9876: mol_type = other RNA
accgccggcgtgatagtaatgctgattcccacggctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggttgacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggtcgaagactacggctttggtgttttcaccacgaacatttggctcaagctgcgtgagaaacaggacgtgttttgtgattctaagttaatgagcgctgccatcaaagacaatcgggcagtgcacgccgatatggggtattggatagaatccgctctgaacgacacatggaagatggagaaggcctcattcattgaggtaaaaagctgccactggcctaagtctcataccctttggtccaatggagtcttggaaagtgagatgatcatccccaagaatttcgcaggccccgtgagccagcacaactaccgacctggttatcatactcaaaccgctggcccatggcacctcgggaagctggaaatggattttgacctatgtgagggaacaactgttgtggtcaccgaagattgcggcaatagagggccctctctgaggacaacgaccgcctccggaaaactcattactgagtggtgctgtcgctcatgcacactgccgcctcttcggtacagaggcgaggacggttgttggtacgggatggaaatcaggccattgaaggagaaggaagagaacctggtgaatagtttagttaccgcgggacatggccagattgataacttcagcctcggtgtgctgggcatggccctttttctggaagagatgttgcgcactcgaatagggacaaaacacgctatcctcctggtagcagtctcgttcgtgaccctaattacgggaaatatgtcctttcgggacctgggccgtgtgatggtcatggttggggccactatgaccgatgacatcggaatgggcgtgacatatctcgctctgcttgccgcattcaaggtaagacccacctttgcggccggtttgctgttaaggaaactcacttctaaggagctgatgatggctacaattgggatcgcccttctgagccagtcaaccatacctgaaacaatcctagagctcactgatgcactggctttgggaatgatggtgctgaaaattgtccgcaacatggaaaagtaccaattagccgtgaccatcatggcaattagttgcgttcccaatgccgtgatcctccagaacgcttggaaggtctcctgtacgatactggcggccgtgtctgttagcccacttctgttgacatcctcacagcagaaagcagactggattcctctcgctctgaccatcaagggcctaaatcccactgccatcttcctgaccacacttagccggacaagtaaaaagagatcttggccactcaacgaggccattatggctgtgggcatggtctccatactggcaagctcgttgctgaaaaatgacatcccgatgaccgggcctttagtagccggaggtctcctgacggtgtgctatgttcttacaggcaggtcagcggatctggaattggagcgagctgccgacgtgaagtgggaggatcaagcagaaatttctgggagttcccccatcctcagcattaccatctctgaggacggaagcatgtccatcaaaaacgaagaggaggaacagactctgacaatcctaattcgcaccggcctgcttgtcgtgtcaggtgtatttccagtgagtatccccattactgccgctgcatggtacctctgggaggtcaagaagcagcgggccggggttctgtgggatgtgcctagcccaccccctgtggaaaaagcggagttggaagacggagcttatagaatcaagcagaggggcatattaggctactctcaaattggggccggagtctataaagagggtacattccacaccatgtggcatgtgacgcgtggcgcagttctgatgcaccgcgggaagcggatcgagccgtcctgggccgatgtcaaaaaggacctcatctcatacggaggcggttggaagctggaaggggagtggaaagaaggagaggaagtgcaggtccttgctctggagccaggcaagaatcccagagccgtgcagactaaacctggcatttttaagaccaacacagggaccatcggagcagttagtttggatttcagcccaggtacatccggctctcccatagtggacaggaaagggaaggtcgtgggactatacggcaatggtgtagtcactcgatcgggggcttatgtgagcgccattgcgcagaccgagaagtcaatcgaagataaccctgagattgaagacgatatctttcggaaaaagcgcctgacgataatggacctccatccgggagccggcaaaacaaagagatacctgcccgcaattgttagggaggctatcaaacggggccttcgaactttaatcctggccccaaccagagtggtcgctgcagaaatggaggaggccctccgcgggttgcctattaggtatcaaacacccgccatcaagaccgaacacactggacgtgagattgtggacctgatgtgtcatgctaccttcacaatgcggctcctgtccccagttagagtgcctaactacaatcttataatcatggatgaagcgcacttcacggaccccgcaagtattgccgctaggggttatatctctactcgcgtcgagatgggcgaggccgcagggatctttatgaccgccacaccaccgggaagccgagatcctttcccccagtccaacgctccaattatggacgaagagagagaaatacccgagcggtcatggaactctggccacgaatgggtgaccgattttaagggtaaaactgtatggttcgtgcctagcatcaaggcggggaacgacattgccgcatgcctgaggaaaaatggaaagaaagttatccagttgagtcgcaagacatttgattccgagtacgtcaagacccgtgctaacgactgggatttcgtggtgacgactgacattagcgagatgggcgccaattttaaagcagaaagagtcatcgatccacggaggtgtatgaagcccgtaatactaacagacggcgaggaacgcgtgatcctggccgggcctatgccggttacccattcttcagctgcccaacgaagaggacggattggtaggaaccccaaaaatgagaacgaccagtatatctacatgggcgaacccctcgagaatgatgaggactgcgcgcactggaaggaagcaaaaatgttactggataacattaatacccctgaggggatcataccctccatgttcgaaccagagcgcgaaaaggtggacgccattgatggagagtacagacttaggggcgaggctcggaaaacttttgtcgacctgatgcgtcgcggtgatctccctgtgtggttggcctataaggttgctgcagaagggatcaactacgccgaccgaaagtggtgtttcgatggcattaaaaataaccagatcctggaggaaaacatggaggtggagatatggacaaaggaaggagagaggaaaaagctcaaacccagatggctggacgctcggatctatagtgatccacttgccctaaaggaatttaaggagttcgcagcgggccgcaaaagcctgaccttgaatttaattacagaaatggggagactgcctactttcatgacgcagaaggccaggaacgctctcgacaatctggccgtccttcataccgcagaggctggaggtcgggcctacaaccacgcactgtcggagctcccggaaacattggagactctgctactgctcacccttctggccacagtgaccggcgggatctttttattcttgatgtctggaaaaggcattggtaagatgactctggggatgtgctgcatcataacggcttccattctcctgtggtatgcgcaaatccagccccactggatcgccgcaagcattatccttgaatttttcctgatagtactcttgattccagagcctgaaaaacagcgaaccccacaggataatcaactgacatacgtggttatcgctattttaactgtcgtggccgccaccatggcaaacgagatgggctttctagagaagacaaagaaagacctgggactcggctcaatcaccactcaggaaagtgagtctaatatacttgacatcgatctgagaccagcttccgcctggacattgtatgcggtggctacgaccttcgtcactcctatgctgcgccatagcattgaaaactcaagtgttaatgtgagcctcacagccatcgcaaaccaggccaccgtactgatggggcttggaaagggttggcccctctccaaaatggacattggcgtgccgctgttggctatcgggtgttactctcaggtcaatccaattaccctgacagcagccttactactgctcgtggcgcactacgctatcataggacctggccttcaagccaaggcaactagggaggcccagaaacgggctgccgcaggtattatgaagaaccccacggttgatgggatcaccgtgatcgacctggaaccaattccctatgatcctaagtttgagaaacagttgggccaggtcatgctgctcatactgtgcgtaacacaagtgcttatgatgcgtactacctgggctttatgtgaggccctgacactcgcgaccggaccgatcagcactttgtgggaaggcaatcccgggagattctggaacacgacaattgccgtttccatggcaaatatctttaggggatcatacctggctggcgccggtctactgttctctattatgaagaacaccactaatacccgccgggggacaggaaacatcggcgagactctcggtgaaaaatggaagagtcgacttaacgcactgggcaaatcggagtttcagatatataagaaaagcgggatccaggaggtggacagaaccttggctaaggaaggaattaagaggggcgagacagatcatcacgccgtctcccgcgggtctgccaaactgcggtggttcgtggaaagaaatatggtcacgccagagggaaaggtggttgacctcggctgcggtcgtgggggatggtcatactattgtggcggtctgaaaaacgtgagggaagtaaagggcttaaccaaagggggacctggccatgaggagcccatccctatgagcacttacgggtggaatcttgtgcggctgcaatccggagtcgatgtatttttcacaccacccgaaaagtgcgacaccctcctatgtgatattggcgagagttctcctaacccaactatcgaagcgggtcgcacactgcgagtgttgaatctggtcgagaactggctcaataacaatacccagttctgcataaaggtgcttaacccctatatgccgagcgtaattgagaaaatggaggctctgcagagaaagtacgggggagcattggtgaggaatcctctgtcacggaactccacgcacgagatgtactgggttagtaatgccaccggcaacatcgtgagctctgtcaatatgatctcccgcatgctcattaacagatttacaatgaaacacaagaaagctacttatgaaccagacgtggatttaggctcagggaccaggaacataggaatcgagagcgaaattcccaatctggacatcattggtaagcgaatcgagaagataaaacaggaacatgagacatcgtggcactacgaccaagatcatccttataagacttgggcctaccacggctcttatgagaccaaacagacagggagtgcatccagcatggtcaacggagtggttcggcttctgaccaagccatgggacgtagtgcccatggtcactcagatggccatgacggatacaaccccgttcggccagcaacgtgtgtttaaagaaaaggttgacactagaacccaggagcctaaggaaggtacgaaaaagctaatgaaaatcacagctgagtggctctggaaggagctggggaaaaagaaaaccccacgcatgtgtactagggaagagttcacacggaaggtgagatcaaatgcggccttgggagcaatttttaccgatgaaaacaagtggaaatccgctcgcgaggccgtcgaagacggcaggttctgggagctggtggatcgagagcggaatctccaccttgaaggcaagtgcgagacttgtgtatacaacatgatggggaaaagagaaaagaaactgggagagtttggtaaggcaaagggctctagggccatctggtatatgtggttaggggctcgcttcctggaatttgaggccttgggattcctcaatgaggaccattggtttagccgtggcaacagtctgtccggtgtggaaggggagggactacaccggcttggctacattctgagagatgttggcaaaaaggaagggggagcgatgtacgcagacgatacagccggttgggacaccaggatcacactcgaggacctgaaaaatgaagagatggtcactaaccatatgaagggcgagcacaaaaagttggctgaagccattttcaagctgacctatcagaataaagtggtgcgcgtccagcgaccaacgcctcgggggaccgttatggatataatcagcagaagggaccaacgcggatctggccaggtgggtacatacgggctcaacacttttaccaatatggaggcacagcttattagacaaatggaaggagagggcatcttcaagtcaatccagcatctgacagctactgaggaaattgccgtacagaactggttagctcgggtgggcagggagcgtctgagtcgaatggccatatccggggatgactgcgtcgtgaaacccatcgatgaccgcttcgcaagcgcgttgaccgccctcaatgatatgggaaaggttagaaaagacattcagcaatgggaaccatctcggggttggaacgattggacacaggtgcccttttgctcgcaccacttccatgagctggtcatgaaggacggcagggtgctagtagttccttgtcgcaaccaggatgaacttatcgggagagctcggatttcacagggagccggctggagcctgaaggagacagcatgcctcggtaaatcctatgctcaaatgtggaccctgatgtactttcacaggcgagacttgcgtttagccgcaaatgccatctgtagtgcggtgccaccgcattgggtccccacttctagaacaacctggagcatacacgctaagcacgagtggatgactaccgaagatatgctggccgtgtggaaccgcgtgtggatccaggagaatccttggatggaagacaaaacaccagtcgagtcctgggaagaggttccctatctcgggaagcgggaggaccagtggtgcggatcacttattggcctgacgagtagggcaacctgggccaaaaacatccagactgctattaatcaagtgagatctctaatcggcaacgaagagtacacagattatatgcctagcatgaagcgcttccggagggaagaggaagaggccggggtactgtggtga

SEQ ID NO: 14526 - RNA, 9876 nt, synthetic construct
  misc_feature 1..9876: note = derived and/or modified CDS sequence (opt3) from DENV-2__GQ199895__SS-prME
  source 1..9876: mol_type = other RNA
accgccggcgtgatagtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggtcgaagactacggctttggtgttttcaccacgaacatttggctcaagctgcgtgagaaacaggacgtgttttgtgattctaagttaatgagcgctgccatcaaagacaatcgggcagtgcacgccgatatggggtattggatagaatccgctctgaacgacacatggaagatggagaaggcctcattcattgaggtaaaaagctgccactggcctaagtctcataccctttggtccaatggagtcttggaaagtgagatgatcatccccaagaatttcgcaggccccgtgagccagcacaactaccgacctggttatcatactcaaaccgctggcccatggcacctcgggaagctggaaatggattttgacctatgtgagggaacaactgttgtggtcaccgaagattgcggcaatagagggccctctctgaggacaacgaccgcctccggaaaactcattactgagtggtgctgtcgctcatgcacactgccgcctcttcggtacagaggcgaggacggttgttggtacgggatggaaatcaggccattgaaggagaaggaagagaacctggtgaatagtttagttaccgcgggacatggccagattgataacttcagcctcggtgtgctgggcatggccctttttctggaagagatgttgcgcactcgaatagggacaaaacacgctatcctcctggtagcagtctcgttcgtgaccctaattacgggaaatatgtcctttcgggacctgggccgtgtgatggtcatggttggggccactatgaccgatgacatcggaatgggcgtgacatatctcgctctgcttgccgcattcaaggtaagacccacctttgcggccggtttgctgttaaggaaactcacttctaaggagctgatgatggctacaattgggatcgcccttctgagccagtcaaccatacctgaaacaatcctagagctcactgatgcactggctttgggaatgatggtgctgaaaattgtccgcaacatggaaaagtaccaattagccgtgaccatcatggcaattagttgcgttcccaatgccgtgatcctccagaacgcttggaaggtctcctgtacgatactggcggccgtgtctgttagcccacttctgttgacatcctcacagcagaaagcagactggattcctctcgctctgaccatcaagggcctaaatcccactgccatcttcctgaccacacttagccggacaagtaaaaagagatcttggccactcaacgaggccattatggctgtgggcatggtctccatactggcaagctcgttgctgaaaaatgacatcccgatgaccgggcctttagtagccggaggtctcctgacggtgtgctatgttcttacaggcaggtcagcggatctggaattggagcgagctgccgacgtgaagtgggaggatcaagcagaaatttctgggagttcccccatcctcagcattaccatctctgaggacggaagcatgtccatcaaaaacgaagaggaggaacagactctgacaatcctaattcgcaccggcctgcttgtcatctcaggtgtgtttccagtaagtattcccatcactgccgctgcatggtacctctgggaggtgaagaagcagcgggccggggtcctgtgggatgttcctagcccaccccctgtggaaaaagcggagttggaagacggagcttatagaataaagcagaggggcattttaggctactctcaaatcggggccggagtgtataaagagggtacattccacaccatgtggcatgtcacgcgtggcgcagtgctgatgcaccgcgggaagcggatcgagccgtcctgggccgatgttaaaaaggacctcatttcatacggaggcggttggaagctggaaggggagtggaaagaaggagaggaagtacaggtgcttgctctggagccaggcaagaatcccagagccgtccagactaaacctggcatctttaagaccaacacagggaccataggagcagtgagtttggatttcagcccaggtacatccggctctcccattgttgacaggaaagggaaggtggtcggactatacggcaatggtgtggtaactcgatcgggggcttatgtcagcgccatcgcgcagaccgagaagtcaattgaagataaccctgagatcgaagaggacatatttcggaaaaagcgcctgacgattatggatctccatccgggagccggcaaaacaaagagatacctgcccgcaatcgtgagggaagctatcaaacggggccttcgaactttaattctggccccaaccagagttgtggctgcagagatggaggaagccctccgcgggttgcctatcaggtatcaaacacccgccattaagaccgagcacactggacgtgaaatagtcgacctgatgtgtcatgctaccttcacaatgcggctcctgtccccagtgagagttcctaactacaatcttatcattatggacgaggcgcacttcacggatcccgcaagtatcgccgctaggggttatatctctactcgcgtggagatgggcgaagccgcagggatttttatgaccgccacaccaccgggaagccgagaccctttcccccagtccaacgctccaataatggatgaggaaagagagatccccgaacggtcatggaactctggccacgagtgggtcaccgactttaagggtaaaactgtgtggttcgtacctagcattaaggcggggaacgatatcgccgcatgcctgaggaaaaatggaaagaaagtgattcagttgagtcgcaagacatttgactccgagtacgttaagacccgtgctaacgattgggacttcgtcgtgacgactgatatcagcgaaatgggcgccaattttaaagcagagagagtgatagacccacggaggtgtatgaagcccgtcatcctaacagatggcgaagaacgcgtaattctggccgggcctatgccggtgacccattcttcagctgcccaacgaagaggacggatcggtaggaaccccaaaaatgaaaacgaccagtatatttacatgggcgagcccctcgagaatgacgaagattgcgcgcactggaaggaggcaaaaatgttactggacaacatcaatacccctgaagggataattccctccatgttcgagccagaacgcgagaaggttgatgccatcgacggagagtacagacttaggggcgaagctcggaaaacttttgtggatctgatgcgtcgcggtgacctccctgtctggttggcctataaggtggctgcagaggggattaactacgccgatcgaaagtggtgtttcgacggcatcaaaaataaccagatactggaagagaacatggaggttgaaatctggacaaaggagggagaaaggaaaaagctcaaacccagatggctggatgctcggatttatagtgacccacttgccctaaaggagtttaaggagttcgcagcgggccgcaaaagcctgaccttgaatttaatcacagagatggggagactgcctactttcatgacgcagaaggccaggaacgctctcgataatctggccgtgcttcataccgcagaggctggaggtcgggcctacaaccacgcactgtcggaactcccggagacattggaaactctgctactgctcacccttctggccacagtcaccggcgggatatttttattcttgatgtctggaaaaggcatcggtaagatgactctggggatgtgctgcataattacggcttccatcctcctgtggtatgcgcaaatccagccccactggattgccgcaagcatcatacttgagtttttcctgattgtgctcttgatcccagaacctgagaaacagcgaaccccacaggacaatcaactgacatacgtagtgattgctatcttaactgttgtcgccgccaccatggcaaacgagatgggctttctagaaaagacaaagaaagatctgggactcggctcaataaccactcaggagagtgaatctaatatccttgacattgacctgagaccagcttccgcctggacattgtatgcggtggctacgaccttcgtgactcctatgctgcgccatagcatcgagaactcaagtgtcaatgttagcctcacagccattgcaaaccaggccaccgtgctgatggggcttggaaagggttggcccctctccaaaatggatatcggcgtaccgctgttggctattgggtgttactctcaggtgaatccaatcaccctgacagcagccttactactgctcgtcgcgcactacgctataattggacctggccttcaagccaaggcaactagggaagcccagaaacgggctgccgcaggtatcatgaagaaccccacggtggacgggatcaccgttattgatctggagccaataccctatgaccctaagtttgagaaacagttgggccaggtgatgctgctcatcctgtgcgtcacacaagtacttatgatgcgtactacctgggctttatgtgaagccctgacactcgcgaccggaccgattagcactttgtgggagggcaatcccgggagattctggaacacgacaatcgccgtgtccatggcaaatatttttaggggatcatacctggctggcgccggtctactgttctctatcatgaagaacaccactaatacccgccgggggacaggaaacataggcgaaactctcggtgagaaatggaagagtcgacttaacgcactgggcaaatcggagtttcagatctataagaaaagcgggattcaggaagttgatagaaccttggctaaggagggaatcaagaggggcgaaacagaccatcacgccgtgtcccgcgggtctgccaaactgcggtggttcgtcgagagaaatatggtgacgccagaaggaaaggtcgtggatctcggctgcggtcgtgggggatggtcatactattgtggcggtctgaaaaacgttagggaggtgaagggcttaaccaaagggggacctggccatgaggaacccattcctatgagcacttacgggtggaatcttgtacggctgcaatccggagtggacgtctttttcacaccacccgagaagtgcgataccctcctatgtgacatcggcgaaagttctcctaacccaactatagaggcgggtcgcacactgcgagttttgaatctggtggaaaactggctcaataacaatacccagttctgcattaaggtccttaacccctatatgccgagcgtgatcgagaaaatggaggctctgcagagaaagtacgggggagcattggtaaggaatcctctgtcacggaactccacgcacgaaatgtactgggtgagtaatgccaccggcaacatcgttagctctgtgaatatgatttcccgcatgctcataaacagatttacaatgaaacacaagaaagctacttatgagccagatgtcgacttaggctcagggaccaggaacatcggaattgaaagcgagatccccaatctggatattatcggtaagcgaatagaaaagatcaaacaggagcatgagacatcgtggcactacgaccaagaccatccttataagacttgggcctaccacggctcttatgaaaccaaacagacagggagtgcatccagcatggtgaacggagtcgtgcggcttctgaccaagccatgggatgttgtacccatggtgactcagatggccatgacggacacaaccccgttcggccagcaacgtgtctttaaagagaaggtggatactagaacccaggaacctaaggagggtacgaaaaagctaatgaaaattacagctgagtggctctggaaggaactggggaaaaagaaaaccccacgcatgtgtactagggaggagttcacacggaaggttagatcaaatgcggccttgggagcaatctttaccgacgagaacaagtggaaatccgctcgcgaagccgtggaggatggcaggttctgggagctggtcgaccgagaacggaatctccaccttgagggcaagtgcgaaacttgtgtgtacaacatgatggggaaaagagagaagaaactgggagaatttggtaaggcaaagggctctagggccatttggtatatgtggttaggggctcgcttcctggagtttgaggccttgggattcctcaatgaagatcattggtttagccgtggcaacagtctgtccggtgtagagggggaaggactacaccggcttggctacatcctgagagacgtgggcaaaaaggaagggggagcgatgtacgcagatgacacagccggttgggataccaggattacactcgaagacctgaaaaatgaggagatggttactaaccatatgaagggcgaacacaaaaagttggctgaggccatattcaagctgacctatcagaataaagtcgtgcgcgtgcagcgaccaacgcctcgggggaccgtcatggacatcattagcagaagggatcaacgcggatctggccaggttggtacatacgggctcaacacttttaccaatatggaagcacagcttatcagacaaatggagggagagggcatcttcaagtcaattcagcatctgacagctactgaagagatagccgtgcagaactggttagctcgggtaggcagggaacgtctgagtcgaatggccatctccggggacgattgcgtggtcaaacccattgacgatcgcttcgcaagcgcgttgaccgccctcaatgacatgggaaaggtgagaaaagatatccagcaatgggagccatctcggggttggaacgactggacgcaggttcccttttgctcgcaccacttccatgaactggtgatgaaggatggcagggtcctagtggtaccttgtcgcaaccaggacgagcttattgggagagctcggatctcacagggagccggctggagcctgaaggagacagcatgcctcggtaaatcctatgctcaaatgtggaccctgatgtactttcacaggcgagatttgcgtttagccgcaaatgccatatgtagtgcggttccaccgcattgggtgcccacttctagaacaacctggagcatccacgctaagcacgaatggatgactaccgaggacatgctggccgtctggaaccgcgtgtggattcaggaaaatccttggatggaggataaaacaccagtggaatcctgggaggaggtcccctatctcgggaagcgggaagaccagtggtgcggatcacttatcggcctgacgagtagggcaacctgggccaaaaacattcagactgctatcaatcaagttagatctctaataggcaacgaggaatacacagactatatgcctagcatgaagcgcttccggagggaggaagaggaggccggggtgctgtggtga

SEQ ID NO: 14527 - RNA, 9876 nt, synthetic construct
  misc_feature 1..9876: note = derived and/or modified CDS sequence (opt3) from DENV-2__FJ898478__SS-prME
  source 1..9876: mol_type = other RNA
accgccggcgtgatagtcatgctgattcccactgctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggtcgaagactacggctttggtgttttcaccacgaacatttggctcaagctgcgtgagaaacaggacgtgttttgtgattctaagttaatgagcgctgccatcaaagacaatcgggcagtgcacgccgatatggggtattggatagaatccgctctgaacgacacatggaagatggagaaggcctcattcattgaggtaaaaagctgccactggcctaagtctcataccctttggtccaatggagtcttggaaagtgagatgatcatccccaagaatttcgcaggccccgtgagccagcacaactaccgacctggttatcatactcaaaccgctggcccatggcacctcgggaagctggaaatggattttgacctatgtgagggaacaactgttgtggtcaccgaagattgcggcaatagagggccctctctgaggacaacgaccgcctccggaaaactcattactgagtggtgctgtcgctcatgcacactgccgcctcttcggtacagaggcgaggacggttgttggtacgggatggaaatcaggccattgaaggagaaggaagagaacctggtgaatagtttagttaccgcgggacatggccagattgataacttcagcctcggtgtgctgggcatggccctttttctggaagagatgttgcgcactcgaatagggacaaaacacgctatcctcctggtagcagtctcgttcgtgaccctaattacgggaaatatgtcctttcgggacctgggccgtgtgatggtcatggttggggccactatgaccgatgacatcggaatgggcgtgacatatctcgctctgcttgccgcattcaaggtaagacccacctttgcggccggtttgctgttaaggaaactcacttctaaggagctgatgatggctacaattgggatcgcccttctgagccagtcaaccatacctgaaacaatcctagagctcactgatgcactggctttgggaatgatggtgctgaaaattgtccgcaacatggaaaagtaccaattagccgtgaccatcatggcaattagttgcgttcccaatgccgtgatcctccagaacgcttggaaggtctcctgtacgatactggcggccgtgtctgttagcccacttctgttgacatcctcacagcagaaagcagactggattcctctcgctctgaccatcaagggcctaaatcccactgccatcttcctgaccacacttagccggacaagtaaaaagagatcttggccactcaacgaggccattatggctgtgggcatggtctccatactggcaagctcgttgctgaaaaatgacatcccgatgaccgggcctttagtagccggaggtctcctgacggtgtgctatgttcttacaggcaggtcagcggatctggaattggagcgagctgccgacgtgaagtgggaggatcaagcagaaatttctgggagttcccccatcctcagcattaccatctctgaggacggaagcatgtccatcaaaaacgaagaggaggaacagactctgacaatcctaattcgcaccggcctgcttgtcatctcaggtgtgtttccagtaagtattcccatcactgccgctgcatggtacctctgggaggtgaagaagcagcgggccggggtcctgtgggatgttcctagcccaccccctgtggaaaaagcggagttggaagacggagcttatagaataaagcagaggggcattttaggctactctcaaatcggggccggagtgtataaagagggtacattccacaccatgtggcatgtcacgcgtggcgcagtgctgatgcaccgcgggaagcggatcgagccgtcctgggccgatgttaaaaaggacctcatttcatacggaggcggttggaagctggaaggggagtggaaagaaggagaggaagtacaggtgcttgctctggagccaggcaagaatcccagagccgtccagactaaacctggcatctttaagaccaacacagggaccataggagcagtgagtttggatttcagcccaggtacatccggctctcccattgttgacaggaaagggaaggtggtcggactatacggcaatggtgtggtaactcgatcgggggcttatgtcagcgccatcgcgcagaccgagaagtcaattgaagataaccctgagatcgaagacgatatatttcggaaaaagcgcctgacgattatggacctccatccgggagccggcaaaacaaagagatacctgcccgcaatcgtgagggaggctatcaaacggggccttcgaactttaattctggccccaaccagagttgtggctgcagaaatggaggaggccctccgcgggttgcctatcaggtatcaaacacccgccattaagaccgaacacactggacgtgagatagtcgacctgatgtgtcatgctaccttcacaatgcggctcctgtccccagtgagagttcctaactacaatcttatcattatggatgaagcgcacttcacggaccccgcaagtatcgccgctaggggttatatctctactcgcgtggagatgggcgaggccgcagggatttttatgaccgccacaccaccgggaagccgagatcctttcccccagtccaacgctccaataatggacgaagagagagaaatccccgagcggtcatggaactctggccacgaatgggtcaccgattttaagggtaaaactgtgtggttcgtacctagcattaaggcggggaacgacatcgccgcatgcctgaggaaaaatggaaagaaagtgattcagttgagtcgcaagacatttgattccgagtacgttaagacccgtgctaacgactgggatttcgtcgtgacgactgacatcagcgagatgggcgccaattttaaagcagaaagagtgatagatccacggaggtgtatgaagcccgtcatcctaacagacggcgaggaacgcgtaattctggccgggcctatgccggtgacccattcttcagctgcccaacgaagaggacggatcggtaggaaccccaaaaatgagaacgaccagtatatttacatgggcgaacccctcgagaatgatgaggactgcgcgcactggaaggaagcaaaaatgttactggataacatcaatacccctgaggggataattccctccatgttcgaaccagagcgcgaaaaggttgacgccatcgatggagagtacagacttaggggcgaggctcggaaaacttttgtggacctgatgcgtcgcggtgatctccctgtctggttggcctataaggtggctgcagaagggattaactacgccgaccgaaagtggtgtttcgatggcatcaaaaataaccagatactggaggaaaacatggaggttgagatctggacaaaggaaggagagaggaaaaagctcaaacccagatggctggacgctcggatttatagtgatccacttgccctaaaggaatttaaggagttcgcagcgggccgcaaaagcctgaccttgaatttaatcacagaaatggggagactgcctactttcatgacgcagaaggccaggaacgctctcgacaatctggccgtgcttcataccgcagaggctggaggtcgggcctacaaccacgcactgtcggagctcccggaaacattggagactctgctactgctcacccttctggccacagtcaccggcgggatatttttattcttgatgtctggaaaaggcatcggtaagatgactctggggatgtgctgcataattacggcttccatcctcctgtggtatgcgcaaatccagccccactggattgccgcaagcatcatacttgaatttttcctgattgtgctcttgatcccagagcctgaaaaacagcgaaccccacaggataatcaactgacatacgtagtgattgctatcttaactgttgtcgccgccaccatggcaaacgagatgggctttctagagaagacaaagaaagacctgggactcggctcaataaccactcaggaaagtgagtctaatatccttgacattgatctgagaccagcttccgcctggacattgtatgcggtggctacgaccttcgtgactcctatgctgcgccatagcatcgaaaactcaagtgtcaatgttagcctcacagccattgcaaaccaggccaccgtgctgatggggcttggaaagggttggcccctctccaaaatggacatcggcgtaccgctgttggctattgggtgttactctcaggtgaatccaatcaccctgacagcagccttactactgctcgtcgcgcactacgctataattggacctggccttcaagccaaggcaactagggaggcccagaaacgggctgccgcaggtatcatgaagaaccccacggtggatgggatcaccgttattgacctggaaccaataccctatgatcctaagtttgagaaacagttgggccaggtgatgctgctcatcctgtgcgtcacacaagtacttatgatgcgtactacctgggctttatgtgaggccctgacactcgcgaccggaccgattagcactttgtgggaaggcaatcccgggagattctggaacacgacaatcgccgtgtccatggcaaatatttttaggggatcatacctggctggcgccggtctactgttctctatcatgaagaacaccacaagtacccgccgggggacaggaaatataggcgagactctcggtgaaaaatggaagtcgcgacttaacgcactgggcaaaagcgagtttcagatctataagaaatccgggattcaggaggttgacagaaccttggctaaggaaggaatcaagaggggcgagacagatcatcacgccgtgtctcgcgggtcagccaaactgcggtggttcgtcgaaagaaacatggtgacgccagagggaaaggtcgtggacctcggctgcggtcgtgggggatggagctactattgtggcggtctgaaaaatgttagggaagtgaagggcttaaccaaagggggacctggccatgaggagcccattcctatgtccacttacgggtggaaccttgtacggctgcaaagtggagtggatgtctttttcacaccacccgaaaagtgcgacaccctcctatgtgatatcggcgagtctagccctaatccaactatagaagcgggtcgcacactgcgagttttgaacctggtggagaattggctcaacaataacacccagttctgcattaaggtccttaatccctatatgccgtcagtgatcgagaaaatggaggctctgcagagaaagtacgggggagcattggtaaggaaccctctgtcccggaatagtacgcacgagatgtactgggtgagcaacgccaccggcaatatcgtttcttccgtgaacatgatttcacgcatgctcataaatagatttacaatgaaacacaagaaagctacttatgaaccagacgtcgatttaggcagcgggaccaggaacatcggaattgagtcggaaatccccaacctggacattatcggtaagcgaatagagaagatcaaacaggaacatgagacatcttggcactacgaccaagatcatccttataagacttgggcctaccacggcagttatgagaccaaacagacagggtccgcaagctcaatggtgaatggagtcgtgcggcttctgaccaagccatgggacgttgtacccatggtgactcagatggccatgacggatacaaccccgttcggccagcaacgtgtctttaaagaaaaggtggacactagaacccaggagcctaaggaaggtacgaaaaagctaatgaaaattacagctgagtggctctggaaggagctggggaaaaagaaaaccccacgcatgtgtactagggaagagttcacacggaaggttagatccaacgcggccttgggagcaatctttaccgatgaaaataagtggaaatctgctcgcgaggccgtggaagacggcaggttctgggagctggtcgatcgagagcggaacctccaccttgaaggcaagtgcgagacttgtgtgtacaatatgatggggaaaagagaaaagaaactgggagagtttggtaaggcaaagggcagcagggccatttggtatatgtggttaggggctcgcttcctggaatttgaggccttgggattcctcaacgaggaccattggtttagtcgtggcaattccctgagcggtgtagaaggggagggactacaccggcttggctacatcctgagagatgtgggcaaaaaggaagggggagcgatgtacgcagacgatacagccggttgggacaccaggattacactcgaggacctgaaaaacgaagagatggttactaatcatatgaagggcgagcacaaaaagttggctgaagccatattcaagctgacctatcagaacaaagtcgtgcgcgtgcagcgaccaacgcctcgggggaccgtcatggatatcatttctagaagggaccaacgcggatcaggccaggttggtacatacgggctcaatacttttaccaacatggaggcacagcttatcagacaaatggaaggagagggcatcttcaagagtattcagcatctgacagctactgaggaaatagccgtgcagaattggttagctcgggtaggcagggagcgtctgtcccgaatggccatcagcggggatgactgcgtggtcaaacccattgatgaccgcttcgcatctgcgttgaccgccctcaacgatatgggaaaggtgagaaaagacatccagcaatgggaaccatcgcggggttggaatgattggacgcaggttcccttttgctcacaccacttccatgagctggtgatgaaggacggcagggtcctagtggtaccttgtcgcaaccaggatgaacttattgggagagctcggatcagccagggagccggctggtccctgaaggagacagcatgcctcggtaaaagttatgctcaaatgtggaccctgatgtactttcacaggcgagacttgcgtttagccgcaaacgccatatgttctgcggttccaagccattgggtgccgacttccagaacaacctggtcaatccacgctaagcacgagtggatgactaccgaagatatgctggccgtctggaatcgcgtgtggattcaggagaacccctggatggaagacaaaacacctgtggagagttgggaagaggtcccatatctcgggaagcgggaggaccagtggtgcggatctcttatcggcctgacgagcagggcaacctgggccaaaaatattcagactgctatcaaccaagttagatccctaataggcaatgaagagtacacagattatatgccctcaatgaagcgcttccggagggaagaggaagaggccggggtgctgtggtga

SEQ ID NO: 14528 - RNA, 9876 nt, synthetic construct
  misc_feature 1..9876: note = derived and/or modified CDS sequence (opt3) from DENV-2__GQ199869__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacatacagggaagcaattggattcagaaggagactcttgtgacattcaagaaccctcatgccaaaaagcaagacgttgtggtcctgggctctcaggaaggggcgatgcacacggccttgaccggagcaactgagatccagatgtcctcaggtaatctactgtttacaggccatctcaaatgccgtctgcgcatggataagcttcaactgaaagggatgagctacagtatgtgtaccggaaagttcaagatcgtgaaagaaattgctgagacacagcacggcactatcgtaattagagttcagtatgagggtgacgggtctccatgcaagatacccttcgaaatcaccgatttggagaaaaggcatgtgctcggccggctgattacggtcaacccgatcgtgaccgaaaaggactcccctgtcaacatcgaggccgaacccccatttggagatagctacattataatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtttttacatcaattgggaaggccctgcaccaggtgttcggcgctatctacggagcggcatttagtggcgtaagctggactatgaaaatacttatcggggtcattatcacctggattggaatgaactccagatctacgagcttgtcagtgagtctggttctcgtgggcgtcgtgacactgtatcttggtgccgtagtgcaggctgactccgggtgtgttgtcagctggaagaataaagaactgaagtgcggatctggcatcttcataaccgataacgtgcacacttggacagagcagtacaagtttcaacccgaatcaccaagtaaattggccagcgcaattcagaaggcccatgaggaaggtatctgtggcattaggtccgtgacccggctcgagaatctgatgtggaaacagatcactcccgagttaaaccacatactgtctgaaaatgaggtcaagctaaccatcatgacaggggacattaaaggaatcatgcaggctggcaagcgctcgctcagacctcaaccaacggaactgaaatatagctggaagacctgggggaaggccaaaatgctttccactgagtcacataaccagacattcttgattgatggaccggaaaccgcagagtgccccaatacaaacagggcgtggaatagtctggaggttgaagactacggctttggtgtgttcactaccaacatctggctcaagctgcgtgagaaacaggacgtgttttgtgattctaagttaatgagcgctgccataaaagacaatcgggcagtacacgccgatatggggtattggattgaatccgctctgaacgacacgtggaagatggagaaggcctcattcatcgaggtcaaaagctgccactggcctaagtctcatacactttggtccaatggagtgttggaaagtgagatgatcattccaaaaaacttcgcaggccccgttagccagcacaactaccgacctggttatcatacccaaactgctggcccatggcacctcgggaagctggaaatggattttgacttctgtgagggaaccacagtggtcgtgactgaagattgcggcaatagagggccctctctaaggaccacaacggcctccggaaaactgatcaccgagtggtgctgtcgctcatgcactctcccgcctctgcggtacagaggcgaggacggttgttggtacgggatggaaattaggccacttaaggagaaggaagagaacttggttaatagtctggtgacagcgggacatggccagatagataactttagcttaggtgtactcggcatggccctgttccttgaagagatgctgcgcacccgaatcgggactaaacacgctattttgctcgtcgcagtgtcgtttgtgacactgatcaccggaaatatgtccttccgggacctaggccgtgtcatggttatggtgggggccacgatgactgatgacattggaatgggcgtaacctatctggctctcctggccgcatttaaggtgagacccacattcgcggccggtcttttgctgaggaaattaacctctaaggagctcatgatggctactatcgggatagccctgcttagccagtcaacaatccctgaaaccattctggagctaacagatgcactcgctctgggaatgatggtcttgaaaatcgtgcgcaacatggaaaagtaccaactggccgttactattatggcaatcagttgcgtgcccaatgccgtcatattacagaacgcttggaaggtgtcctgtaccattctcgcggccgtttctgtgagcccactgcttctgacgtcctcacagcagaaagcagactggatccctttggctctcacaatcaagggcctgaatcccaccgccatttttctaactaccctgagccggacaagtaaaaagagatcttggccacttaacgaggccataatggctgtcggcatggtatccatcctcgcaagctcgctgttgaaaaatgacattccgatgactgggcctctggtggccggaggtttactcaccgtttgctatgtgctgacgggcaggtcagcggatcttgaactggagcgagctgccgacgtcaagtgggaggatcaagcagaaatctctgggagttcccccattttgagcatcacaatatctgaggacggaagcatgtccatcaaaaacgaagaggaggaacagaccctcactattctgatccgcacaggcctactggtgatttcaggtgtattcccagtgagtatccccataaccgccgctgcatggtacctttgggaggtcaagaagcagcgggccggggttctctgggatgtgcctagcccaccccctgtggaaaaagcggagctggaagacggagcttatagaattaagcagaggggcatcttgggctactctcaaatcggggccggagtctataaagagggtacttttcacacaatgtggcatgtgacccgtggcgcagttttaatgcaccgcgggaagcggattgagccgtcctgggccgatgtaaaaaaggacctgatctcatacggaggcggttggaagctcgaaggggagtggaaagaaggagaggaagtgcaggtcctggctcttgagccaggcaagaatcccagagccgtgcagacgaaacctggcatattcaagactaacaccgggacaattggagcagttagtctggattttagcccaggtacctccggctctcccatcgtggacaggaaagggaaggtcgtgggattgtacggcaatggtgtagtcacacgatcgggggcttatgtgagcgccattgcgcagactgagaagtcaatcgaagataaccctgagatagaagacgatattttccggaaaaagcgcctaaccatcatggacctgcatccgggagccggcaaaacgaagagatacctccccgcaatcgttagggaggctattaaacggggcctgcgaacacttatcttagccccaactagagtggtcgctgcagaaatggaggaggccctgcgcgggctccctattaggtatcaaacccccgccataaagacagaacacaccggacgtgagatcgtggacttgatgtgtcatgctactttcaccatgcggctgctctccccagttagagtgcctaactacaatctgattatcatggatgaagcgcactttacagaccccgcaagtatcgccgctaggggttatatttctacgcgcgtcgagatgggcgaggccgcagggatattcatgactgccaccccaccgggaagccgagatccttttccccagtccaacgctccaatcatggacgaagagagagaaattcccgagcggtcatggaattctggccacgaatgggtgacagatttcaagggtaaaaccgtatggtttgtgcctagcatcaaggcggggaacgacattgccgcatgccttaggaaaaatggaaagaaagttatccagctgagtcgcaagactttcgattccgagtacgtcaagacacgtgctaacgactgggattttgtggtgaccacggacataagcgagatgggcgccaatttcaaagcagaaagagtcatcgatccacggaggtgtatgaagcccgtaattttgactgacggcgaggaacgcgtgatcctagccgggcctatgccggttacacattcttcagctgcccaacgaagaggacggattggtaggaacccaaaaaatgagaacgaccagtatatctacatgggcgaacccctggagaatgatgaggactgcgcgcactggaaggaagcaaaaatgctcttagataacataaatacccctgaggggattatcccctccatgtttgaaccagagcgcgaaaaggtggacgccattgatggagagtacagactgaggggcgaggctcggaaaaccttcgtcgaccttatgcgtcgcggtgatctgcctgtgtggctcgcctataaggttgctgcagaagggatcaactacgccgaccgaaagtggtgttttgatggcataaaaaataaccagatcttggaggaaaacatggaggtggagatttggactaaggaaggagagagaaaaaagctgaaacccaggtggctcgacgctcggatctatagtgatccactggcccttaaggaattcaaggagttcgcagcgggccgcaaaagcctaacactgaatttgattaccgaaatggggagattacctacatttatgactcagaaggccaggaacgctctggacaatctcgccgtcctgcatacggcagaggctggaggtcgggcctacaaccacgcactttcggagctgccggaaaccctcgagacattgctgctactgactctccttgccaccgtgacaggcgggatcttcctgtttttaatgtctggaaaaggcataggtaagatgaccttggggatgtgctgcattatcactgcttccatcctgctctggtatgcgcaaattcagccccactggatcgccgcaagcataattctggaattctttcttatcgtactgctcattccagagcctgaaaaacagcgaacgccccaggataatcaattgacctacgtggttatcgctatactgacagtcgtggccgccactatggcaaacgagatgggcttcttagagaagaccaagaaagacctaggactgggctcaatcacaacccaggaaagtgagtctaatattctcgacatcgatcttagaccagcttccgcctggactctgtatgcggtggctacaacgtttgtcacccctatgttgcgccatagcattgaaaactcaagtgttaatgtgagcctgactgccatcgcaaaccaggccacagtactcatggggctgggaaagggttggcccctttccaaaatggacattggcgtgccgctcctggctatcgggtgttactctcaggtcaatccaataaccttgaccgcagccctgttactactggtggcgcactacgctattatcggacctggcctccaagccaaggcaacaagggaggcccagaaacgggctgccgcaggtatcatgaagaaccccactgttgatgggattacggtgatagaccttgaaccaatcccctatgatcctaagttcgagaaacagctgggccaggtcatgttgctgattctctgcgtaacccaagtgctgatgatgcgtacaacttgggctctttgtgaggccttaaccctggcgacaggaccgatcagcaccctctgggaaggcaatcccgggagattttggaacactacgattgccgtttccatggcaaatatcttcaggggatcatacttggctggcgccggtctgctattttctataatgaagaacacaaccagtactcgccgggggaccggaaatatcggcgagacactgggtgaaaaatggaagtcgcgactcaacgcacttggcaaaagcgagttccagatttataagaaatccgggatccaggaggtggacagaactctggctaaggaaggaattaagaggggcgagaccgatcatcacgccgtctctcgcgggtcagccaaattgcggtggtttgtggaaagaaacatggtcacaccagagggaaaggtggttgacctgggctgcggtcgtgggggatggagctactattgtggcggtctcaaaaatgtgagggaagtaaagggcctgacgaaagggggacctggccatgaggagcccatccctatgtccacctacgggtggaacttagtgcggcttcaaagtggagtcgatgttttcttcactccacccgaaaagtgcgacacactgctctgtgatataggcgagtctagccctaatccaaccattgaagcgggtcgcactctacgagtgctgaacttggtcgagaattggctgaacaataacacacagttttgcatcaaggtgctcaatccctatatgccgtcagtaatcgaaaaaatggaggctcttcagagacagtacgggggagcactggtgaggaaccctttgtcccggaatagtacccacgagatgtactgggttagcaacgccacgggcaatattgtgtcttccgtcaacatgatatcacgcatgctgatcaatagattcaccatgaagcacaaaaaggctacatatgaaccagacgtggatctcggcagcgggactaggaacattggaatcgagtcggaaattcccaacttagacatcataggtaaacgaatcgagaagattaagcaagaacatgagatctcttggcactacgaccaggatcatccttataaaacctgggcctaccacggcagttatgagacaaagcagactgggtccgcaagctcaatggtcaatggagtggttcggctgcttaccaaaccatgggacgtagtgcccatggtcacacagatggccatgaccgatactacgccgtttggccaacagcgtgtgttcaaggaaaaagttgacacaagaacccaggagcctaaggaaggtactaagaaactgatgaagattaccgctgagtggctatggaaagagctcgggaagaaaaagacaccccgcatgtgtacgagggaagagtttaccaaaaaggtgcggtccaacgcggccctgggagcaatcttcactgatgaaaataagtggaaatctgctagagaggccgtcgaagacggccgcttttgggagttggtggatagggagcgaaacctgcacctcgaaggcaagtgcgagacatgtgtatacaatatgatggggaaacgggaaaagaaacttggagagttcggtaaggcaaagggcagcagagccatttggtatatgtggctgggggctaggtttttagaattcgaggccctgggatttttgaacgaggaccattggttcagtcgcggcaattccctcagcggtgtggaaggggagggactgcaccgtctaggctacatacttcgggatgttggcaaaaaggaagggggagcgatgtacgcagacgataccgccggttgggacactagaatcacactggaggacctcaaaaacgaagagatggtcaccaatcatatgaagggcgagcacaaaaagctggctgaagccatttttaagttgacatatcagaacaaagtggtgagggtccaacgcccaactcctcgagggaccgttatggatatcatctctcggagagaccagaggggatcaggccaggtgggtacgtacgggctgaataccttcacaaacatggaggcacaactcattcgccagatggaaggagagggcatattcaagagtatccagcatcttactgctaccgaggaaattgccgtacagaattggctggctagagtgggccgggagaggttatcccgtatggccatcagcggggatgactgcgtcgtgaaacccattgatgaccgatttgcatctgcgctgacagccttgaacgatatgggaaaggttcgcaaagacatccaacagtgggaaccatcgagaggttggaatgattggactcaggtgcccttctgctcacaccactttcatgagctcgtcatgaaggacggccgggtgctggtagttccttgtaggaaccaggatgaactaatagggcgcgctagaatcagccaaggagccggctggtcccttaaggagaccgcatgcctgggtaaaagttatgctcagatgtggacgctcatgtacttccaccggagggacctgcgattggccgcaaacgccatttgttctgcggtgccaagccattgggtcccgacatcccgtaccacttggtcaatccacgctaagcacgagtggatgacaaccgaagatatgttagccgtgtggaatagagtgtggattcaggagaacccctggatggaagacaaaactcctgtcgagagttgggaagaggttccatatctggggaagcgcgaggaccagtggtgcggatctctcatcggccttaccagccgggcaacatgggccaaaaatatacaaacggctattaaccaggtgaggtccctgatcggcaatgaagagtacaccgattatatgccctcaatgaagagatttcgccgggaagaggaagaggccggggtactatggtga

SEQ ID NO: 14529 - RNA, 9876 nt, synthetic construct
  misc_feature 1..9876: note = derived and/or modified CDS sequence (opt3) from DENV-2__JX079688__SS-prME
  source 1..9876: mol_type = other RNA
accgccggcgtgatagtaatgctgattccaactgctatggctttccacctcactacgagaaacggggaacctcatatgatagttggaaggcaggaaaagggtaaaagccttctgtttaagaccgaagacggcgtgaatatgtgcacattgatggccatcgatttaggggaactgtgtgaagacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatagaatccgctctgaacgacacatggaagatggagaaggcctcattcattgaggtcaaaagctgccactggcctaagtctcataccctttggtccaatggagtgttggaaagtgagatgatcatccccaagaatttcgcaggccccgttagccagcacaactaccgacctggttatcatactcaaaccgctggcccatggcacctcgggaagctggaaatggattttgacttctgtgagggaacaactgtggtcgtgaccgaagattgcggcaatagagggccctctctaaggacaacgaccgcctccggaaaactgattactgagtggtgctgtcgctcatgcacactcccgcctctgcggtacagaggcgaggacggttgttggtacgggatggaaatcaggccacttaaggagaaggaagagaacttggttaatagtctggtgaccgcgggacatggccagattgataactttagcttaggtgtactcggcatggccctgttccttgaagagatgctgcgcactcgaatagggacaaaacacgctatcttgctcgtcgcagtgtcgtttgtgaccctgattacgggaaatatgtccttccgggacctaggccgtgtcatggttatggtgggggccactatgaccgatgacatcggaatgggcgtaacatatctggctctcctggccgcatttaaggtgagacccaccttcgcggccggtcttttgctgaggaaattaacttctaaggagctcatgatggctacaattgggatcgccctgcttagccagtcaaccatacctgaaacaatcctggagctaactgatgcactcgctctgggaatgatggtcttgaaaattgtgcgcaacatggaaaagtaccaactggccgttaccatcatggcaattagttgcgtgcccaatgccgtcatcttacagaacgcttggaaggtgtcctgtacgatactcgcggccgtttctgtgagcccactgcttctgacatcctcacagcagaaagcagactggattcctttggctctcaccatcaagggcctgaatcccactgccatctttctaaccacactgagccggacaagtaaaaagagatcttggccacttaacgaggccattatggctgtcggcatggtatccatactcgcaagctcgctgttgaaaaatgacatcccgatgaccgggcctctggtggccggaggtttactcacggtttgctatgtgctgacaggcaggtcagcggatcttgaactggagcgagctgccgacgtcaagtgggaggatcaagcagaaatttctgggagttcccccatcttgagcattaccatctctgaggacggaagcatgtccatcaaaaacgaagaggaggaacagactctcacaatcctgattcgcaccggcctactggtgatctcaggtgtattcccagtgagtattcccatcactgccgctgcatggtacctttgggaggtcaagaagcagcgggccggggttctctgggatgtgcctagcccaccccctgtggaaaaagcggagctggaagacggagcttatagaataaagcagaggggcattttgggctactctcaaatcggggccggagtctataaagagggtacatttcacaccatgtggcatgtgacgcgtggcgcagttttaatgcaccgcgggaagcggatcgagccgtcctgggccgatgtcaaaaaggacctgatttcatacggaggcggttggaagctcgaaggggagtggaaagaaggagaggaagtgcaggtcctggctcttgagccaggcaagaatcccagagccgtgcagactaaacctggcatcttcaagaccaacacagggaccataggagcagttagtctggattttagcccaggtacatccggctctcccattgtggacaggaaagggaaggtcgtgggattgtacggcaatggtgtagtcactcgatcgggggcttatgtgagcgccatcgcgcagaccgagaagtcaattgaagataaccctgagatcgaagacgatatattccggaaaaagcgcctaacgattatggacctgcatccgggagccggcaaaacaaagagatacctccccgcaatcgttagggaggctatcaaacggggcctgcgaactcttattttagccccaaccagagtggtcgctgcagaaatggaggaggccctgcgcgggctccctatcaggtatcaaacacccgccattaagaccgaacacactggacgtgagatagtggacttgatgtgtcatgctaccttcacaatgcggctgctctccccagttagagtgcctaactacaatctgatcattatggatgaagcgcactttacggaccccgcaagtatcgccgctaggggttatatctctactcgcgtcgagatgggcgaggccgcagggattttcatgaccgccacaccaccgggaagccgagatccttttccccagtccaacgctccaataatggacgaagagagagaaatccccgagcggtcatggaactctggccacgaatgggtgaccgatttcaagggtaaaactgtatggtttgtgcctagcattaaggcggggaacgacatcgccgcatgccttaggaaaaatggaaagaaagttattcagctgagtcgcaagacattcgattccgagtacgtcaagacccgtgctaacgactgggattttgtggtgacgactgacatcagcgagatgggcgccaatttcaaagcagaaagagtcatagatccacggaggtgtatgaagcccgtaatcttgacagacggcgaggaacgcgtgattctagccgggcctatgccggttacccattcttcagctgcccaacgaagaggacggatcggtaggaaccccaaaaatgagaacgaccagtatatttacatgggcgaacccctggagaatgatgaggactgcgcgcactggaaggaagcaaaaatgctcttagataacatcaatacccctgaggggataattccctccatgtttgaaccagagcgcgaaaaggtggacgccatcgatggagagtacagactgaggggcgaggctcggaaaactttcgtcgaccttatgcgtcgcggtgatctgcctgtgtggctcgcctataaggttgctgcagaagggattaactacgccgaccgaaagtggtgttttgatggcatcaaaaataaccagatattggaggaaaacatggaggtggagatctggacaaaggaaggagagaggaaaaagctgaaacccagatggctcgacgctcggatttatagtgatccactggcccttaaggagttcaaggagttcgcagcgggccgcaaaagcctaaccctgaatttgatcacagaaatggggagattacctacttttatgacgcagaaggccaggaacgctctggacaatctcgccgtcctgcataccgcagaggctggaggtcgggcctacaaccacgcactttcggagctgccggaaacactcgagactttgctgctactgaccctccttgccacagtgaccggcgggattttcctgtttttaatgtctggaaaaggcatcggtaagatgactttggggatgtgctgcataattacggcttccatcctgctctggcacgcgcaaatccagccccattggattgccgcaagcatcatactggagttctttcttattgtactgctcatcccagagcctgaaaaacagcgaaccccacaggataatcaattgacatatgtggttattgctatcctgactgtcgtggccgccaccatggcaaacgagatgggcttcttagagaagacaaagaaagacctaggactgggctcaataaccactcaggaaagtgagtctaatatcctcgacattgatcttagaccagcttccgcctggacactgtacgcggtggctacgacctttgtcactcctatgttgcgccacagcatcgaaaactcaagtgttaatgtgagcctgacagccattgcaaaccaggccaccgtactcatggggctgggaaagggttggcccctttccaaaatggacatcggcgtgccgctcctggctattgggtgttattctcaggtcaatccaatcaccttgacagcagccctgttactactggtggcgcattacgctataattggacctggcctccaagccaaggcaactagggaggcccagaaacgggctgccgcaggtatcatgaagaaccccacggttgatgggatcaccgtgattgaccttgaaccaataccctacgatcctaagttcgagaaacagctgggccaggtcatgttgctgatcctctgcgtaacacaagtgctgatgatgcgtactacctgggctctttgtgaggccttaacactggcgaccggaccgattagcactctctgggaaggcaatcccgggagattttggaacacgacaatcgccgtttccatggcaaatattttcaggggatcatatttggctggcgccggtctgctattttctatcatgaagaacaccacaagtacccgccgggggacaggaaatataggcgagactctgggtgaaaaatggaagtcgcgactcaacgcacttggcaaaagcgagttccagatctacaagaaatccgggattcaggaggtggacagaaccctggctaaggaaggaatcaagaggggcgagacagatcaccatgccgtctctcgcgggtcagccaaattgcggtggtttgtggaaagaaacatggtcacgccagagggaaaggtggttgacctgggctgcggtcgtgggggatggagctattactgtggcggtctcaaaaatgtgagggaagtaaagggcctgaccaaagggggacctggccacgaggagcccattcctatgtccacttatgggtggaacttagtgcggcttcaaagtggagtcgatgttttcttcacaccacccgaaaagtgcgacaccctgctctgtgatatcggcgagtctagccctaatccaactatagaagcgggtcgcacactacgagtgctgaacttggtcgagaattggctgaacaataacacccagttttgcattaaggtgctcaatccctacatgccgtcagtaatcgagaaaatggaggcacttcagagacagtatgggggagcactggtgaggaaccctttgtcccggaatagtacgcacgagatgtactgggttagcaacgccaccggcaatatcgtgtcttccgtcaacatgatttcacgcatgctgataaatagattcacaatgaagcataaaaaggctacttacgaaccagacgtggatctcggcagcgggaccaggaacatcggaattgagtcggaaatccccaacttagacattatcggtaaacgaatagagaagatcaagcaagaacacgagatttcttggcattatgaccaggatcacccttacaaaacatgggcctatcacggcagttacgagactaagcagaccgggtccgcaagctcaatggtcaatggagtggttcggctgcttacaaaaccatgggacgtagtgcccatggtcacccagatggccatgactgatacgacaccgtttggccaacagcgtgtgttcaaggaaaaagttgacaccagaactcaggagcctaaggaaggtaccaagaaactgatgaagatcacagctgagtggctatggaaagagctcgggaagaaaaagacgccccgcatgtgtaccagggaagagtttactaaaaaggtgcggtccaacgcggccctgggagcaattttcacagatgaaaataagtggaaatctgctagagaggccgtcgaagacggccgcttttgggagttggtggatagggagcgaaacctgcatctcgaaggcaagtgcgagacctgtgtatataatatgatggggaaacgggaaaagaaacttggagagttcggtaaggcaaagggcagcagagccatctggtacatgtggctgggggctaggtttttagagttcgaggccctgggatttttgaacgaggaccactggttcagtcgcggcaattccctcagcggtgtggaaggggagggactgcatcgtctaggctatattcttcgggatgttggcaaaaaggaagggggagcgatgtacgcagacgatactgccggttgggacacaagaataaccctggaggacctcaaaaacgaagagatggtcacaaatcacatgaagggcgagcataaaaagctggctgaagccatctttaagttgacttaccagaacaaagtggtgagggtccaacgcccaacccctcgagggacggttatggatattatctctcggagagaccagaggggatcaggccaggtgggtacctatgggctgaatacattcactaacatggaggcacaactcatccgccagatggaaggagagggcattttcaagagtatacagcaccttaccgctacagaggaaatcgccgtacagaattggctggctagagtgggccgggagaggttatcccgtatggccattagcggggatgactgcgtcgtgaaacccatcgatgaccgatttgcatctgcgctgactgccttgaacgatatgggaaaggttcgcaaagacattcaacagtgggaaccatcgagaggttggaatgattggacccaggtgcccttctgctcacaccattttcacgagctcgtcatgaaggacggccgggtgctggtagttccttgtaggaaccaggatgaactaatcgggcgcgctagaataagccaaggagccggctggtcccttaaggagacggcatgcctgggtaaaagttacgctcagatgtggacactcatgtatttccatcggagggacctgcgattggccgcaaacgccatctgttctgcggtgccaagccactgggtcccgacctcccgtactacatggtcaattcacgctaagcatgagtggatgaccactgaagatatgttagccgtgtggaatagagtgtggatccaggagaacccctggatggaagacaaaacccctgtcgagagttgggaagaggttccatacctggggaagcgcgaggaccagtggtgcggatctctcattggccttacaagccgggcaacgtgggccaaaaatatccaaaccgctataaaccaggtgaggtccctgattggcatcgaagagtatactgattacatgccctcaatgaagagatttcgccgggaagaggaagaggccggggtactatggtga

SEQ ID NO: 14530 - RNA, 9876 nt, synthetic construct
  misc_feature 1..9876: note = derived and/or modified CDS sequence (opt3) from DENV-2__JF357906__SS-prME
  source 1..9876: mol_type = other RNA
accgccggagtgatcgtcatgctgattcccacggctatggcattccacctcactacgcggaatggggaacctcatatgatagttggaagacaggaaaagggtaaaagccttctgtttaagaccgaagacggcgtgaatatgtgcacattgatggccatcgatttaggggaactgtgtgaggacactattacctacaaatgcccactactccggcaaaacgaaccggaggatatcgactgttggtgcaattccacatctacctgggtgacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcagtgttggcctacaccatcggcacgactcactttcagaaggctctcattttcatcctgctgacagcagtcgccccatccatgaccatgcgctgcattgggatctctaacagagattttgtggaaggagtatcgggtggctcatgggttgacatagtgctcgagcacgggagctgtgtcactacaatggctaagaataaacccaccttagatttcgaactgattaagacggaggccaaacagcctgcgacccttaggaagtattgcatcgaagcaaaattgacaaacactaccacagagagtcggtgtccaactcaaggagagccctccctgaatgaagaacaggacaagcgctttatttgcaagcattctatggtggatcgaggctggggtaacgggtgtggactattcggcaaaggcgggatcgtgacctgcgccatgtttacatgcaagaaaaatatggaaggaaaggtcgttcagcctgagaacctcgaatacaccatcgtgattactccacacagcggtgaggagcatgctgtaggcaatgacacggggaaacacggaaaggaaataaaaatcacaccgcagtcctcaattaccgaggccgaactgactggctatggtaccgtgacaatggagtgtagtcccagaaccgggcttgatttcaacgaaatggtcctgttgcaaatggaggacaaggcatggctcgtgcacaggcagtggtttctggatttacctctgccatggctccccggcgctgacactcagggaagcaattggatccagaaggagacacttgttacgttcaaaaaccctcatgccaagaaacaagacgtggtcgtgctgggctctcaggaaggggcgatgcacaccgccttgactggagcaacagagatacagatgtcctcaggtaatctactgtttaccggccatctcaagtgccggctgcgtatggataaacttcaactgaaggggatgagctacagtatgtgtacaggaaagttcaaaattgtaaaggaaatcgctgagactcagcacggcaccatcgttattcgcgtgcagtatgagggtgacgggtctccatgcaaaatccccttcgaaattacggatttggagaagagacatgtcctcggcaggctgataaccgtgaacccgatcgtcacagaaaaagactcccctgtgaacattgaggccgaacccccatttggagatagctacatcatcattggcgttgagcctgggcagttaaagctgaattggttcaagaaaggatcgtctataggtcaaatgtttgagactaccatgcggggcgctaagcgaatggccatcctaggggacacagcatgggatttcggatccctcggcggtgtgtttacttcaattgggaaagccctgcaccaggtattcggcgctatctacggagcggcatttagtggcgtcagctggaccatgaagattcttatcggggtgataatcacgtggattggaatgaactcccgctctactagcttgtcagttagtctggtgctcgtcggcgtggtaaccctgtatcttggtgccgtggttcaggctgactccgggtgtgtcgtgagctggaaaaataaggaactgaagtgcggatctggcatcttcattactgataacgtgcacacatggaccgagcagtacaaatttcaacccgaatcaccaagtaagttggccagcgcaatccagaaagcccatgaggaaggtatatgtggcattagatccgtcactaggctcgagaatctgatgtggaagcagatcacccccgagttaaaccacattctgtctgaaaatgaggttaaactaacaatcatgacgggggacataaagggaatcatgcaggctggcaaacggtcgctccgccctcaaccaaccgaactgaagtatagctggaagacttgggggaaagccaagatgctttccacagagtcacataaccagaccttcttgattgatggaccggaaacagcagagtgccccaatactaacagagcgtggaatagtctggaggtggaagactacggctttggtgtgttcaccacgaacatctggctcaaactgagggagaagcaggacgtattttgtgattctaaattaatgagcgctgccattaaggacaatcgtgcagtccacgccgatatggggtattggatcgaatccgctctgaacgacacatggaagatggagaaagcctcattcatagaggtaaagagctgccactggcctaaatctcataccctttggtccaatggagttttggaaagtgagatgattatcccaaagaacttcgcaggccccgtgagccagcacaactaccggcctggttatcatactcaaaccgctggcccatggcacctcgggaaactggaaatggattttgacttctgtgagggaacaactgtcgtggttaccgaagattgcggcaatcgagggccctctctaagaacaacgaccgcctccggaaagctgatcactgagtggtgctgtaggtcatgcacactcccgcctctgcgctaccggggcgaggacggttgttggtacgggatggaaattagaccacttaaggagaaagaagagaacttggtgaatagtctggtaaccgcgggacatggccagatcgataactttagcttaggtgtcctcggcatggccctgttccttgaagagatgctgaggactcgcattgggacaaagcacgctatattgctcgtggcagtgtcgtttgtcaccctgatcacgggaaatatgtccttccgagacctaggccgggttatggtgatggtaggggccactatgaccgatgacattggaatgggcgtgacatatctggctctcctggccgcatttaaagtccgtcccaccttcgcggccggtcttttgctgagaaagttaacttctaaagagctcatgatggctacaatcgggattgccctgcttagccagtcaaccatccctgaaacaatactggagctaactgatgcactcgctctgggaatgatggtgttgaagatcgttaggaacatggaaaagtaccaactggccgtgaccattatggcaatcagttgcgtccccaatgccgtgattttacagaacgcttggaaagtttcctgtacgatcctcgcggccgtgtctgtcagcccactgcttctgacatcctcacagcagaaggcagactggatacctttggctctcaccattaaaggcctgaatcccactgccatctttctaaccacactgagccgcacaagtaagaaacggtcttggccacttaacgaggccatcatggctgtaggcatggtgtccattctcgcaagctcgctgttgaagaatgacataccgatgaccgggcctctggttgccggaggtttactcacggtgtgctatgtcctgacaggcagatcagcggatcttgaactggagagggctgccgacgtgaaatgggaggatcaagcagaaatctctgggagttcccccattttgagcatcaccatttctgaggacggaagcatgtccatcaagaacgaagaggaggaacagactctcacaatactgatccgaaccggcctactggtaatttcaggtatcttcccagtgagtattcccatcactgccgctgcatggtacctttgggaggtcaagaaacagcgcgccggggttctctgggatgtgcctagcccaccccctgtggaaaaggcggagctggaagacggagcttatcggataaaacagagaggcattttgggctactctcaaatcggggccggagtctataaggagggtacatttcacaccatgtggcatgtgacgaggggcgcagttttaatgcaccgtgggaaacgcatcgagccgtcctgggccgatgtaaagaaggacctgatttcatacggaggcggttggaaactcgaaggggagtggaaggaaggagaggaagtgcaggtcctggctcttgagccaggcaaaaatccccgggccgtgcagactaagcctggcatcttcaaaaccaacacagggaccataggagcagttagtctggattttagcccaggtacatccggctctcccattgtggacagaaaggggaaggtcgtgggattgtacggcaatggtgtagtcactaggtcgggggcttatgtgagcgccatcgcgcagaccgagaaatcaattgaagataaccctgagatcgaagacgatatattccgaaagaaacggctaacgattatggacctgcatccgggagccggcaagacaaaacgctacctccccgcaatcgttagagaggctatcaagaggggcctgcggactcttattttagccccaacccgagtggtcgctgcagaaatggaggaggccctgagagggctccctatccgctatcaaacacccgccattaagaccgaacacactggaagggagatagtggacttgatgtgtcatgctaccttcacaatgcgtctgctctccccagttcgggtgcctaactacaatctgatcattatggatgaagcgcactttacggaccccgcaagtatcgccgctagaggttatatctctactagggtcgagatgggcgaggccgcagggattttcatgaccgccacaccaccgggaagccgcgatccttttccccagtccaacgctccaataatggacgaagaacgagaaatccccgagagatcatggaactctggccacgaatgggtgaccgatttcaaaggtaagactgtatggtttgtgcctagcattaaagcggggaacgacatcgccgcatgccttcggaagaatggcaagaaggttattcagctgagtaggaagacattcgattccgagtacgtcaaaacccgcgctaacgactgggattttgtggtgacgactgacatcagcgagatgggcgccaatttcaaggcagaacgtgtcatagatccaagacggtgtatgaaacccgtaatcttgacagacggcgaggaaagggtgattctagccgggcctatgccggttacccattcttcagctgcccaacgccgaggaagaatcggtcggaacccaaagaatgagaacgaccagtatatttacatgggcgaacccctggagaatgatgaggactgcgcgcactggaaagaagcaaagatgctcttagataacatcaatacccctgaggggataattccctccatgtttgaaccagagagggaaaaagtggacgccatcgatggagagtaccgcctgagaggcgaggctaggaagactttcgtcgaccttatgcggcgtggtgatctgcctgtgtggctcgcctataaggttgctgcagaagggattaactacacagaccgcaaatggtgttttgatggcatcaagaataaccagatattggaggaaaacatggaggtggagatctggaccaaagaaggagagcgaaagaaactgaagcccagatggctcgacgccaggatttatagtgatccactggctcttaaggagttcaaagagttcgccgcaggcagaaagagcctaacactgaatttgatcactgaaatggggcgcttacctacgtttatgacccagaaagcgagaaacgccctggacaatctcgctgtcctgcatacagccgaggcaggaggtagggcttacaaccacgccctttcggagctgccggaaactctcgagaccttgctgctactgacactccttgcaaccgtgactggcgggattttcctgtttttaatgtctggaaagggcatcggtaaaatgacgttggggatgtgctgcataattaccgcctccatcctgctctggtatgctcaaatccagccccactggattgcggccagcatcatactggagttctttcttattgtactgctcatcccagagcctgaaaagcagcggacaccccaggataatcaattgacttacgtggttattgcaatcctgaccgtcgtggctgccacaatggccaacgagatgggcttcttagagaagaccaaaaaggacctaggactgggctcaataactacacaggaaagtgagtctaatatcctcgacattgatcttcgaccagcatccgcttggacgctgtatgccgtggcgaccacttttgtcacacctatgttgagacatagcatcgaaaactcaagtgttaatgtgagcctgaccgctattgccaaccaggcaaccgtactcatggggctgggaaaaggttggcccctttccaagatggacatcggcgtgccgctcctggccattgggtgttactctcaggtcaatccaatcacattgactgctgcactgttactactggtggcccactacgcgataattggacctggcctccaagctaaagccacgcgcgaggcacagaagagggccgctgccggtatcatgaagaaccccaccgttgatgggatcacagtgattgaccttgaaccaataccctatgatcctaaattcgagaagcagctgggccaggtcatgttgctgatcctctgcgtaactcaagtgctgatgatgcggaccacatgggcactttgtgaggctttaaccctggccactggaccgattagcacgctctgggaaggcaatcccgggcgtttttggaacacaaccatcgcggtttccatggccaatattttcagaggatcatacttggcaggcgctggtctgctattttctatcatgaaaaacactaccagtacaaggcgcgggactggaaatataggcgagaccctgggtgaaaagtggaaatcgcggctcaacgcccttggcaagagcgagttccagatctataaaaagtccgggattcaggaggtggaccgaacactggcaaaggaaggaatcaaaagaggcgagacggatcatcacgctgtctctagggggtcagccaagttgcgctggtttgtggaacggaacatggtcaccccagagggaaaagtggttgacctgggctgcggtagagggggatggagctactattgtggcggtctcaagaatgtgcgtgaagtaaaaggcctgactaaagggggacctggccatgaggagcccattcctatgtccacatacgggtggaacttagtgaggcttcaaagtggagtcgatgttttcttcaccccacccgaaaagtgcgacactctgctctgtgatatcggcgagtctagccctaatccaacaatagaagccggtcggaccctacgcgtgctgaacttggtcgagaattggctgaacaataacacgcagttttgcattaaagtgctcaatccctatatgccgtcagtaatcgaaaagatggaggcgcttcagcgacagtacgggggagctctggtgagaaaccctttgtccaggaatagtacccacgagatgtactgggttagcaacgcaacaggcaatatcgtgtcttccgtcaacatgatttcacggatgctgataaatcgcttcactatgaaacacaagaaagccacctatgaaccagacgtggatctcggcagcgggacaagaaacatcggaattgagtcggaaatccccaacttagacattatcggtaagaggatagagaagatcaaacaagaacatgagatttcttggcactacgaccaggatcatccttataagacttgggcttaccacggcagttatgagaccaaacagacagggtccgccagctcaatggtcaatggagtggttcgactgcttaccaagccatgggacgtagtgcccatggtcactcagatggcaatgacggatacaaccccgtttggccaacagcgggtgttcaaagaaaaggttgacactcgtacccaggagcctaaggaaggtaccaagaagctgatgaaaatcacggccgagtggctatggaaggagctcgggaggaaaaagacaccccgcatgtgtactagggaagagtttacacggaaagtgagatccaacgctgcgctgggagccattttcaccgatgaaaataagtggaagtctgcacgcgaggctgtcgaagacggcaggttttgggagttggtggatcgagagcggaacctgcacctcgaaggcaaatgcgagacttgtgtatacaatatgatggggaagagagagaagaaacttggagagttcggtaaagccaaaggcagcagggcaatctggtatatgtggctgggggcccgctttttagagttcgaggctctgggatttttgaacgaggaccattggttcagtcgtgaaaattccctcagcggcgtggagggtgaagggctgcaccggctaggatacattcttagagatgttggcaagaaagagggcggggccatgtacgcggacgatacagcaggatgggacaccaggataacactggaagacctcaagaacgaggagatggtcactaatcatatgaaaggtgaacacaagaaactggccgaggctatctttaagttgacctatcagaacaaggtggtgcgcgtccaacgaccaacgcctcggggcaccgttatggatattatctctagaagggaccagcgcgggtcaggacaggtgggcacatacggtctgaatactttcaccaacatggaagcccaactcatcagacagatggagggggagggaattttcaaaagtatacagcatcttacagcaactgaagagatcgctgtacagaattggctggcccgggtgggcagggaacgtttatcccgaatggctattagcggcgatgactgcgtcgtgaagcccatcgatgaccgctttgcctctgcactgaccgcgttgaacgatatggggaaagttagaaaggacattcaacagtgggagccatcgcggggatggaatgattggacacaggtgcccttctgctcacaccactttcatgaactcgtcatgaaagacggtagggtgctggtagttccttgtcgcaaccaggatgagctaatcggcagagcccggataagccaaggggctggatggtcccttaaggagacagcctgcctgggcaagagttatgcacagatgtggaccctcatgtacttccacaggcgagacctgcgtttggctgccaacgcaatctgttctgccgtgccaagccattgggtcccgacttccagaacaacctggtatattcacgcgaaacacgaatggatgactaccgaggatatgttagctgtgtggaatcgcgtgtggatccaggaaaacccctggatggaggacaagacacctgtcgaatcatgggaggaggttccatacctgggtaaacgggaagaccagtggtgcgggagtctcattggacttacgtctagggccacctgggcaaagaatatccaaactgccataaaccaggtgagaagcctgattggcaatgaggaatatacagattacatgccctccatgaaacgctttcggagggaggaagaggaggctggcgtactatggtga

SEQ ID NO: 14531 - RNA, 9873 nt, synthetic construct
  misc_feature 1..9873: note = derived and/or modified CDS sequence (opt3) from DENV-2__HQ705624__SS-prME
  source 1..9873: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccaaatttacatgcaagaaaaatatggaaggaaaggtggtccagcctgagaacctcgaatacaccattgttataactccacacagcggtgaggagcatgctgtgggcaatgacacggggaaacacggaaaggaaatcaaaattacaccgcagtcctcaatcaccgaggccgaactgactggctatggtaccgtaacaatggagtgtagtcccaggaccgggcttgatttcaacgaaatggtgctgttgcaaatggaggacaaggcatggctcgtccaccggcagtggtttctggatttacctctgccatggctccccggcgctgacactcagggaagcaattggatacagaaggagacacttgtgacgttcaaaaaccctcatgccaagaaacaagacgttgtggtcctgggctctcaggaaggggcgatgcacaccgccttgactggagcaacagagattcagatgtcctcaggtaatctactgtttaccggccatctcaagtgccgtctgcgcatggataaacttcaactgaaggggatgagctacagtatgtgtacaggaaagttcaaaatcgtgaaggaaatcgctgagactcagcacggcaccattgtaatcagagttcagtatgagggtgacgggtctccatgcaaagtgcccttcgaaattacggatttggagaagaggcatgtcctcggccggctgataaccgtgaacccgatcgtcacagaaaaagactcccctgtgaacattgaggccgaacccccatttggagatagctacatcatcattggcgttgagcctgggcagttaaagctgaattggttcaagaaaggatcgtctataggtcaaatgtttgagactaccatgcgaggcgctaagcgcatggccatcctaggggacacagcatgggatttcggatccctcggcggtgtgtttacttcaattgggaaagccctgcaccaggtattcggcgctatctacggagcggcatttagtggcgtcagctggaccatgaagattcttatcggggtgataatcacgtggattggaatgaactccagatctacaagcttgtcagttagtctggtgctcgtcggcgtggtaaccctgtatcttggtgccatggtgcaggctgactccgggtgtgttgtcagctggaaaaataaggaactgaagtgcggatctggcatcttcattactgataacgtgcacacatggaccgagcagtacaaatttcaacccgaatcaccaagtaagttggccagcgcaatcaaaaaggcccatgaggaaggtatatgtggcattaggtccgtgactcggctcgagaatctgatgtggaaacagatcacccccgagttaaaccacattctgtctgaaaatgaggtcaagctaacaatcatgacgggggacatacgcggaatcatgcaggctggcaaaagatcgctcaggcctcagccaaccgaactgaagtatagctggaagacttgggggaaagccaagatgctttccacagagtcacataaccaaaccttcttgattgatggaccggaaacagcagagtgccccaatactaaccgtgcgtggaatagtctggaggttgaagactacggctttggtgtgttcaccacgaacatctggctcaaactgcgggacaagcaggatgtgttttgtgactctaaattaatgagcgctgccattaaggataatcgagcagtacacgccgacatggggtattggatcgagtccgctctgaacgatacatggaagatggaaaaagcctcattcatagaggtcaagagctgccactggcctaaatctcataccctttggtccaatggagtgttggagagtgaaatgattatcccaaagaacttcgcaggccccgttagccagcacaactacagacctggttatcatactcagaccgctggcccatggcacctcgggaaactggagatggactttgatctatgtgaaggaacaactgtggtcgtgaccgaggactgcggcaatagggggccctctctgcgcacaacgaccgcctccggaaagctcatcactgaatggtgctgtcggtcatgcacactgccgcctcttagatacaggggcgaggatggttgttggtacgggatggagattcgcccattgaaggaaaaagaggaaaacctggttaatagtttagtgaccgcgggacatggccaaatcgacaacttcagcctcggtgtactgggcatggcccttctgttggaggaaatgctccgaactcggattgggacaaagcacgctatactgctagtcgcagtgtcgtttgtgaccctgatcacgggaaatatgtccttccgtgatctcggcagagtcatggttatggtgggggccactatgaccgacgatattggaatgggcgtaacatatctggctcttttggccgcatttaaagtgaggcccaccttcgcggccggtctgttactccgcaagctgacttctaaagagcttatgatggctacaatcgggattgccctgctaagccagtcaaccatccctgagacaatactcgaactgactgacgcattggctctgggaatgatggtcttaaagatcgtgcggaacatggagaagtaccagctcgccgttaccgtgatggcaattagttgcgtccccaatgccgtgatcctgcaaaacgcttggaaagtttcctgtacgattcttgcggccgtgtctgtcagcccactgttgctcacatcctcacagcagaaggcagactggatccctctggctctaaccataaaaggcctgaatcccactgccatttttcttaccacactcagcagaactagtaagaaaaggtcttggccactgaacgaagccatcatggctgtaggcatggtgtccatcttggcaagctcgctgttaaagaatgatattccgatgaccgggcctctcgttgccggaggtctgcttacggtgtgctatgtcctgacaggccgatcagcggacttggagctcgaacgcgctgccgatgtgaaatgggaggaccaggcagagatatctgggagttcccccatcctgagcattaccatctctgaagatggaagcatgtccattaagaacgaggaagaggagcaaactctaacaatcctgatacggaccggccttctcgtaatctcaggtgtgttcccagtcagtattcccatcactgccgctgcatggtacctgtgggaagttaagaaacagagagccggggtgttgtgggacgtgcctagcccaccccctgtcgagaaggcggaattagaggatggagcttataggattaaacagcgtggcatcctgggctactctcagataggggccggagtgtataaggaaggtacatttcacaccatgtggcatgttacgcgcggcgcagtactcatgcaccgggggaaaagaattgagccgtcctgggccgacgtgaagaaggatctgatctcatacggaggcggttggaaacttgagggggaatggaaggagggagaagaggtccaagtgctggctttggaaccaggcaaaaatcccagggccgttcagactaagcctggcatcttcaaaaccaacacagggaccattggagcagtgagtctagactttccaggtacaagcggctcccccatcgtcgatcgaaaggggaaggtggtaggactgtacggcaatggtgtcgtgactcggtctggggcttatgtttcggccatagcgcagaccgagaaaagcattgaggacaaccctgaaatcgaggatgacattttccgcaagaaaagactcacgatcatggacctgcatccgggagccggcaagacaaaaaggtaccttcccgcaatagtgcgggaagctattaagcgaggcttaagaactctgatcctcgccccaacccgcgtcgtggctgcagagatggaagaggccttgagggggctgcctatccgttatcagacaaccgccattaagactgagcacaccggacgggaaatcgttgatctcatgtgtcatgctacatttacgatgagactgctttcacccgtgagggtcccaaactacaatctgattataatggacgaggcgcacttcactgatcctgcatccatcgccgctcgcggttatattagtacccgagtggaaatgggcgaggccgcagggatcttcatgacagccacccccccaggatctagagacccgtttcctcaaagcaacgctcccatcatggatgaggaacgggagattccagaaaggtcctggaattcaggccacgagtgggtaactgacttcaaaggtaagacagtgtggtttgttccctctataaaagcggggaacgatatcgccgcatgcttgcgcaagaatggaaaaaaggtcattcagctaagccgtaagaccttcgacagtgaatacgtgaaaacgagagctaacgattgggactttgtggtcactacagatatctccgagatgggcgccaatttcaaggcagagcgggtaattgaccctaggcgctgtatgaaaccagtgatcctgaccgacggcgaagagcgagttatactcgccgggcccatgcctgtgacccatagctctgctgcccagagacggggaaggatcggtcgcaacccgaagaatgaaaacgatcaatatatttacatgggcgagccattagaaaatgacgaggattgcgcgcactggaaagaggcaaagatgctgcttgacaacatcaatactcccgaagggattatcccttcaatgtttgagcccgaaagagagaaagtcgatgccatagacggagaatacaggctgcggggcgaggctcgtaagacattcgtggatctcatgcgccgaggtgacttgccagtttggctggcctataaggtggctgcagaggggattaactacgccgatagaaaatggtgttttgacggcatcaagaataaccagattctcgaagagaacatggaagtcgagatctggaccaaagagggagaaaggaagaaactgaagcctcggtggcttgatgctcgcatatattccgaccccctagccctgaaggagttcaaagaatttgcagcgggcagaaagagtttgacattaaatctgatcactgagatggggaggctcccaacgttcatgacccagaaagcccggaacgctctggataatcttgccgtgctgcatacagcagaagctggaggtcgagcctacaaccacgcactcagcgagttgcctgagactctggaaaccctactgctccttacactgttagccaccgtaactggcgggattttcttgtttctgatgtcgggaaagggcatcggtaaaatgacgctcgggatgtgctgcattatcaccgcttctatactgctttggtatgcgcagattcaaccgcactggatcgccgcatccatcattctggagttctttctcatcgtgttgctgatacccgaaccagagaagcagagaacacctcaggacaatcagttaacttacgttgtcattgctatcctaaccgtggtggccgccacaatggcaaacgaaatgggcttcctggagaagaccaaaaaggacctcggacttggcagcattactacacaagagtcagaaagtaatatcctggatatagacttgcgccccgcttctgcctggacgctgtatgcggtcgctaccacttttgttacaccaatgctcaggcattccatcgagaacagctcagtgaatgtaagtctgaccgccattgcaaaccaggccaccgtgcttatggggctcggaaaaggttggcctctgagcaagatggatatcggcgtccccttgctggctattgggtgttactcccaggtgaatccgatcacattaactgcagccctactgctccttgttgcgcactacgctattatcggaccaggcctgcaggccaaagcaacgcgggaagcccaaaagcgtgctgccgcaggtataatgaagaaccctaccgtggacgggattacagtcatcgatttggagcccatcccatatgaccccaaattcgaaaagcagctgggccaggtaatgctcctgattctttgcgtgactcaggttttaatgatgagaaccacatgggctctgtgtgaggccctcaccttggcgactggacctatatctacgctgtgggagggcaatccggggaggttttggaacacaaccatcgccgtgagcatggcaaatattttccgcggatcctacctagctggcgccggtctgctcttttcaatcatgaaaaacactaccaatacacggcgagggactggaaacattggcgaaacccttggtgagaagtggaaatctagactgaacgcattgggcaagagtgaattccaaatctataaaaagtcggggatacaggaggtcgataggacactggctaaggagggaatcaaacgcggcgaaacggaccatcacgccgtgagccgggggtccgccaagctcagatggtttgtcgagcgtaatatggtgacccccgaaggaaaagttgtggatctgggctgcggtagggggggatggtcttactattgtggcggtttaaagaacgtacgggaggtgaaaggccttactaaggggggaccaggccatgaagagcctattcccatgtcaacatacgggtggaatctggtccgcctccagagcggagttgacgtgttctttacccctccagagaagtgcgatactctactgtgtgacatcggcgaatccagtcccaaccctacaattgaggcgggtcgaaccttgagagtcctgaatctcgtggaaaactggcttaataacaatacgcaattctgcatcaaagtactgaacccatatatgccctctgtgatagagaagatggaagctttgcagaggaaatacgggggagcactggttcggaatccgctcagccgcaactcaacccacgagatgtactgggtgtccaatgccacaggcaacattgtcagtagcgtgaatatgatctctagaatgttaatcaacaggttcactatgaagcacaaaaaggctacctatgagcctgatgtcgacctgggctccgggacacgaaacattggaatagaatcagagatcccaaatcttgacattatcggtaagcggattgaaaaaatcaagcaggagcatgaaactagctggcactacgatcaggaccatccctataaaacctgggcctaccacggctcgtatgagacaaagcaaaccgggtctgcaagttccatggtgaacggagttgtacgtctgctaactaaaccttgggatgtggtcccaatggtgacgcagatggccatgacagacaccactccctttggccagcagagagttttcaaggagaaggtggatacccgcacacaagaaccgaaagagggtacgaagaaactcatgaagataaccgctgaatggctgtggaaagagttggggaagaaaaagactcctaggatgtgtacacgggaggaatttaccagaaaggtccgcagcaatgcggccctgggagcaatcttcactgacgagaacaaatggaagtcagctagggaagccgtggaggatggccgattttgggaactcgtagaccgggagagaaatcttcacctggagggcaaatgcgaaacatgtgtgtacaacatgatggggaagagggagaaaaagttaggagaattcggtaaggcaaaaggctcccgcgccatttggtatatgtggctgggggctcgttttttggagttcgaagccctcggatttctgaatgaggatcattggttctctcggggcaacagcctaagtggtgttgagggggaaggacttcacagactgggctacatcctcagggacgtcggcaagaaagaggggggagcgatgtacgcagatgacaccgccggttgggacacacgcattactctggaagatttgaagaatgaggaaatggtgaccaaccatatgaaaggcgagcacaagaagctggctgaggccatctttaaactcacgtatcagaataaggtggtccgagttcagcggcccaccccaagagggacagtgatggacattatatccaggcgcgatcagagaggaagcggccaagtaggtacttacgggcttaacaccttcacaaatatggaagcacagctgatccggcagatggagggagaaggcatttttaaatctatccaacatttaactgctaccgaggagatcgccgtgcagaactggctggctagggtcggccgtgaacgattgtcacgcatggccattagtggggacgattgcgtggttaagcctatagacgatagattcgcatccgcgctcacggccctgaatgacatgggaaaagtgcggaaggatatccagcagtgggagcccagcaggggttggaacgactggacacaagtcccattctgctctcaccactttcatgaactagtgatgaaggatggccgcgtacttgttgtgccctgtagaaaccaggacgagctgattgggcgggctaggatctcgcagggagccggctggtcactcaaagaaaccgcatgcctgggtaagagctatgctcagatgtggactttgatgtacttccaccgacgtgatttaagactggccgcaaatgccatttgttccgcggtccctagtcattgggtgccaacatctcgcaccacttggagcatccacgctaaacacgagtggatgaccacagaggacatgctcgccgtgtggaaccgggtctggatacaagaaaatccgtggatggaggacaagacgcccgttgaatcctgggaggaagtgccttatcttgggaaaagggaggatcagtggtgcggatcactgatcggcctaaccagtagagcaacttgggccaagaacattcagacagctatcaatcaggtacgctctctgattggcaacgaggaatacaccgactatatgccaagcatgaagcggtttaggcgagaggaagaggaagccggggtgctctggtga

SEQ ID NO: 14532 - RNA, 9876 nt, synthetic construct
  misc_feature 1..9876: note = derived and/or modified CDS sequence (opt3) from DENV-2__HQ705625__SS-prME
  source 1..9876: mol_type = other RNA
acagccggcgtgatcgtaatgctgattccaacggctatggctttccacctcactacgagaaacggggaacctcatatgatagttggaaggcaggaaaagggtaaaagccttctgtttaagaccgaagacggcgtgaatatgtgcacattgatggccatcgatttaggggaactgtgtgaagacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatgaaaacggaggccaagcagcctgcgacccttcggaaatattgcatcgaagcaaagttgacaaacactaccacagagagtcgctgtccaactcaaggagagccctccctgaatgaagaacaggacaaacgatttatttgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccatcgttattactccacacagcggtgaggagcatgctgtgggcaatgacacggggaagcacggaaaagaaataaagatcacaccgcagtcctcaattaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatccagaaggagacacttgtgacgttcaagaaccctcatgccaaaaagcaagacgttgtggtcctgggctctcaggaaggggcgatgcacaccgccttgactggagcaacagagatacagatgtcctcaggtaatctactgtttaccggccatctcaaatgccgtctgcgcatggataaacttcaactgaaagggatgagctacagtatgtgtacaggaaagttcaagattgtgaaagaaatcgctgagactcagcacggcaccatcgtaattagagttcagtatgagggtgacgggtctccatgcaagatccccttcgaaattacggatttggagaaaaggcatgtgctcggccggctgataaccgtcaacccgatcgtgacagaaaaggactcccctgtcaacattgaggccgaacccccatttggagatagctacatcatcattggcgtggagcctgggcagttaaaactgaattggttcaagaagggatcgtctataggtcaaatgtttgagactaccatgcgaggcgctaaacgcatggccatcctaggggacacagcatgggatttcggatccctcggcggtgtttttacttcaattgggaaggccctgcaccaggtgttcggcgctatctacggagcggcatttagtggcgtaagctggaccatgaaaattcttatcggggtcataatcacgtggattggaatgaactccagatctactagcttgtcagtgagtctggttctcgtgggcgtcgtgaccctgtatcttggtgccgtagtgcaggctgactccgggtgtgttgtcagctggaagaataaagaactgaagtgcggatctggcatcttcattactgataacgtgcacacatggaccgagcagtacaagtttcaacccgaatcaccaagtaaattggccagcgcaatccagaaggcccatgaggaaggtatatgtggcattaggtccgtgactcggctcgagaatctgatgtggaaacagatcacccccgagttaaaccacattctgtctgaaaatgaggtcaagctaacaatcatgacgggggacataaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggttgaagactacggctttggtgtgttcaccacgaacatctggctcaagctgcgtgagaaacaggacgtgttttgtgattctaagttaatgagcgctgccattaaagacaatcgggcagtacacgccgatatggggtattggatcgaatccgctctgaacgacacatggaagatggagaaggcctcattcatagaggtcaaaagctgccactggcctaagtctcataccctttggtccaatggagtgttggaaagtgagatgattatccccaagaatttcgcaggccccgttagccagcacaactaccgacctggttatcatactcaaaccgctggcccatggcacctcgggaagctggaaatggattttgacttctgtgagggaacaactgtggtcgtgaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaattaggccacttaaggagaaggaagagaacttggttaatagtctggtgaccgcgggacatggccagatcgataactttagcttaggtgtactcggcatggccctgttccttgaagagatgctgcgcactcgaattgggacaaaacacgctatattgctcgtcgcagtgtcgtttgtgaccctgatcacgggaaatatgtccttccgggacctaggccgtgtcatggttatggtgggggccactatgaccgatgacattggaatgggcgtaacatatctggctctcctggccgcatttaaggtgagacccaccttcgcggccggtcttttgctgaggaaattaacttctaaggagctcatgatggctacaatcgggattgccctgcttagccagtcaaccatccctgaaacaatactggagctaactgatgcactcgctctgggaatgatggtcttgaaaatcgtgcgcaacatggaaaagtaccaactggccgttaccattatggcaatcagttgcgtgcccaatgccgtcattttacagaacgcttggaaggtgtcctgtacgatcctcgcggccgtttctgtgagcccactgcttctgacatcctcacagcagaaagcagactggatacctttggctctcaccattaagggcctgaatcccactgccatctttctaaccacactgagccggacaagtaaaaagagatcttggccacttaacgaggccatcatggctgtcggcatggtatccattctcgcaagctcgctgttgaaaaatgacataccgatgaccgggcctctggtggccggaggtttactcacggtttgctatgtgctgacaggcaggtcagcggatcttgaactggagcgagctgccgacgtcaagtgggaggatcaagcagaaatctctgggagttcccccattttgagcatcaccatttctgaggacggaagcatgtccatcaaaaacgaagaggaggaacagactctcacaatactgatccgcaccggcctactggtgatttcaggtgtattcccagtgagtatccccattactgccgctgcatggtacctttgggaggtcaagaagcagcgggccggggttctctgggatgtgcctagcccaccccctgtggaaaaagcggagctggaagacggagcttatagaatcaagcagaggggcatattgggctactctcaaattggggccggagtctataaagagggtacatttcacaccatgtggcatgtgacgcgtggcgcagttttaatgcaccgcgggaagcggatcgagccgtcctgggccgatgtcaaaaaggacctgatctcatacggaggcggttggaagctcgaaggggagtggaaagaaggagaggaagtgcaggtcctggctcttgagccaggcaagaatcccagagccgtgcagactaaacctggcattttcaagaccaacacagggaccatcggagcagttagtctggattttagcccaggtacatccggctctcccatagtggacaggaaagggaaggtcgtgggattgtacggcaatggtgtagtcactcgatcgggggcttatgtgagcgccattgcgcagaccgagaagtcaatcgaagataaccctgagattgaagacgatatcttccggaaaaagcgcctaacgataatggacctgcatccgggagccggcaaaacaaagagatacctccccgcaattgttagggaggctatcaaacggggcctgcgaactcttatcttagccccaaccagagtggtcgctgcagaaatggaggaggccctgcgcgggctccctattaggtatcaaacacccgccatcaagaccgaacacactggacgtgagattgtggacttgatgtgtcatgctaccttcacaatgcggctgctctccccagttagagtgcctaactacaatctgataatcatggatgaagcgcactttacggaccccgcaagtattgccgctaggggttatatctctactcgcgtcgagatgggcgaggccgcagggatcttcatgaccgccacaccaccgggaagccgagatccttttccccagtccaacgctccaattatggacgaagagagagaaatacccgagcggtcatggaactctggccacgaatgggtgaccgatttcaagggtaaaactgtatggtttgtgcctagcatcaaggcggggaacgacattgccgcatgccttaggaaaaatggaaagaaagttatccagctgagtcgcaagacattcgattccgagtacgtcaagacccgtgctaacgactgggattttgtggtgacgactgacattagcgagatgggcgccaatttcaaagcagaaagagtcatcgatccacggaggtgtatgaagcccgtaatattgacagacggcgaggaacgcgtgatcctagccgggcctatgccggttacccattcttcagctgcccaacgaagaggacggattggtaggaaccccaaaaatgagaacgaccagtatatctacatgggcgaacccctggagaatgatgaggactgcgcgcactggaaggaagcaaaaatgctcttagataacattaatacccctgaggggatcataccctccatgtttgaaccagagcgcgaaaaggtggacgccattgatggagagtacagactgaggggcgaggctcggaaaactttcgtcgaccttatgcgtcgcggtgatctgcctgtgtggctcgcctataaggttgctgcagaagggatcaactacgccgaccgaaagtggtgttttgatggcaccaaaaataaccagattttggaggaaaacatggaggtggagatctggaccaaggaaggagagaggaaaaagctgaaacccagatggctcgacgctcggatatatagtgatccactggcccttaaggagttcaaggagttcgcagcgggccgcaaaagcctaacactgaatttgatcactgaaatggggagattacctacgtttatgacccagaaggccaggaacgctctggacaatctcgccgtcctgcatacagcagaggctggaggtcgggcctacaaccacgcactttcggagctgccggaaactctcgagaccttgctgctactgacactccttgccaccgtgactggcgggattttcctgtttttaatgtctggaaaaggcatcggtaagatgacgttggggatgtgctgcattatcaccgcttccatactgctctggtatgcgcaaattcagccccactggatcgccgcaagcatcattctggagttctttcttatcgtactgctcataccagagcctgaaaaacagcgaacaccccaggataatcaattgacttacgtggttattgctatcctgaccgtcgtggccgccacaatggcaaacgagatgggcttcttagagaagaccaagaaagacctaggactgggctcaattactacacaggaaagtgagtctaatatcctcgacatagatcttagaccagcttccgcctggacgctgtatgcggtggctaccacttttgtcacacctatgttgcgccatagcatcgaaaactcaagtgttaatgtgagcctgaccgccattgcaaaccaggccaccgtactcatggggctgggaaagggttggcccctttccaaaatggacatcggcgtgccgctcctggctattgggtgttactctcaggtcaatccaatcacattgactgcagccctgttactactggtggcgcactacgctattatcggacctggcctccaagccaaggcaacgagggaggcccagaaacgggctgccgcaggtataatgaagaaccccaccgttgatgggattacagtgatcgaccttgaaccaatcccctatgatcctaagttcgagaaacagctgggccaggtcatgttgctgattctctgcgtaactcaagtgctgatgatgcgtaccacatgggctctttgtgaggccttaaccctggcgactggaccgataagcacgctctgggaaggcaatcccgggagattttggaacacaaccatcgccgtttccatggcaaatattttcaggggatcatacttggctggcgccggtctgctattttctatcatgaagaacactaccagtacacgccgggggactggaaatattggcgagaccctgggtgaaaaatggaagtcgcgactcaacgcacttggcaaaagcgagttccagatctataagaaatccgggatacaggaggtggacagaacactggctaaggaaggaatcaagaggggcgagacggatcatcacgccgtctctcgcgggtcagccaaattgcggtggtttgtggaaagaaacatggtcaccccagagggaaaggtggttgacctgggctgcggtcgtgggggatggagctactattgtggcggtctcaaaaatgtgagggaagtaaagggcctgactaaagggggacctggccatgaggagcccattcctatgtccacatacgggtggaacttagtgcggcttcaaagtggagtcgatgttttcttcaccccacccgaaaagtgcgacactctgctctgtgatatcggcgagtctagccctaatccaacaattgaagcgggtcgcaccctacgagtgctgaacttggtcgagaattggctgaacaataacacgcagttttgcatcaaggtgctcaatccctatatgccgtcagtaatagagaaaatggaggcacttcagagacagtacgggggagcactggtgaggaaccctttgtcccggaatagtacccacgagatgtactgggttagcaacgccacaggcaatattgtgtcttccgtcaacatgatctcacgcatgctgatcaatagattcactatgaagcacaaaaaggctacctatgaaccagacgtggatctcggcagcgggacaaggaacattggaatagagtcggaaatccccaacttagacattatcggtaaacgaattgagaagatcaagcaagaacatgagatatcttggcactacgaccaggatcatccttataaaacttgggcctaccacggcagttatgagaccaagcagacagggtccgcaagctcaatggtcaatggagtggttcggctgcttaccaaaccatgggacgtagtgcccatggtcactcagatggccatgacggatacaaccccgtttggccaacagcgtgtgttcaaggaaaaagttgacactagaacccaggagcctaaggaaggtacaaagaaactgatgaagatcacggctgagtggctatggaaagagctcgggaagaaaaagacaccacgcatgtgtactagggaagagtttaccaaaaaggtgcggtccaacgcggccctgggagcaattttcaccgatgaaaataagtggaaatctgctagagaggccgtcgaagacggccgcttttgggagttggtggatagggagcgaaacctgcacctcgaaggcaagtgcgagacttgtgtatacaatatgatggggaaacgggaaaagaaacttggagagttcggtaaggcaaagggcagcagagccatctggtatatgtggctgggggctaggtttttagagttcgaggccctgggatttttgaacgaggaccattggttcagtcgcggcaattccctcagcggtgtggaaggggagggactgcaccgtctaggctacattcttcgggatgttggcaaaaaggaagggggagcgatgtacgcagacgatacagccggttgggacaccagaatcacactggaggacctcaaaaacgaagagatggtcactaatcatatgaagggcgagcacaaaaagctggctgaagccatttttaagttgacctatcagaacaaagtggtgagggtccaacgcccaacgcctcgagggaccgttatggatataatctctcggagagaccagaggggatcaggccaggtgggtacatacgggctgaatactttcaccaacatggaggcacaactcattcgccagatggaaggagagggcatcttcaagagtatccagcatcttacagctactgaggaaattgccgtacagaattggctggctagagtgggccgggagaggttatcccgtatggccataagcggggatgactgcgtcgtgaaacccatcgatgaccgatttgcatctgcgctgaccgccttgaacgatatgggaaaggttcgcaaagacattcaacagtgggaaccatcgagaggttggaatgattggacacaggtgcccttctgctcacaccactttcatgagctcgtcatgaaggacggccgggtgctggtagttccttgtaggaaccaggatgaactaatcgggcgcgctagaattagccaaggagccggctggtcccttaaggagacagcatgcctgggtaaaagttatgctcagatgtggaccctcatgtacttccaccggagggacctgcgattggccgcaaacgccatctgttctgcggtgccaagccattgggtcccgacttcccgtacaacctggtcaatacacgctaagcacgagtggatgactaccgaagatatgttagccgtgtggaatagagtgtggatccaggagaacccctggatggaagacaaaacacctgtcgagagttgggaagaggttccatatctggggaagcgcgaggaccagtggtgcggatctctcattggccttacgagccgggcaacctgggccaaaaatatccaaactgctattaaccaggtgaggtccctgatcggcaatgaagagtacacagattatatgccctcaatgaagagatttcgccgggaagaggaagaggccggggtactatggtga

SEQ ID NO: 14533 - RNA, 9876 nt, synthetic construct
  misc_feature 1..9876: note = derived and/or modified CDS sequence (opt3) from DENV-2__JF730052__SS-prME
  source 1..9876: mol_type = other RNA
acagccggcgtgatcgtaatgctgattccaacagctatggctttccacctcactacgagaaacggggaacctcatatgatagttggaaggcaggaaaagggtaaaagccttctgtttaagaccgaagacggcgtgaatatgtgcacattgatggccatcgatttaggggaactgtgtgaagacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccacatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatgaaaacggaggccaagcagcctgcgacccttcggaaatattgcatcgaagcaaagttgacaaacactaccacagagagtcgctgtccaactcaaggagagccctccctgaatgaagaacaggacaaacgatttatttgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccatcgttattactccacacagcggtgaggagcatgctgtgggcaatgacacggggaagcacggaaaagaaataaagatcacaccgcagtcctcaattaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatccagaaggagacacttgtgacgttcaagaaccctcatgccaaaaagcaagacgttgtggtcctgggctctcaggaaggggcgatgcacaccgccttgactggagcaacagagatacagatgtcctcaggtaatctactgtttaccggccatctcaaatgccgtctgcgcatggataaacttcaactgaaagggatgagctacagtatgtgtacaggaaagttcaagattgtgaaagaaatcgctgagactcagcacggcaccatcgtaattagagttcagtatgagggtgacgggtctccatgcaagatccccttcgaaattacggatttggagaaaaggcatgtgctcggccggctgataaccgtcaacccgatcgtgacagaaaaggactcccctgtcaacattgaggccgaacccccatttggagatagctacatcatcattggcgtggagcctgggcagttaaaactgaattggttcaagaagggatcgtctataggtcaaatgtttgagactaccatgcgaggcgctaaacgcatggccatcctaggggacacagcatgggatttcggatccctcggcggtgtttttacttcaattgggaaggccctgcaccaggtgttcggcgctatctacggagcggcatttagtggcgtaagctggaccatgaaaattcttatcggggtcataatcacgtggattggaatgaactccagatctaccagcttgtcagtgagtctggttctcgtgggcgtcgtgaccctgtatcttggtgccgtagtgcaggctgactccgggtgtgttgtcagctggaagaataaagaactgaagtgcggatctggcatcttcattactgataacgtgcacacatggaccgagcagtacaagtttcaacccgaatcaccaagtaaattggccagcgcaatccagaaggcccatgaggaaggtatatgtggcattaggtccgtgactcggctcgagaatctgatgtggaaacagatcacccccgagttaaaccacattctgtctgaaaatgaggtcaagctaacaatcatgacgggggacataaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggttgaagactacggctttggtgtgttcaccacgaacatctggctcaagctgcgtgagaaacaggacgtgttttgtgattctaagttaatgagcgctgccattaaagacaatcgggcagtacacgccgatatggggtattggatcgaatccgctctgaacgacacatggaagatggagaaggcctcattcatagaggtcaaaagctgccactggcctaagtctcataccctttggtccaatggagtgttggaaagtgagatgattatccccaagaatttcgcaggccccgttagccagcacaactaccgacctggttatcatactcaaaccgctggcccatggcacctcgggaagctggaaatggattttgacttctgtgagggaacaactgtggtcgtgaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaattaggccacttaaggagaaggaagagaacttggttaatagtctggtgaccgcgggacatggccagatcgataactttagcttaggtgtactcggcatggccctgttccttgaagagatgctgcgcactcgaattgggacaaaacacgctatattgctcgtcgcagtgtcgtttgtgaccctgacgactggaaatatgtccttccgggacctaggccgtgtcatggttatggtgggggccaccatgacagatgacatcggaatgggcgtaacctatctggctctcctggccgcatttaaggtgagacccactttcgcggccggtcttttgctgaggaaattaacatctaaggagctcatgatggctaccattgggatcgccctgcttagccagtcaacaattcctgaaactatcctggagctaaccgatgcactcgctctgggaatgatggtcttgaaaatagtgcgcaacatggaaaagtaccaactggccgttacgatcatggcaattagttgcgtgcccaatgccgtcatcttacagaacgcttggaaggtgtcctgtacaattctcgcggccgtttctgtgagcccactgcttctgacctcctcacagcagaaagcagactggatccctttggctctcactataaagggcctgaatcccaccgccatttttctaacaactctgagccggaccagtaaaaagagatcttggccacttaacgaggccatcatggctgtcggcatggtatccatcctcgcaagctcgctgttgaaaaatgacattccgatgacggggcctctggtggccggaggtttactcacagtttgctatgtgctgaccggcaggtcagcggatcttgaactggagcgagctgccgacgtcaagtgggaggatcaagcagaaatatctgggagttcccccatcttgagcattactatctctgaggacggaagcatgtccattaaaaacgaagaggaggaacagacactcaccatcctgatacgcactggcctactggtgatctcaggtgtattcccagtgagtattcccatcacagccgctgcatggtacctttgggaggtcaagaagcagcgggccggggttctctgggatgtgcctagcccaccccctgtggaaaaagcggagctggaagacggagcttatagaattaagcagaggggcatcttgggctactctcaaataggggccggagtctataaagagggtacctttcacacgatgtggcatgtgactcgtggcgcagttttaatgcaccgcgggaagcggattgagccgtcctgggccgatgtcaaaaaggacctgatctcatacggaggcggttggaagctcgaaggggagtggaaagaaggagaggaagtgcaggtcctggctcttgagccaggcaagaatcccagagccgtgcagaccaaacctggcatcttcaagacaaacaccgggacaattggagcagttagtctggattttagcccaggtacttccggctctcccatcgtggacaggaaagggaaggtcgtgggattgtacggcaatggtgtagtcacccgatcgggggcttatgtgagcgccatagcgcagacggagaagtcaattgaagataaccctgagatcgaagacgatattttccggaaaaagcgcctaacaatcatggacctgcatccgggagccggcaaaactaagagatacctccccgcaatagttagggaggctattaaacggggcctgcgaacccttatcttagccccaacaagagtggtcgctgcagaaatggaggaggccctgcgcgggctccctatcaggtatcaaacccccgccattaagactgaacacaccggacgtgagatcgtggacttgatgtgtcatgctacattcacgatgcggctgctctccccagttagagtgcctaactacaatctgattataatggatgaagcgcactttactgaccccgcaagtatcgccgctaggggttatatttctacccgcgtcgagatgggcgaggccgcagggatcttcatgacagccaccccaccgggaagccgagatccttttccccagtccaacgctccaatcatggacgaagagagagaaattcccgagcggtcatggaactctggccacgaatgggtgactgatttcaagggtaaaacagtatggtttgtgcctagcataaaggcggggaacgacatcgccgcatgccttaggaaaaatggaaagaaagttattcagctgagtcgcaagaccttcgattccgagtacgtcaagacgcgtgctaacgactgggattttgtggtgactacagacatcagcgagatgggcgccaatttcaaagcagaaagagtcattgatccacggaggtgtatgaagcccgtaatcttgaccgacggcgaggaacgcgtgatactagccgggcctatgccggttacccattcttcagctgcccaacgaagaggacggatcggtaggaaccccaaaaatgagaacgaccagtatatttacatgggcgaacccctggagaatgatgaggactgcgcgcactggaaggaagcaaaaatgctcttagataacatcaatactcctgaggggattatcccctccatgtttgaaccagagcgcgaaaaggtggacgccatagatggagagtacagactgaggggcgaggctcggaaaacattcgtcgaccttatgcgtcgcggtgatctgcctgtgtggctcgcctataaggttgctgcagaagggattaactacgccgaccgaaagtggtgttttgatggcaccaaaaataaccagatcttggaggaaaacatggaggtggagatttggacaaaggaaggagagaggaaaaagctgaaacccagatggctcgacgctcggatctatagtgatccactggcccttaaggagttcaaggagttcgcagcgggccgcaaaagcctaactctgaatttgataacggaaatggggagattacctacctttatgacacagaaggccaggaacgctctggacaatctcgccgtcctgcatactgcagaggctggaggtcgggcctacaaccacgcactttcggagctgccggaaaccctcgagacattgctgctactgaccctccttgccactgtgacgggcgggatcttcctgtttttaatgtctggaaaaggcattggtaagatgaccttggggatgtgctgcatcattacagcttccatcctgctctggtatgcgcaaatacagccccactggattgccgcaagcatcatcctggagttctttcttattgtactgctcatcccagagcctgaaaaacagcgaactccccaggataatcaattgacctacgtggttatagctattctgacagtcgtggccgccaccatggcaaacgagatgggcttcttagagaagactaagaaagacctaggactgggctcaatcacaacgcaggaaagtgagtctaatattctcgacatcgatcttagaccagcttccgcctggaccctgtatgcggtggctactacatttgtcacccctatgttgcgccatagcatagaaaactcaagtgttaatgtgagcctgaccgccatcgcaaaccaggccacagtactcatggggctgggaaagggttggcccctttccaaaatggacattggcgtgccgctcctggctatcgggtgttactctcaggtcaatccaattactttgacggcagccctgttactactggtggcgcactacgctatcattggacctggcctccaagccaaggcaaccagggaggcccagaaacgggctgccgcaggtatcatgaagaaccccacagttgatgggataactgtgattgaccttgaaccaatcccctatgatcctaagttcgagaaacagctgggccaggtcatgttgctgatcctctgcgtaacccaagtgctgatgatgcgtacaacctgggctctttgtgaggccttaactctggcgacgggaccgattagcacactctgggaaggcaatcccgggagattttggaacaccactatagccgtttccatggcaaatatcttcaggggatcatacttggctggcgccggtctgctattttctattatgaagaacaccacaagtactcgccgggggaccggaaatatcggcgagacactgggtgaaaaatggaagtcgcgactcaacgcacttggcaaaagcgagttccagatttataagaaatccgggatccaggaggtggacagaacgctggctaaggaaggaataaagaggggcgagaccgatcatcacgccgtctctcgcgggtcagccaaattgcggtggtttgtggaaagaaacatggtcactccagagggaaaggtggttgacctgggctgcggtcgtgggggatggagctactattgtggcggtctcaaaaatgtgagggaagtaaagggcctgacaaaagggggacctggccatgaggagcccatccctatgtccacctacgggtggaacttagtgcggcttcaaagtggagtcgatgttttcttcactccacccgaaaagtgcgacacactgctctgtgatattggcgagtctagccctaatccaaccatcgaagcgggtcgcacgctacgagtgctgaacttggtcgagaattggctgaacaataacacccagttttgcattaaggtgctcaatccctatatgccgtcagtaatcgagaaaatggaggcacttcagagacagtacgggggagcactggtgaggaaccctttgtcccggaatagtacacacgagatgtactgggttagcaacgccactggcaatatagtgtcttccgtcaacatgatttcacgcatgctgatcaatagattcaccatgaagcacaaaaaggctacatatgaaccagacgtggatctcggcagcgggactaggaacatcggaattgagtcggaaatacccaacttagacatcattggtaaacgaatcgagaagattaagcaagaacatgagatctcttggcactacgaccaggatcatccttataaaacctgggcctaccacggcagttatgagacaaagcagaccgggtccgcaagctcaatggtcaatggagtggttcggctgcttactaaaccatgggacgtagtgcccatggtcacgcagatggccatgacagataccactccgtttggccaacagcgtgtgttcaaggaaaaagttgacaccagaacacaggagcctaaggaaggtacgaagaaactgatgaagataaccgctgagtggctatggaaagagctcgggaagaaaaagactccccgcatgtgtacaagggaagagtttaccaaaaaggtgcggtccaacgcggccctgggagcaatcttcactgatgaaaataagtggaaatctgctagagaggccgtcgaagacggccgcttttgggagttggtggatagggagcgaaacctgcacctcgaaggcaagtgcgagacatgtgtatacaatatgatggggaaacgggaaaagaaacttggagagttcggtaaggcaaagggcagcagagccatttggtatatgtggctgggggctaggtttttagagttcgaggccctgggatttttgaacgaggaccattggttcagtcgcggcaattccctcagcggtgtggaaggggagggactgcaccgtctaggctacatccttcgggatgttggcaaaaaggaagggggagcgatgtacgcagacgataccgccggttgggacacaagaattactctggaggacctcaaaaacgaagagatggtcaccaatcatatgaagggcgagcacaaaaagctggctgaagccatctttaagttgacgtatcagaacaaagtggtgagggtccaacgcccaacccctcgagggacagttatggatattatatctcggagagaccagaggggatcaggccaggtgggtacttacgggctgaataccttcacaaacatggaggcacaactcatccgccagatggaaggagagggcattttcaagagtatccagcatcttactgctaccgaggaaatcgccgtacagaattggctggctagagtgggccgggagaggttatcccgtatggccattagcggggatgactgcgtcgtgaaacccatagatgaccgatttgcatctgcgctgacggccttgaacgatatgggaaaggttcgcaaagacatccaacagtgggaaccatcgagaggttggaatgattggacacaggtgcccttctgctcacaccactttcatgagctcgtcatgaaggacggccgggtgctggtagttccttgtaggaaccaggatgaactaattgggcgcgctagaatcagccaaggagccggctggtcccttaaggagaccgcatgcctgggtaaaagttatgctcagatgtggactctcatgtacttccaccggagggacctgcgattggccgcaaacgccatttgttctgcggtgccaagccattgggtcccgacatcccgtaccacttggtcaatccacgctaagcacgagtggatgaccacagaagatatgttagccgtgtggaatagagtgtggatacaggagaacccctggatggaagacaaaacgcctgtcgagagttgggaagaggttccatatctggggaagcgcgaggaccagtggtgcggatctctcatcggccttaccagccgggcaacttgggccaaaaatattcaaacagctatcaaccaggtgaggtccctgattggcaatgaagagtacaccgattatatgccctcaatgaagagatttcgccgggaagaggaagaggccggggtactatggtga

SEQ ID NO: 14534 - RNA, 9876 nt, synthetic construct
  misc_feature 1..9876: note = derived and/or modified CDS sequence (opt3) from DENV-2__EU482748__SS-prME
  source 1..9876: mol_type = other RNA
accgccggcgtgatagtcatgctgattccaactgctatggcattccacctcactacgagaaacggggaacctcatatgatagttggaaggcaggaaaagggtaaaagccttctgtttaagaccgaggacggcgtgaatatgtgcacattgatggccatcgatttaggggaactgtgtgaggaaactattacctacaaatgcccactactccggcaaaacgagccggaggacatcgattgttggtgcaattccacatctacctgggtaacttatggaacatgtaccacgactggcgaacaccgccgagagaagcgttcagtggcgctggtcccccatgtgggtatggggcttgaaaccagaacagagacttggatgagtagcgagggagcttggaaacacgttcagaggattgaaacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggactttgtcgagggagtgtcgggtggctcatgggtagatattgttctcgaacacgggagctgtgtgactacaatggctaagaataagcccaccttagacttcgagctgatcaaaacggaagccaagcagcctgcgacccttcggaaatattgcattgaggcaaagttgacaaacactaccacagagagtcgctgtccaactcaaggagaaccctccctgaatgaggaacaggataaacgatttatctgcaagcattctatggtcgacagaggctggggtaacgggtgtggactattcggcaagggcgggatcgtgacctgcgccatgtttacatgcaaaaagaatatggagggaaaagtggtccagcctgaaaacctcgagtacaccattgttataactccacacagcggtgaggaacatgctgtgggcaatgatacggggaagcacggaaaagagatcaagattacaccgcagtcctcaatcaccgaagccgagctgactggctatggtaccgtaacaatggaatgtagtcccaggaccgggcttgacttcaacgagatggtgctgttgcaaatggaggataaagcatggctcgtccaccggcagtggtttctggacttacctctgccatggctccccggcgctgatactcagggaagcaattggatacagaaggaaacacttgtgacgttcaagaaccctcatgccaaaaagcaagacgttgtggtcctgggctctcaggagggggcgatgcacaccgccttgactggagcaacagaaattcagatgtcctcaggtaatctactgtttaccggccatctcaaatgccgtctgcgcatggacaaacttcaactgaaagggatgagctacagtatgtgtacaggaaagttcaagatcgtgaaagagatcgctgagactcagcacggcaccattgtaatcagagttcagtatgaaggtgatgggtctccatgcaagattcccttcgagataacggacttggagaagaggcatgtgctcggccggctgatcaccgtcaacccgattgtgacagagaaggattcccctgtcaacatcgaagccgagcccccatttggagacagctacatcattataggcgtggagcctgggcagttaaaactgaattggttcaagaagggatcgtctatcggtcaaatgtttgaaactaccatgcgaggcgctaaacgcatggccattctaggggatacagcatgggacttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgattccgggtgtgtggttagctggaagaataaagagctgaagtgcggatctggcattttcatcactgacaacgtccacacatggaccgaacagtacaagtttcaacccgagtcaccaagtaaattggccagcgcaatacagaaggcccatgaagagggtatttgtggcatcaggtccgtgactcggctcgagaatctgatgtggaaacagattacccccgaattaaaccacatcctgtctgagaatgaagtgaagctaacaataatgacgggggatatcaaaggaattatgcaggctggcaagcgctcgctcagacctcaaccaaccgagctgaaatatagctggaagacttgggggaaggccaaaatgctttccacagaatcacataaccagaccttcttgatcgacggaccggagacagcagagtgccccaatactaacagggcgtggaatagtctggaagtcgaggattacggctttggtgttttcaccacgaacatttggctcaagctgcgtgaaaaacaggacgtgttttgtgactctaagttaatgagcgctgccatcaaagataatcgggcagtgcacgccgacatggggtattggatagagtccgctctgaacgatacatggaagatggagaaggcctcattcattgaagtaaaaagctgccactggcctaagtctcataccctttggtccaatggagtcttggagagtgaaatgatcatccccaaaaatttcgcaggccccgtgagccagcacaactaccgacctggttatcatactcaaaccgctggcccatggcacctcgggaagctggagatggactttgatctatgtgaaggaacaactgttgtggtcaccgaggactgcggcaatagagggccctctctgaggacaacgaccgcctccggaaaactcattactgagtggtgctgtcgctcatgcacactgccgcctcttcggtacagaggcgaagatggttgttggtacgggatggagatcaggccattgaaggaaaaggaggaaaacctggtgaatagtttagttaccgcgggacatggccagattgacaacttcagcctcggtgtgctgggcatggccctttttctggaggagatgttgcgcactcgaatagggacaaaacacgctatcctcctggtagcagtctcgttcgtgaccctaattacgggaaatatgtcctttcgggatctgggccgtgtgatggtcatggttggggccactatgaccgacgatatcggaatgggcgtgacatatctcgctctgcttgccgcattcaaggtaagacccacctttgcggccggtttgctgttaaggaaactcacttctaaggaactgatgatggctacaattgggatcgcccttctgagccagtcaaccatacctgagacaatcctagaactcactgacgcactggctttgggaatgatggtgctgaaaattgtccgcaacatggagaagtaccaattagccgtgaccatcatggcaattagttgcgttcccaatgccgtgatcctccagaacgcttggaaggtctcctgtacgatactggcggccgtgtctgttagcccacttctgttgacatcctcacagcagaaagcagattggattcctctcgctctgaccatcaagggcctaaatcccactgccatcttcctgaccacacttagccggacaagtaaaaagagatcttggccactcaacgaagccattatggctgtgggcatggtctccatactggcaagctcgttgctgaaaaatgacatcccgatgaccgggcctttagtagccggaggtctcctgacggtgtgctatgttcttacaggcaggtcagcggacctggagttggagcgagctgccgatgtgaagtgggaagaccaagcagagatttctgggagttcccccatcctcagcattaccatctctgaagatggaagcatgtccatcaaaaacgaggaggaagaacagactctgacaatcctaattcgcaccggcctgcttgtcatctcaggtgtgtttccagtaagtattcccatcactgccgctgcatggtacctctgggaagtgaagaagcagcgggccggggtcctgtgggacgttcctagcccaccccctgtggagaaagcggaattggaggatggagcttatagaataaagcagaggggcattttaggctactctcaaatcggggccggagtgtataaagagggtacattccacaccatgtggcatgtcacgcgtggcgcagtgctgatgcaccgcgggaagcggatcgaaccgtcctgggccgacgttaaaaaggatctcatttcatacggaggcggttggaagctggagggggaatggaaagagggagaagaggtacaggtgcttgctctggagccaggcaagaatcccagagccgtccagactaaacctggcatctttaagaccaacacagggaccataggagcagtgagtttggacttcagcccaggtacatccggctctcccattgttgataggaaagggaaggtggtcggactatacggcaatggtgtggtaactcgatcgggggcttatgtcagcgccatcgcgcagaccgaaaagtcaattgaggacaaccctgaaatcgaggatgacatatttcggaaaaagcgcctgacgattatggatctccatccgggagccggcaaaacaaagagatacctgcccgcaatcgtgagggaagctatcaaacggggccttcgaactttaattctggccccaaccagagttgtggctgcagagatggaggaagccctccgcgggttgcctatcaggtatcaaacacccgccattaagaccgagcacactggacgtgaaatagtcgacctgatgtgtcatgctaccttcacaatgcggctcctgtccccagtgagagttcctaactacaatcttatcattatggacgaggcgcacttcacggatcccgcaagtatcgccgctaggggttatatctctactcgcgtggagatgggcgaagccgcagggatttttatgaccgccacaccaccgggaagccgagaccctttcccccagtccaacgctccaataatggatgaggaaagagagatccccgaacggtcatggaactctggccacgagtgggtcaccgactttaagggtaaaactgtgtggttcgtacctagcattaaggcggggaacgatatcgccgcatgcctgaggaaaaatggaaagaaagtgattcagttgagtcgcaagacatttgactccgagtacgttaagacccgtgctaacgattgggacttcgtcgtgacgactgatatcagcgaaatgggcgccaattttaaagcagagagagtgatagacccacggaggtgtatgaagcccgtcatcctaacagatggcgaagaacgcgtaattctggccgggcctatgccggtgacccattcttcagctgcccaacgaagaggacggatcggtaggaaccccaaaaatgaaaacgaccagtatatttacatgggcgagcccctcgagaatgacgaagattgcgcgcactggaaggaggcaaaaatgttactggacaacatcaatacccctgaagggataattccctccatgttcgagccagaacgcgagaaggttgatgccatcgacggagagtacagacttaggggcgaagctcggaaaacttttgtggatctgatgcgtcgcggtgacctccctgtctggttggcctataaggtggctgcagaggggattaactacgccgatcgaaagtggtgtttcgacggcatcaaaaataaccagatactggaagagaacatggaggttgaaatctggacaaaggagggagaaaggaaaaagctcaaacccagatggctggatgctcggatttatagtgacccacttgccctaaaggagtttaaggagttcgcagcgggccgcaaaagcctgaccttgaatttaatcacagagatggggagactgcctactttcatgacgcagaaggccaggaacgctctcgataatctggccgtgcttcataccgcagaggctggaggtcgggcctacaaccacgcactgtcggaactcccggagacattggaaactctgctactgctcacccttctggccacagtcaccggcgggatatttttattcttgatgtctggaaaaggcatcggtaagatgactctggggatgtgctgcataattacggcttccatcctcctgtggtatgcgcaaatccagccccactggattgccgcaagcatcatacttgagtttttcctgattgtgctcttgatcccagaacctgagaaacagcgaaccccacaggacaatcaactgacatacgtagtgattgctatcttaactgttgtcgccgccaccatggcaaacgagatgggctttctagaaaagacaaagaaagatctgggactcggctcaataaccactcaggagagtgaatctaatatccttgacattgacctgagaccagcttccgcctggacattgtatgcggtggctacgaccttcgtgactcctatgctgcgccatagcatcgagaactcaagtgtcaatgttagcctcacagccattgcaaaccaggccaccgtgctgatggggcttggaaagggttggcccctctccaaaatggatatcggcgtaccgctgttggctattgggtgttactctcaggtgaatccaatcaccctgacagcagccttactactgctcgtcgcgcactacgctataattggacctggccttcaagccaaggcaactagggaagcccagaaacgggctgccgcaggtatcatgaagaaccccacggtggacgggatcaccgttattgatctggagccaataccctatgaccctaagtttgagaaacagttgggccaggtgatgctgctcatcctgtgcgtcacacaagtacttatgatgcgtactacctgggctttatgtgaagccctgacactcgcgaccggaccgattagcactttgtgggagggcaatcccgggagattctggaacacgacaatcgccgtgtccatggcaaatatttttaggggatcatacctggctggcgccggtctactgttctctatcatgaagaacaccacaagtacccgccgggggacaggaaatataggcgaaactctcggtgagaaatggaagtcgcgacttaacgcactgggcaaaagcgagtttcagatctataagaaatccgggattcaggaagttgatagaaccttggctaaggagggaatcaagaggggcgaaacagaccatcacgccgtgtctcgcgggtcagccaaactgcggtggttcgtcgagagaaacatggtgacgccagaaggaaaggtcgtggatctcggctgcggtcgtgggggatggagctactattgtggcggtctgaaaaatgttagggaggtgaagggcttaaccaaagggggacctggccatgaggaacccattcctatgtccacttacgggtggaaccttgtacggctgcaaagtggagtggacgtctttttcacaccacccgagaagtgcgataccctcctatgtgacatcggcgaatctagccctaatccaactatagaggcgggtcgcacactgcgagttttgaacctggtggaaaattggctcaacaataacacccagttctgcattaaggtccttaatccctatatgccgtcagtgatcgagaaaatggaggctctgcagagaaagtacgggggagcattggtaaggaaccctctgtcccggaatagtacgcacgaaatgtactgggtgagcaacgccaccggcaatatcgtttcttccgtgaacatgatttcacgcatgctcataaatagatttacaatgaaacacaagaaaactacctatgagccagatgtcgacttaggcagcgggacaaggaacatcggaattgaatcggagatccccaacctggatattatcggtaagcgaatagaaaagatcaaacaggagcatgagacttcttggcactacgaccaagaccatccttataagacctgggcttaccacggcagttatgaaacaaaacagaccgggtccgccagctcaatggtgaatggagtcgtgcggcttctgactaagccatgggatgttgtacccatggtgacgcagatggcaatgacagacaccactccgttcggccagcaacgtgtctttaaagagaaggtggataccagaacacaggaacctaaggagggtacgaaaaagctaatgaaaattaccgccgagtggctctggaaggaactggggaaaaagaaaactccccgcatgtgtacaagggaggagttcacccggaaggttagatccaacgctgcgttgggagccatctttactgacgagaataagtggaaatctgcacgcgaagctgtggaggatggcaggttctgggagctggtcgaccgagaacggaacctccaccttgagggcaagtgcgaaacatgtgtgtacaatatgatggggaaaagagagaagaaactgggagaatttggtaaggccaagggcagcagggcaatttggtatatgtggttaggggcccgcttcctggagtttgaggctttgggattcctcaacgaagatcattggtttagtcgtggcaattccctgagcggtgtagagggggaaggactacaccggcttggctacatcctgagagacgtgtctaaaaaggagggcggggccatgtacgcggatgacaccgcaggatgggatacaaggattactctcgaagacctgaaaaacgaggagatggttaccaatcatatgaagggtgaacacaaaaagttggccgaggctatattcaagctgacgtatcagaacaaagtcgtgcgcgtgcagcgaccaacccctcggggcacagtcatggacatcatttcaagaagggatcaacgcgggagtggacaggttggcacttacggtctcaatacctttacaaacatggaagcccagcttatcagacaaatggagggggagggaatcttcaagtccattcagcatctgactgcaaccgaagagatagtggtacagaattggttagctcgggtgggcagggaacgtctgagccgaatggccatctctggcgacgattgcgtcgtgaaacccattgacgatcgcttcgcttcggccttgacggcactcaacgacatggggaaggttagaaaagatatccagcaatgggagccatcacggggatggaatgactggacacaggtgcccttttgcagccaccacttccatgaactggtcatgaaggatggtagggtgctagtagttccttgtcgcaaccaggacgagcttattggcagagcgcggatctcccagggggccggatggagtctgaaggagaccgcttgcctcggcaaatcttatgcccaaatgtggactctgatgtactttcacaggcgagatttgcgtttagcagctaacgccatatgtagcgcagtgccatcccattgggtcccgacatcaagaaccacttggagtatccacgccaagcacgaatggatgaccacagaggacatgctggcggtgtggaatcgcgtgtggattcaggaaaacccctggatggaggataaaacgcctgtcgaatcttgggaggaggttccatatctcggtaagcgggaagaccagtggtgcgggagccttatcggactgacctccagggctacttgggccaaaaatattcagacagcaatcaaccaagtgagatcactaataggcaatgaggaatacaccgactatatgcccagcatgaagcgcttccggagggaggaagaggaggccggcgtactgtggtga

SEQ ID NO: 14535 - RNA, 9876 nt, synthetic construct
  misc_feature 1..9876: note = derived and/or modified CDS sequence (opt3) from DENV-2__EU482749__SS-prME
  source 1..9876: mol_type = other RNA
accgccggagtgatcgtcatgctgattcccacagctatggcattccacctcactacgagaaatggggaacctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaccattgagacatggatcctgaggcatcctggcttcaccattatggccgcaatcttggcctacacgattggcactacacactttcagcgggctctcatcttcattctgctgaccgcagtggccccatccatgactatgcgctgcatcgggatatctaacagagattttgtcgaaggagtgtcgggtggctcatgggtagacattgttctcgagcacgggagctgtgtgacaaccatggctaagaataagcccacgttagatttcgaactgatcaaaaccgaggccaagcagcctgcgacacttaggaaatattgcattgaagcaaagttgactaacaccacaactgagagtcggtgtccaacccaaggagagccctccctgtctgaggaacaggacaaacgctttatctgcaagcatagcatggtcgatcgaggctggggtaatgggtgtggactattcggcaagggcgggatcgtgacatgcgccatgtttacctgcaaaaagaacatggaaggaaaagtggtccagcctgagaatctcgaatacactattgttataacgccacactccggtgaggagcatgctgtgggcaacgacacagggaagcacggaaaagaaatcaagattaccccgcagtcaagtatcactgaggccgaactgaccggctatggtacagtaaccatggagtgtagccccagaactgggcttgatttcaatgaaatggtgctgttgcaaatggaggacaaagcatggctcgtccacaggcagtggtttctggatttacctctgccatggctccccggcgctgacacacagggatctaactggatacagaaggagacgcttgtgaccttcaagaatcctcatgccaaaaagcaagacgttgtggtcctgggctcccaggaaggggcgatgcacactgccttgacaggagcaaccgagattcagatgtcaagcggtaacctactgtttacaggccatctcaaatgccggctgcgtatggataaacttcaactgaaagggatgagttactctatgtgtactggaaagttcaagatcgtgaaagaaatcgctgagacccagcacggcacgattgtaatccgcgttcagtatgagggtgacgggtccccatgcaagattcccttcgaaataaccgatttggagaaaagacatgtgctcggcaggctgatcacagtcaatccgattgtgactgaaaaggacagccctgtcaacatcgaggccgaacccccatttggagattcgtacatcattataggcgtggagcctgggcagttaaaactgaactggttcaagaagggatcttccatcggtcaaatgtttgagaccacaatgcggggcgctaaacgaatggccattctaggggacactgcatgggatttcggatcactcggcggtgtttttaccagtatcgggaaggccctgcaccaggtgttcggcgctatttacggagcggcatttagcggcgtatcctggacgatgaaaatccttataggggtcatcattacatggatcggaatgaactctcgcagcacctcattgagtgtgtccctggttctcgtgggcgtcgtgactctgtatcttggtgccatggtacaggctgacagcgggtgtgtggtttcttggaagaacaaagaactgaagtgcggatcaggcattttcatcacagataatgtccacacctggactgagcagtacaagtttcaacccgaaagtccaagcaaattggcctccgcaatacagaaggcccatgaggaaggtatttgtggcatcagatctgtgaccaggctcgagaacctgatgtggaaacagattacacccgagttaaatcacatcctgtcggaaaacgaggtgaagctaacgataatgaccggggacatccggggaattatgcaggctggcaaacgcagcctcagacctcaaccaactgaactgaagtattcctggaaaacatgggggaaggccaagatgctttcaaccgagagtcataatcagacattcttgatcgatggaccggaaactgcagagtgccccaacaccaatagggcgtggaactctctggaggtcgaagactacggctttggtgttttcacgacaaatatttggctcaaactgcgtgagaagcaggacgtgttttgtgatagcaaattaatgtccgctgccatcaaggacaaccgggcagtgcacgccgatatggggtattggatagaatcagctctgaatgacacctggaaaatggagaaggccagcttcattgaggtaaagtcttgccactggcctaaatcccatactctttggagtaacggagtcttggaaagcgagatgatcatcccaaagaatttcgcaggccccgtgtctcagcacaactaccgacctggttatcatacccaaacagctggcccatggcacctcgggaaactggaaatggattttgacctatgtgagggaactaccgttgtggtcacagaagattgcggcaacagagggccctccctgaggacgaccactgcctcaggaaagctcattacagagtggtgctgtcgcagttgcaccctgccgcctcttcggtacagaggcgaggacggttgttggtacgggatggaaatcaggccattgaaagagaaggaagagaatctggtgaacagcttagttactgcgggacatggccagattgataatttctcgctcggtgtgctgggcatggccctttttctggaagagatgttgcgcacacgaatagggaccaagcacgctatcctcctggtagcagtctccttcgtgacgctaattactggaaacatgtcttttcgggacctgggccgtgtgatggtcatggttggggccaccatgacagatgacatcggaatgggcgtgacctatctcgctctgcttgccgcattcaaagtaagacccacttttgcggccggtttgctgttaaggaagctcacaagcaaagagctgatgatggctaccattgggatcgcccttctgtcacagagtacaatacctgaaactatcctagagctcaccgatgcactggctttgggaatgatggtgctgaagattgtccgcaatatggaaaaataccaattagccgtgacgatcatggcaatttcctgcgttcccaacgccgtgatcctccagaatgcttggaaggtctcttgtacaatactggcggccgtgagcgtttccccacttctgttgacctcaagccagcagaaggcagactggattcctctcgctctgactatcaaaggcctaaaccccaccgccatcttcctgacaactcttagtcggacctctaagaaaagatcctggccactcaatgaggccattatggctgtgggcatggtcagcatactggcatcgtcattgctgaagaacgacatcccgatgacggggcctttagtagccggaggtctcctgacagtgtgctatgttcttaccggcaggtctgcggatctggaattggagcgagctgccgacgtgaaatgggaggatcaagcagaaattagtgggtccagccccatcctctctattactatcagcgaggacggatccatgtcaataaagaatgaagaggaggaacagacactgaccatcctaattcgcactggcctgcttgtcatcagtggtgtgtttccagtaagcattcccatcacagccgctgcatggtacctctgggaggtgaaaaagcagcgggccggggtcctgtgggatgttccttctccaccccctgtggaaaaggcggagttggaagacggagcttatagaataaaacagaggggcattttaggctactcccaaatcggggccggagtgtataaggagggtaccttccacacgatgtggcatgtcactcgtggcgcagtgctgatgcaccgcgggaaacggatcgagccgtcatgggccgatgttaagaaagacctcattagttacggaggcggttggaagctggaaggggagtggaaggaaggagaggaagtacaggtgcttgctctggagccaggcaaaaaccccagagccgtccagaccaagcctggcatctttaaaacaaataccgggacaataggagcagtgagcttggatttctccccaggtacttctggctcgcccattgttgacaggaaggggaaagtggtcggactatacggcaacggtgtggtaacccgaagcggggcttatgtctcagccatcgcgcagacggagaagtccattgaagataatcctgagatcgaagacgatatatttcggaagaaacgcctgacaattatggacctccatccgggagccggcaagactaaaagatacctgcccgcaatcgtgagggaggctatcaagcggggccttcgaaccttaattctggccccaacaagagttgtggctgcagaaatggaggaggccctccgcgggttgcctatcaggtatcaaaccactgccattaaaaccgaacacacaggacgtgagatagtcgacctgatgtgtcatgctacgttcactatgcggctcctgagtcccgtgagagttccaaactacaaccttatcattatggatgaagcgcacttcaccgaccctgcatctatcgccgctaggggttatatcagcacacgcgtggagatgggcgaggccgcagggatttttatgaccgccactcccccaggatcccgagatccgttccctcagtcaaatgctcccataatggacgaagagagagaaatcccagagcggtcttggaacagcggccacgaatgggtcacagattttaagggtaagaccgtgtggttcgtacccagtattaaagcggggaatgacatcgccgcatgcctgaggaagaacggcaagaaggtgattcagttgtcccgcaaaacgtttgatagcgagtacgttaagactcgtgctaatgactgggatttcgtcgtgacaaccgacatctctgagatgggcgccaactttaaggcagaaagagtgatagatcctcggaggtgtatgaaaccagtcatcctaaccgacggcgaggaacgcgtaattctggccgggcccatgcctgtgactcattcatccgctgcccaacgaagaggacggatcggtaggaatccgaagaacgagaatgaccagtatatttacatgggcgaaccactcgagaacgatgaggactgcgcgcactggaaagaagcaaagatgttactggataatatcaacacacccgaggggataattcctagtatgttcgaacccgagcgcgaaaaagttgacgccatcgatggagagtacagacttaggggcgaggctcggaagacctttgtggacctgatgcgtcgcggtgatctcccagtctggttggcctataaagtggctgcagaagggattaattacgccgaccgaaagtggtgtttcgatggcatcaagaacaatcagatactggaggaaaacatggaggttgagatctggacaaaagaaggagagagaaagaaactcaagcctaggtggctggacgctcggatttatagcgatccccttgccctaaaagaatttaaggagttcgcagcgggccgcaagtcgctgactttgaacttaatcacggaaatggggagactgccaaccttcatgacacagaaagccaggaatgctctcgacaacctggccgtgcttcatactgcagaggctggaggtcgggcctacaatcacgcactgtctgagctccctgaaaccttggagacactgctactgctcacccttctggccactgtcacgggcgggatatttttattcttgatgtccggaaagggcatcggtaaaatgaccctggggatgtgctgcataattacagctagcatcctcctgtggtatgcgcaaatccagccgcactggattgccgcatcaatcatacttgaatttttcctgattgtgctcttgatccccgagccagaaaagcagcgaactcctcaggataaccaactgacctacgtagtgattgctatcttaacagttgtcgccgccaccatggcaaatgagatgggctttctagagaaaactaagaaggacctgggactcggcagtataacaacgcaggaatctgagtccaacatccttgacattgatctgagacccgctagcgcctggaccttgtatgcggtggctactacattcgtgaccccaatgctgcgccattcaatcgaaaatagtagcgtcaacgtttccctcaccgccattgcaaatcaggccacagtgctgatggggcttggaaaaggttggcctctctctaagatggacatcggcgtacccctgttggctattgggtgttacagccaggtgaacccgatcactctgacggcagccttactactgctcgtcgcgcactacgctataattggaccaggccttcaagccaaagcaaccagggaggcccagaagcgggctgccgcaggtatcatgaaaaatcctacagtggatgggatcactgttattgacctggaacccataccatatgatcccaagtttgagaagcagttgggccaggtgatgctgctcatcctgtgcgtcacccaagtacttatgatgcgtacaacctgggctttatgtgaggccctgactctcgcgacgggacctatttccacattgtgggaaggcaacccggggagattctggaataccactatcgccgtgtcaatggcaaacatttttaggggatcttacctggctggcgccggtctactgttcagtatcatgaaaaataccacaaacactcgccgggggaccggaaatataggcgagacactcggtgaaaagtggaaatcgcgacttaacgcactgggcaagagcgagtttcagatctataaaaagtccgggattcaggaggttgacagaacgttggctaaagaaggaatcaagaggggcgagaccgatcatcacgccgtgtctcgcgggtcagccaagctgcggtggttcgtcgaaagaaacatggtgactcccgagggaaaagtcgtggacctcggctgcggtcgtgggggatggagctactattgtggcggtctgaagaatgttagggaagtgaaaggcttaacaaaagggggaccaggccatgaggagcctattcccatgtccacctacgggtggaaccttgtacggctgcaaagtggagtggatgtctttttcactcctccagaaaaatgcgacacactcctatgtgatatcggcgagtctagccccaatcctaccatagaagcgggtcgcacgctgcgagttttgaacctggtggagaattggctcaacaataacacccagttctgcattaaggtccttaatccatatatgccctcagtgatcgaaaagatggaggctctgcagagaaaatacgggggagcattggtaaggaacccgctgtcccggaatagtacacacgagatgtactgggtgagcaacgccactggcaatatcgtttcttccgtgaacatgatttcacgcatgctcataaatagatttaccatgaagcacaaaaaggctacatatgaacctgacgtcgatttaggcagcgggactaggaacatcggaattgagtcggaaatcccaaacctggacattatcggtaaacgaatagagaagatcaagcaggaacatgagacctcttggcactacgaccaagatcatccctataaaacatgggcctaccacggcagttatgagaccaagcagactgggtccgcaagctcaatggtgaatggagtcgtgcggcttctgacgaaaccttgggacgttgtaccaatggtgacacagatggccatgaccgatactacccccttcggccagcaacgtgtctttaaggaaaaagtggacacaagaacgcaggagccgaaggaaggtaccaagaaactaatgaagattactgctgagtggctctggaaagagctggggaagaaaaagacacctcgcatgtgtaccagggaagagttcactcggaaagttagatccaacgcggccttgggagcaatctttacagatgaaaataagtggaagtctgctcgcgaggccgtggaagacggcaggttctgggagctggtcgatcgagagcggaacctccaccttgaaggcaaatgcgagacctgtgtgtacaatatgatggggaagagagagaagaagctgggagagtttggtaaagcaaagggcagcagggccatttggtatatgtggttaggggctcgcttcctggaatttgaggccttgggattcctcaacgaggaccattggtttagtcgtggcaattccctgagcggtgtagaaggggagggactacaccggcttggctacatcctgagagatgtgggcaagaaagaagggggagcgatgtacgcagacgatacagccggttgggacactaggattaccctcgaggacctgaagaacgaagagatggttacgaatcatatgaaaggcgagcacaagaaattggctgaagccatattcaagctgacctatcagaacaaggtcgtgcgcgtgcagcgacccacaccacgggggactgtcatggatatcatttctagaagggaccaacgcggatcaggccaggttggtacctacgggctcaatacatttactaacatggaggcacagcttatcagacaaatggaaggagagggcatcttcaaaagtattcagcatctgaccgctacggaggaaatagccgtgcagaattggttagctcgggtaggcagggagcgtctgtcccgaatggccatcagcggggatgactgcgtggtcaagcctattgatgaccgcttcgcatctgcgttgacagccctcaacgatatgggaaaaatcagaaaggacattcagcaatgggaaccctcgcggggttggaatgattggacccaggtgccattttgctcacaccacttccatgagctggttatgaaagacggcagggtgctagtcgtgccctgtcgcaaccaggatgaacttatcgggagagctcggataagccagggagccggctggtccctgaaggagactgcatgcctcggtaagagttatgctcaaatgtggacactgatgtactttcacaggcgagacttgcgtttagccgcaaacgccatctgttctgcggtacctagccattgggttccaacctccagaactacctggtcaattcacgctaaacacgagtggatgacaacggaagatatgctggccgtgtggaatcgcgtctggatccaggagaacccgtggatggaagacaagacccccgtggagagttgggaagaggtgccttatctcgggaaacgggaggaccagtggtgcggatctcttattggcctgactagcagggcaacatgggccaagaatatccagaccgctataaaccaagtcagatccctaattggcaatgaagagtacactgattatatgccatcaatgaaacgcttccggagggaagaggaagaggccggggttctgtggtga

SEQ ID NO: 14536 - RNA, 9876 nt, synthetic construct
  misc_feature 1..9876: note = derived and/or modified CDS sequence (opt3) from DENV-2__EU482751__SS-prME
  source 1..9876: mol_type = other RNA
accgccggcgtgatagtaatgctgattccaactgctatggctttccacctcactacgagaaacggggaacctcatatgatagttggaaggcaggaaaagggtaaaagccttctgtttaagaccgaagacggcgtgaatatgtgcacattgatggccatcgatttaggggaactgtgtgaagacactattacctacaaatgcccactactccggcaaaacgaaccggaagatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatagaatccgctctgaacgacacatggaagatggagaaggcctcattcattgaggtcaaaagctgccactggcctaagtctcataccctttggtccaatggagtgttggaaagtgagatgatcatccccaagaatttcgcaggccccgttagccagcacaactaccgacctggttatcatactcaaaccgctggcccatggcacctcgggaagctggaaatggattttgacttctgtgagggaacaactgtggtcgtgaccgaagattgcggcaatagagggccctctctaaggacaacgaccgcctccggaaaactgattactgagtggtgctgtcgctcatgcacactcccgcctctgcggtacagaggcgaggacggttgttggtacgggatggaaatcaggccacttaaggagaaggaagagaacttggttaatagtctggtgaccgcgggacatggccagattgataactttagcttaggtgtactcggcatggccctgttccttgaagagatgctgcgcactcgaatagggacaaaacacgctatcttgctcgtcgcagtgtcgtttgtgaccctgattacgggaaatatgtccttccgggacctaggccgtgtcatggttatggtgggggccactatgaccgatgacatcggaatgggcgtaacatatctggctctcctggccgcatttaaggtgagacccaccttcgcggccggtcttttgctgaggaaattaacttctaaggagctcatgatggctacaattgggatcgccctgcttagccagtcaaccatacctgaaacaatcctggagctaactgatgcactcgctctgggaatgatggtcttgaaaattgtgcgcaacatggaaaagtaccaactggccgttaccatcatggcaattagttgcgtgcccaatgccgtcatcttacagaacgcttggaaggtgtcctgtacgatactcgcggccgtttctgtgagcccactgcttctgacatcctcacagcagaaagcagactggattcctttggctctcaccatcaagggcctgaatcccactgccatctttctaaccacactgagccggacaagtaaaaagagatcttggccacttaacgaggccattatggctgtcggcatggtatccatactcgcaagctcgctgttgaaaaatgacatcccgatgaccgggcctctggtggccggaggtttactcacggtttgctatgtgctgacaggcaggtcagcggatcttgaactggagcgagctgccgacgtcaagtgggaggatcaagcagaaatttctgggagttcccccatcttgagcattaccatctctgaggacggaagcatgtccatcaagaacgaagaggaggaacagactctcacaatcctgattcgcaccggcctactggtgatctcaggtgtattcccagtgagtattcccatcactgccgctgcatggtacctttgggaggtcaagaagcagcgggccggggttctctgggatgtgcctagcccaccccctgtggaaaaagcggagctggaagacggagcttatagaataaagcagaggggcattttgggctactctcaaatcggggccggagtctataaagagggtacatttcacaccatgtggcatgtgacgcgtggcgcagttttaatgcaccgcgggaagcggatcgagccgtcctgggccgatgtcaaaaaggacctgatttcatacggaggcggttggaagctcgaaggggagtggaaagaaggagaggaagtgcaggtcctggctcttgagccaggcaagaatcccagagccgtgcagactaaacctggcatcttcaagaccaacacagggaccataggagcagttagtctggattttagcccaggtacatccggctctcccattgtggacaggaaagggaaggtcgtgggattgtacggcaatggtgtagtcactcgatcgggggcttatgtgagcgccatcgcgcagaccgagaagtcaattgaagataaccctgagatcgaagacgatatattccggaaaaagcgcctaacgattatggacctgcatccgggagccggcaaaacaaagagatacctccccgcaatcgttagggaggctatcaaacggggcctgcgaactcttattttagccccaaccagagtggtcgctgcagaaatggaggaggccctgcgcgggctccctatcaggtatcaaacacccgccattaagaccgaacacactggacgtgagatagtggacttgatgtgtcatgctaccttcacaatgcggctgctctccccagttagagtgcctaactacaatctgatcattatggatgaagcgcactttacggaccccgcaagtatcgccgctaggggttatatctctactcgcgtcgagatgggcgaggccgcagggattttcatgaccgccacaccaccgggaagccgagatccttttccccagtccaacgctccaataatggacgaagagagagaaatccccgagcggtcatggaactctggccacgaatgggtgaccgatttcaagggtaaaactgtatggtttgtgcctagcattaaggcggggaacgacatcgccgcatgccttaggaaaaatggaaagaaagttattcagctgagtcgcaagacattcgattccgagtacgtcaagacccgtgctaacgactgggattttgtggtgacgactgacatcagcgagatgggcgccaatttcaaagcagaaagagtcatagatccacggaggtgtatgaagcccgtaatcttgacagacggcgaggaacgcgtgattctagccgggcctatgccggttacccattcttcagctgcccaacgaagaggacggatcggtaggaaccccaaaaatgagaacgaccagtatatttacatgggcgaacccctggagaatgatgaggactgcgcgcactggaaggaagcaaaaatgctcttagataacatcaatacccctgaggggataattccctccatgtttgaaccagagcgcgaaaaggtggacgccatcgatggagagtacagactgaggggcgaggctcggaaaactttcgtcgaccttatgcgtcgcggtgatctgcctgtgtggctcgcctataaggttgctgcagaagggattaactacgccgaccgaaagtggtgttttgatggcatcaaaaataaccagatattggaggaaaacatggaggtggagatctggacaaaggaaggagagaggaaaaagctgaaacccagatggctcgacgctcggatttatagtgatccactggcccttaaggagttcaaggagttcgcagcgggccgcaaaagcctaaccctgaatttgatcacagaaatggggagattacctacttttatgacgcagaaggccaggaacgctctggacaatctcgccgtcctgcataccgcagaggctggaggtcgggcctacaaccacgcactttcggagctgccggaaacactcgagactttgctgctactgaccctccttgccacagtgaccggcgggattttcctgtttttaatgtctggaaaaggcatcggtaagatgactttggggatgtgctgcataattacggcttccatcctgctctggtatgcgcaaatccagccccactggattgccgcaagcatcatactggagttctttcttattgtactgctcatcccagagcctgaaaaacagcgaaccccacaggataatcaattgacatacgtggttattgctatcctgactgtcgtggccgccaccatggcaaacgagatgggcttcttagagaagacaaagaaagacctaggactgggctcaataaccactcaggaaagtgagtctaatatcctcgacattgatcttagaccagcttccgcctggacactgtatgcggtggctacgacctttgtcactcctatgttgcgccatagcatcgaaaactcaagtgttaatgtgagcctgacagccattgcaaaccaggccaccgtactcatggggctgggaaagggttggcccctttccaaaatggacatcggcgtgccgctcctggctattgggtgttactctcaggtcaatccaatcaccttgacagcagccctgttactactggtggcgcactacgctataattggacctggcctccaagccaaggcaactagggaggcccagaaacgggctgccgcaggtatcatgaagaaccccacggttgatgggatcaccgtgattgaccttgaaccaataccctatgatcctaagttcgagaaacagctgggccaggtcatgttgctgatcctctgcgtaacacaagtgctgatgatgcgtactacctgggctctttgtgaggccttaacactggcgaccggaccgattagcactctctgggaaggcaatcccgggagattttggaacacgacaatcgccgtttccatggcaaatattttcaggggatcatacttggctggcgccggtctgctattttctatcatgaagaacaccacaagtacccgccgggggacaggaaatataggcgagactctgggtgaaaaatggaagtcgcgactcaacgcacttggcaaaagcgagttccagatctataagaaatccgggattcaggaggtggacagaaccctggctaaggaaggaatcaagaggggcgagacagatcatcacgccgtctctcgcgggtcagccaaattgcggtggtttgtggaaagaaacatggtcacgccagagggaaaggtggttgacctgggctgcggtcgtgggggatggagctactattgtggcggtctcaaaaatgtgagggaagtaaagggcctgaccaaagggggacctggccatgaggagcccattcctatgtccacttacgggtggaacttagtgcggcttcaaagtggagtcgatgttttcttcacaccacccgaaaagtgcgacaccctgctctgtgatatcggcgagtctagccctaatccaactatagaagcgggtcgcacactacgagtgctgaacttggtcgagaattggctgaacaataacacccagttttgcattaaggtgctcaatccctatatgccgtcagtaatcgagaaaatggaggcacttcagagacagtacgggggagcactggtgaggaaccctttgtcccggaatagtacgcacgagatgtactgggttagcaacgccaccggcaatatcgtgtcttccgtcaacatgatttcacgcatgctgataaatagattcacaatgaagcacaaaaaggctacttatgaaccagacgtggatctcggcagcgggaccaggaacatcggaattgagtcggaaatccccaacttagacattatcggtaaacgaatagagaagatcaagcaagaacatgagatttcttggcactacgaccaggatcatccttataaaacatgggcctaccacggcagttatgagactaagcagaccgggtccgcaagctcaatggtcaatggagtggttcggctgcttacaaaaccatgggacgtagtgcccatggtcacccagatggccatgactgatacgacaccgtttggccaacagcgtgtgttcaaggaaaaagttgacaccagaactcaggagcctaaggaaggtaccaagaaactgatgaagatcacagctgagtggctatggaaagagctcgggaagaaaaagacgccccgcatgtgtaccagggaagagtttactcggaaagtgagatccaacgcggccctgggagcaattttcacagatgaaaataagtggaagtctgctcgcgaggccgtcgaagacggcaggttttgggagttggtggatcgagagcggaacctgcacctcgaaggcaaatgcgagacctgtgtatacaatatgatggggaagagagagaagaaacttggagagttcggtaaagcaaaaggcagcagggccatctggtatatgtggctgggggctcgctttttagagttcgaggccctgggatttttgaacgaggaccattggttcagtcgtggcaattccctcagcggtgtggaaggggagggactgcaccggctaggctacattcttagagatgttggcaagaaagaagggggagcgatgtacgcagacgatactgccggttgggacacaaggataaccctggaggacctcaagaacgaagagatggtcacaaatcatatgaaaggcgagcacaagaaactggctgaagccatctttaagttgacttatcagaacaaggtggtgcgcgtccaacgaccaacccctcgggggacggttatggatattatctctagaagggaccagcgcggatcaggccaggtgggtacctacgggctgaatacattcactaacatggaggcacaactcatcagacagatggaaggagagggcattttcaaaagtatacagcatcttaccgctacagaggaaatcgccgtacagaattggctggctcgggtgggcagggagcgtttatcccgaatggccattagcggggatgactgcgtcgtgaagcccatcgatgaccgctttgcatctgcgctgactgccttgaacgatatgggaaaagttagaaaggacattcaacagtgggaaccatcgcggggttggaatgattggacccaggtgcccttctgctcacaccactttcatgagctcgtcatgaaagacggcagggtgctggtagttccttgtcgcaaccaggatgaactaatcgggagagctcggataagccaaggagccggctggtcccttaaggagacggcatgcctgggtaagagttatgctcagatgtggacactcatgtacttccacaggcgagacctgcgtttggccgcaaacgccatctgttctgcggtgccaagccattgggtcccgacctccagaactacatggtcaattcacgctaaacacgagtggatgaccactgaagatatgttagccgtgtggaatcgcgtgtggatccaggagaacccctggatggaagacaagacccctgtcgagagttgggaagaggttccatatctggggaaacgggaggaccagtggtgcggatctctcattggccttacaagcagggcaacgtgggccaagaatatccaagctgccataaaccaggtgagatccctgattggcaatgaagagtacaccgattatatgccctcaatgaaacgctttcggagggaagaggaagaggcaggggtactatggtga

SEQ ID NO: 14537 - RNA, 9876 nt, synthetic construct
  misc_feature 1..9876: note = derived and/or modified CDS sequence (opt3) from DENV-2__GQ868604__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctacaagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatagaatccgctctgaacgacacatggaagatggagaaggcctcattcattgaggtcaaaagctgccactggcctaagtctcataccctttggtccaatggagtgttggaaagtgagatgatcatcccaaaaaacttcgcaggccccgttagccagcacaactaccgacctggttatcatactcaaaccgctggcccatggcacctcgggaagctggaaatggattttgacctatgtgagggaacaactgtggtcgtgaccgaagattgcggcaatagagggccctctctgaggacaacgaccgcctccggaaaactcattactgagtggtgctgtcgctcatgcacactgccgcctcttcggtacagaggcgaggacggttgttggtacgggatggaaatcaggccattgaaggagaaggaagagaacctggttaatagtttagtgaccgcgggacgcggccagattgataacttcagcctcggtgtactgggcatggccctttttctggaagagatgttgcgaactcggatagggacaaaacatgctatcctcctggtcgcagtgtcgttcgtgaccctaattacgggaaatatgtcctttcgtgacctgggcagagtcatggttatggtgggggccactatgaccgatgacatcggaatgggcgtaacatatctcgctctgcttgccgcattcaaggtgaggcccacctttgcggccggtttgctgttacgcaaactcacttctaaggagctgatgatggctacaattgggatcgcccttctgagccagtcaaccatacctgaaaacatcctagagctcacagatgcactggctttgggaatgatggtcctgaaaattgtgcggaatatggaaaagtaccaattagccgttactatcatggcaattagttgcgtgcccaacgccgtcatcctccagaatgcttggaaggtgtcctgtaccatactggcggccgtttctgtgagcccacttctgttgacgtcctcacagcagaaagcagactggattcctctcgctctgacaatcaagggcctaaaccccaccgccatcttcctgactacccttagcagaacaagtaaaaagaggtcttggccactcaatgaggccattatggctgtcggcatggtatccatactggcaagctcgttgctgaaaaacgacatcccgatgactgggcctttagtggccggaggtctcctgaccgtttgctatgtgcttacgggccgatcagcggatctggaattggagcgcgctgccgacgtcaagtgggaggatcaagcagaaatttctgggagttcccccatcctcagcattacaatctctgaggacggaagcatgtccataaaaaatgaagaggaggaacagaccctgactatcctaattcggacaggcctgcttgtgatctcaggtgtatttccagtgagtattcccatcaccgccgctgcatggtacctctgggaggtcaagaagcagagagccggggttctgtgggatgtgcctagcccaccccctgtggaaaaagcggagttggaagacggagcttataggataaagcagcgtggcattttaggctactctcaaatcggggccggagtctataaagagggtactttccacacaatgtggcacgtgacccgcggcgcagttctgatgcatcgggggaagagaatcgagccgtcctgggccgatgtaaaaaaggacctcatttcatacggaggcggttggaagctggaaggggagtggaaagaaggagaggaagtgcaggtccttgctctggagccaggcaagaaccccagggccgtgcagacgaaacctggcatctttaagactaataccgggacaataggagcagttagtttggatttcagcccaggtacctccggctctcccattgtggaccgaaaagggaaggtcgtgggactatacggcaacggtgtagtcacacggtcgggggcttatgtgagcgccatcgcgcagactgagaagtcaattgaagataaccctgagatcgaagacgatatatttcgcaaaaagagactgaccattatggacctccacccgggagccggcaaaacgaagaggtacctgcccgcaatcgttcgggaggctatcaaacgaggccttagaacattaattctggccccaactcgcgtggtcgctgcagaaatggaggaggccctcagggggttgcctatccgttatcaaacccccgccattaagacagaacataccggacgggagatagtggacctgatgtgtcacgctactttcaccatgagactcctgtccccagttagggtgcctaattacaaccttatcattatggatgaagcgcatttcacagaccccgcaagtatcgccgctcgcggttatatctctacgcgagtcgagatgggcgaggccgcagggatttttatgactgccaccccaccgggaagcagagatcctttcccccagtccaatgctccaataatggacgaagagcgggaaatccccgagaggtcatggaactctggccacgaatgggtgacagattttaagggtaaaaccgtatggttcgtgcctagcattaaggcggggaatgacatcgccgcatgcctgcgcaaaaacggaaagaaagttattcagttgagtcgtaagacttttgattccgagtacgtcaagacaagagctaatgactgggatttcgtggtgaccacggacatcagcgagatgggcgccaactttaaagcagaacgggtcatagatccaaggcgctgtatgaagcccgtaatcctaactgacggcgaggaacgagtgattctggccgggcctatgccggttacacactcttcagctgcccaaagacggggaaggatcggtcgcaatccaaaaaacgagaatgaccagtatatttacatgggcgaacccctcgagaacgatgaggactgcgcgcattggaaggaagcaaaaatgttactggataatatcaacacccctgaggggataattccctccatgttcgaaccagagagagaaaaggtggacgccatcgatggagagtacaggcttcggggcgaggctcgtaaaacctttgtcgacctgatgcgccgaggtgatctccctgtgtggttggcctataaggttgctgcagaagggattaattacgccgacagaaagtggtgtttcgatggcatcaaaaacaaccagatactggaggaaaatatggaggtggagatctggactaaggaaggagagaggaaaaagctcaaaccccggtggctggacgctcgcatttatagtgatccacttgccctaaaggaatttaaggagttcgcagcgggcagaaaaagcctgacattgaacttaatcaccgaaatggggaggctgcctacattcatgactcagaaggcccggaatgctctcgacaacctggccgtccttcacacggcagaggctggaggtcgagcctacaatcatgcactgtcggagctcccggaaaccttggagacactgctactgctcactcttctggccaccgtgacaggcgggatttttttattcttgatgtctggaaaaggcatcggtaagatgaccctggggatgtgctgcataattactgcttccatcctcctgtggtatgcgcaaatccagccccactggattgccgcaagcatcatacttgaatttttcctgattgtactcttgatcccagagcctgaaaaacagagaacgccccaggataaccaactgacctacgtggttattgctatcttaacagtcgtggccgccactatggcaaatgagatgggctttctagagaagaccaagaaagacctgggactcggctcaataacaacccaggaaagtgagtctaacatccttgacattgatctgcgcccagcttccgcctggactttgtatgcggtggctacaacgttcgtcacccctatgctgaggcacagcatcgaaaattcaagtgttaacgtgagcctcactgccattgcaaatcaggccacagtactgatggggcttggaaagggttggcccctctccaaaatggacatcggcgtgccgctgttggctattgggtgttactctcaggtcaacccaatcaccctgaccgcagccttactactgctcgtggcgcattacgctataattggacctggccttcaagccaaggcaacacgggaggcccagaaacgtgctgccgcaggtatcatgaagaatcccactgttgatgggatcacggtgattgacctggaaccaataccctatgatcctaagtttgagaaacagttgggccaggtcatgctgctcatcctgtgcgtaacccaagtgcttatgatgagaacaacttgggctttatgtgaggccctgaccctcgcgacaggaccgattagcaccttgtgggaaggcaaccccgggaggttctggaatactacgatcgccgtttccatggcaaacatttttcgcggatcatacctggctggcgccggtctactgttctctatcatgaagaatacaaccagtactcggcgagggaccggaaacataggcgagacactcggtgaaaaatggaagtcgagacttaacgcactgggcaaaagcgagtttcagatctataagaaatccgggattcaggaggtggacaggactttggctaaggaaggaatcaagcgcggcgagaccgatcaccatgccgtctctcgggggtcagccaaactgagatggttcgtggaacgtaatatggtcacaccagagggaaaggtggttgacctcggctgcggtagggggggatggagctactattgtggcggtctgaaaaacgtgcgggaagtaaagggcttaacgaaagggggacctggccacgaggagcccattcctatgtccacctacgggtggaatcttgtgcgcctgcaaagtggagtcgatgtttttttcactccacccgaaaagtgcgacacactcctatgtgatatcggcgagtctagccctaacccaaccatagaagcgggtcgaactctgagagtgttgaatctggtcgagaactggctcaataacaatacacagttctgcattaaggtgcttaacccctatatgccgtcagtaatcgaaaaaatggaggctctgcagaggcagtacgggggagcattggtgcggaatcctctgtcccgcaacagtacccatgagatgtactgggttagcaatgccacgggcaacatcgtgtcttccgtcaatatgatttcaagaatgctcataaacaggtttaccatgaagcacaaaaaggctacatatgaaccagacgtggatttaggcagcgggactcgaaacatcggaattgagtcggaaatccccaatctggacattatcggtaaacggatagagaagatcaagcaagaacacgagatttcttggcattacgaccaggatcacccttataaaacctgggcctaccatggcagttatgagacaaagcagactgggtccgcaagctcaatggtcaacggagtggttcgtcttctgaccaaaccatgggacgtagtgcccatggtcacacagatggccatgaccgatactacgccgttcggccaacagagagtgtttaaggaaaaagttgacacacgcacccaggagcctaaggaaggtactaagaaactaatgaagatcaccgctgagtggctctggaaagagctggggaagaaaaagacacccaggatgtgtacgcgggaagagttcaccaaaaaggtgagatccaatgcggccttgggagcaatttttactgatgaaaacaagtggaaatctgctcgcgaggccgtcgaagacggcaggttctgggagctggtggatcgagagcggaatctccaccttgaaggcaagtgcgagacatgtgtatacaacatgatggggaaaagagaaaagaaactgggagagtttggtaaggcaaagggcagcagggccatctggtatatgtggttaggggctcgcttcctggaatttgaggccttgggattcctcaatgaggaccactggtttagtcgtggcaactccctgagcggtgtggaaggggagggactacatcggcttggctacattctgagagatgttggcaaaaaggaagggggagcgatgtacgcagacgataccgccggttgggacactaggataacactcgaggacctgaaaaatgaagagatggtcaccaaccacatgaagggcgagcataaaaagttggctgaagccatcttcaagctgacatatcagaataaagtggtgcgcgtccaacgaccaactcctcgggggaccgttatggatattatctctagaagggaccagcgcggatcaggccaggtgggtacgtacgggctcaacacctttacaaatatggaggcacaacttatcagacagatggaaggagagggcattttcaagagtatacagcacctgactgctaccgaggaaatcgccgtacagaactggttagctcgggtgggcagggagcgtctgtcccgaatggccattagcggggatgactgcgtcgtgaaacccatcgatgaccgcttcgcatctgcgttgacagccctcaatgatatgggaaaggttagaaaagacattcaacagtgggaaccatcgcggggttggaacgattggactcaggtgcccttttgctcacatcacttccacgagctggtcatgaaggacggcagggtgctagtagttccttgtcgcaaccaggatgaacttatcgggagagctcggataagccaaggagccggctggtccctgaaggagaccgcatgcctcggtaaaagttatgctcagatgtggacgctgatgtactttcataggcgagacttgcgtttagccgcaaatgccatctgttctgcggtgccaagccactgggtcccgacatccagaaccacttggtcaattcatgctaagcacgagtggatgacaaccgaagatatgctggccgtgtggaaccgcgtgtggatccaggagaatccctggatggaagacaaaactcctgtcgagagttgggaagaggttccatatctcgggaagcgggaggaccagtggtgcggatctcttattggcctgaccagcagggcaacatgggccaaaaacatccaaacggctataaatcaggtgagatccctaattggcaacgaagagtacaccgattatatgccctcaatgaagcgcttccggagggaagaggaagaggccggggtactgtggtga

SEQ ID NO: 14538 - RNA, 9876 nt, synthetic construct
  misc_feature 1..9876: note = derived and/or modified CDS sequence (opt3) from DENV-2__EU482752__SS-prME
  source 1..9876: mol_type = other RNA
acagccggagtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctaccagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatccgcggaattatgcaggctggcaaaagatcgctcaggcctcaaccaaccgaactgaagtatagctggaaaacttgggggaaggccaagatgctttccacagagtcacataaccagaccttcttgatcgatggaccggaaacagcagagtgccccaatactaaccgtgcgtggaatagtctggaggtcgaagactacggctttggtgttttcaccacgaacatttggctcaaactgcgggagaagcaggacgtgttttgtgattctaaattaatgagcgctgccatcaaggacaatcgagcagtgcacgccgatatggggtattggatagaatccgctctgaacgacacatggaaaatggagaaggcctcattcattgaggtaaagagctgccactggcctaaatctcataccctttggtccaatggagtcttggaaagtgagatgatcatcccaaagaacttcgcaggccccgtgagccagcacaactacagacctggttatcatactcaaaccgctggcccatggcacctcgggaaactggaaatggattttgacctatgtgagggaacaactgttgtggtcaccgaagattgcggcaatagggggccctctctgcgcacaacgaccgcctccggaaagctcattactgagtggtgctgtcggtcatgcacactgccgcctcttagatacaggggcgaggacggttgttggtacgggatggaaatccgcccattgaaagagaaggaagagaacctggtgaatagtttagttaccgcgggacatggccagattgataacttcagcctcggtgtgctgggcatggccctttttctggaagagatgttgcgaactcggatagggacaaagcacgctatcctcctggtagcagtctcgttcgtgaccctaattacgggaaatatgtcctttcgtgacctgggcagagtgatggtcatggttggggccactatgaccgatgacatcggaatgggcgtgacatatctcgctctgcttgccgcattcaaagtaaggcccacctttgcggccggtttgctgttacgcaagctcacttctaaagagctgatgatggctacaattgggatcgcccttctgagccagtcaaccatacctgaaaacatcctagagctcacagatgcactggctttgggaatgatggtgctgaagattgtccggaatatggaaaaataccaattagccgtgactatcatggcaattagttgcgttcccaacgccgtgatcctccagaatgcttggaaggtctcctgtaccatactggcggccgtgtctgttagcccacttctgttgacgtcctcacagcagaaggcagactggattcctctcgctctgacaatcaaaggcctaaaccccaccgccatcttcctgactacccttagcagaacaagtaagaaaaggtcttggccactcaatgaggccattatggctgtgggcatggtctccatactggcaagctcgttgctgaagaacgacatcccgatgactgggcctttagtagccggaggtctcctgaccgtgtgctatgttcttacgggccgatcagcggatctggaattggagcgcgctgccgacgtgaaatgggaggatcaagcagaaatttctgggagttcccccatcctcagcattacaatctctgaggacggaagcatgtccataaagaatgaagaggaggaacagaccctgactatcctaattcggacaggcctgcttgtcatctcaggtgtgtttccagtaagtattcccatcaccgccgctgcatggtacctctgggaggtgaaaaagcagagagccggggtcctgtgggatgttcctagcccaccccctgtggaaaaggcggagttggaagacggagcttataggataaaacagcgtggcattttaggctactctcaaatcggggccggagtgtataaggagggtactttccacacaatgtggcatgtcacccgcggcgcagtgctgatgcaccgggggaaaagaatcgagccgtcctgggccgatgttaagaaagacctcatttcatacggaggcggttggaagctggaaggggagtggaaggaaggagaggaagtacaggtgcttgctctggagccaggcaaaaaccccagggccgtccagacgaagcctggcatctttaaaactaataccgggacaataggagcagtgagtttggatttcagcccaggtacctccggctctcccattgttgaccgaaaggggaaagtggtcggactatacggcaacggtgtggtaacacggtcgggggcttatgtcagcgccatcgcgcagactgagaagtcaattgaagataaccctgagatcgaagacgatatatttcgcaagaaaagactgaccattatggacctccatccgggagccggcaagacgaaaaggtacctgcccgcaatcgtgcgggaggctatcaagcgaggccttagaacattaattctggccccaactcgcgttgtggctgcagaaatggaggaggccctcagggggttgcctatccgttatcaaaccacagccattaaaaccgaacacactggacgggagatagtcgacctgatgtgtcatgctaccttcacaatgagactcctgtcccccgtgagggttccaaattacaaccttatcattatggatgaagcgcacttcacggaccctgcaagtatcgccgctcgcggttatatctctactcgagtggagatgggcgaggccgcagggatttttatgaccgccacacccccaggaagcagagatccgttccctcagtccaatgctcccataatggacgaagaacgggaaatcccagagaggtcatggaactctggccacgaatgggtcaccgattttaagggtaagactgtgtggttcgtacccagcattaaagcggggaatgacatcgccgcatgcctgcgcaagaacggcaagaaggtgattcagttgagtcgtaaaacatttgattccgagtacgttaagaccagagctaatgactgggatttcgtcgtgacgactgacatcagcgagatgggcgccaactttaaggcagaacgggtgatagatcctaggcgctgtatgaaaccagtcatcctaacagacggcgaggaacgagtaattctggccgggcccatgcctgtgacccattcttcagctgcccaaagacggggaaggatcggtcgcaatccgaagaacgagaatgaccagtatatttacatgggcgaaccactcgagaacgatgaggactgcgcgcactggaaagaagcaaagatgttactggataatatcaacacccccgaggggataattccttccatgttcgaacccgagagagaaaaagttgacgccatcgatggagagtacaggcttcggggcgaggctcgtaagacttttgtggacctgatgcgccgaggtgatctcccagtctggttggcctataaagtggctgcagaagggattaattacgccgacagaaagtggtgtttcgatggcatcaagaacaaccagatactggaggaaaatatggaggttgagatctggacaaaagaaggagagaggaagaaactcaagcctcggtggctggacgctcgcatttatagtgatccccttgccctaaaagaatttaaggagttcgcagcgggcagaaagagcctgaccttgaacttaatcacagaaatggggaggctgccaactttcatgacgcagaaagcccggaatgctctcgacaacctggccgtgcttcataccgcagaggctggaggtcgagcctacaatcacgcactgtcggagctccctgaaacattggagactctgctactgctcacccttctggccacagtcaccggcgggatatttttattcttgatgtctggaaagggcatcggtaaaatgactctggggatgtgctgcataattacggcttccatcctcctgtggtatgcgcaaatccagccgcactggattgccgcaagcatcatacttgaatttttcctgattgtgctcttgatccccgagccagaaaagcagagaacccctcaggataaccaactgacatacgtagtgattgctatcttaactgttgtcgccgccaccatggcaaatgagatgggctttctagagaaaacaaagaaggacctgggactcggctcaataaccactcaggaaagtgagtctaacatccttgacattgatctgcgccccgcttccgcctggacattgtatgcggtggctacgaccttcgtgactccaatgctgaggcatagcatcgaaaattcaagtgtcaacgttagcctcacagccattgcaaatcaggccaccgtgctgatggggcttggaaaaggttggcctctctccaagatggacatcggcgtacccctgttggctattgggtgttactctcaggtgaacccgatcaccctgacagcagccttactactgctcgtcgcgcactacgctataattggaccaggccttcaagccaaagcaactcgggaggcccagaagcgtgctgccgcaggtatcatgaaaaatcctacggtggatgggatcaccgttattgacctggaacccataccatatgatcccaagtttgagaagcagttgggccaggtgatgctgctcatcctgtgcgtcacacaagtacttatgatgagaactacctgggctttatgtgaggccctgacactcgcgaccggacctattagcactttgtgggaaggcaacccggggaggttctggaatacgacaatcgccgtgtccatggcaaacatttttcgcggatcatacctggctggcgccggtctactgttctctatcatgaaaaataccactaacacccggcgagggacaggaaacataggcgagactctcggtgaaaagtggaaaagtagacttaatgcactgggcaagtcggagtttcagatctataaaaagagcgggattcaggaggttgacaggaccttggctaaagaaggaatcaagcgcggcgagacagatcatcacgccgtgtcccgggggtctgccaagctgagatggttcgtcgaacgtaacatggtgacgcccgagggaaaagtcgtggacctcggctgcggtagagggggatggtcatactattgtggcggtctgaagaatgttcgggaagtgaaaggcttaaccaaagggggaccaggccatgaggagcctattcccatgagcacttacgggtggaaccttgtacgcctgcaatccggagtggatgtctttttcacacctccagaaaaatgcgacaccctcctatgtgatatcggcgagagttctcccaatcctactatagaagcgggtcgaacactgagagttttgaacctggtggagaattggctcaacaataacacccagttctgcattaaggtccttaatccatatatgcccagcgtgatcgaaaagatggaggctctgcagaggaaatacgggggagcattggtacggaacccgctgtcacgcaattccacgcacgagatgtactgggtgagtaacgccaccggcaatatcgttagctctgtgaacatgatttccagaatgctcataaacaggtttacaatgaagcacaaaaaggctacttatgaacctgacgtcgatttaggctcagggacccgaaatatcggaattgagagcgaaatcccaaacctggacattatcggtaaacggatagagaagatcaagcaggaacatgagacatcgtggcactacgaccaagatcatccctataaaacttgggcctaccacggctcttatgagaccaagcagacagggagtgcatccagcatggtgaatggagtcgtgcgtcttctgaccaaaccttgggacgttgtaccaatggtgactcagatggccatgacggatacaacccccttcggccagcaaagagtctttaaggaaaaagtggacactcgcacccaggagccgaaggaaggtacaaagaaactaatgaagattacggctgagtggctctggaaagagctggggaagaaaaagacccctaggatgtgtactcgggaagagttcacaagaaaagttcgctcaaacgcggccttgggagcaatctttaccgatgaaaataagtggaagtccgctagggaggccgtggaagacggccgattctgggagctggtcgatcgggagagaaacctccaccttgaaggcaaatgcgagacttgtgtgtacaatatgatggggaagagggagaagaagctgggagagtttggtaaagcaaagggctctcgcgccatttggtatatgtggttaggggctcgtttcctggaatttgaggccttgggattcctcaacgaggaccattggtttagccggggcaatagtctgtccggtgtagaaggggagggactacacagacttggctacatcctgagggatgtgggcaagaaagaagggggagcgatgtacgcagacgatacagccggttgggacacccgcattacactcgaggacctgaagaacgaagagatggttactaatcatatgaaaggcgagcacaagaaattggctgaagccatattcaagctgacctatcagaacaaggtcgtgcgagtgcagcggcccacgccaagagggaccgtcatggatatcattagcaggcgcgaccaaagaggatctggccaggttggtacatacgggctcaatacttttaccaacatggaggcacagcttatccggcaaatggaaggagagggcatcttcaaatcaattcagcatctgacagctactgaggaaatagccgtgcagaattggttagctagggtaggccgtgagcgactgagtcgcatggccatctccggggatgactgcgtggtcaagcctattgatgacagattcgcaagcgcgttgaccgccctcaacgatatgggaaaagtgcggaaggacatccagcaatgggaaccctctaggggttggaacgattggacgcaggttccattttgctcgcaccacttccatgagctggtgatgaaagacggccgcgtcctagtggtaccctgtagaaatcaggatgaacttattgggcgggctaggatctcacagggagccggctggagcctgaaggagacagcatgcctcggtaagtcctatgctcaaatgtggaccctgatgtactttcaccgacgtgacttgagattagccgcaaacgccatatgtagtgcggttccttctcattgggtgccaactagccgcacaacctggtccatccacgctaaacacgagtggatgactaccgaagatatgctggccgtctggaatcgggtgtggattcaggagaacccgtggatggaagacaagacacccgtggagtcatgggaagaggtcccttatctcgggaaaagggaggaccagtggtgcggaagtcttatcggcctgacgtctagagcaacctgggccaagaatattcagactgctatcaaccaagttcgcagcctaataggcaatgaagagtacacagattatatgccatccatgaaacggttcaggcgagaagaggaagaggccggggtgctgtggtga

SEQ ID NO: 14539 - RNA, 9876 nt, synthetic construct
  misc_feature 1..9876: note = derived and/or modified CDS sequence (opt3) from DENV-2__EU482753__SS-prME
  source 1..9876: mol_type = other RNA
accgccggagtgatcgtcatgctgattcccacagctatggcattccacctcactacgagaaatggggagcctcatatgatagttggaaggcaggaaaagggtaaaagccttctgtttaagaccgaggacggcgtgaatatgtgcaccttgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatccgcggaattatgcaggctggcaaaagatcgctcaggcctcaaccaaccgaactgaagtatagctggaaaacttgggggaaggccaagatgctttccacagagtcacataaccagaccttcttgatcgatggaccggaaacagcagagtgccccaatactaaccgtgcgtggaatagtctggaggtcgaagactacggctttggtgttttcaccacgaacatttggctcaaactgcgggagaagcaggacgtgttttgtgattctaaattaatgagcgctgccatcaaggacaatcgagcagtgcacgccgatatggggtattggatagaatccgctctgaacgacacatggaaaatggagaaggcctcattcattgaggtaaagagctgccactggcctaaatctcataccctttggtccaatggagtcttggaaagtgagatgatcatcccaaagaacttcgcaggccccgtgagccagcacaactacagacctggttatcatactcaaaccgctggcccatggcacctcgggaaactggaaatggattttgacctatgtgagggaacaactgttgtggtcaccgaagattgcggcaatagggggccctctctgcgcacaacgaccgcctccggaaagctcattactgagtggtgctgtcggtcatgcacactgccgcctcttagatacaggggcgaggacggttgttggtacgggatggaaatccgcccattgaaagagaaggaagagaacctggtgaatagtttagttaccgcgggacatggccagattgataacttcagcctcggtgtgctgggcatggccctttttctggaagagatgttgcgaactcggatagggacaaagcacgctatcctcctggtagcagtctcgttcgtgaccctaattacgggaaatatgtcctttcgtgacctgggcagagtgatggtcatggttggggccactatgaccgatgacatcggaatgggcgtgacatatctcgctctgcttgccgcattcaaagtaaggcccacctttgcggccggtttgctgttacgcaagctcacttctaaagagctgatgatggctacaattgggatcgcccttctgagccagtcaaccatacctgaaacaatcctagagctcactgatgcactggctttgggaatgatggtgctgaagattgtccggaacatggaaaaataccaattagccgtgaccatcatggcaattagttgcgttcccaatgccgtgatcctccagaacgcttggaaggtctcctgtacgatactggcggccgtgtctgttagcccacttctgttgacatcctcacagcagaaggcagactggattcctctcgctctgaccatcaaaggcctaaatcccactgccatcttcctgaccacacttagcagaacaagtaagaaaaggtcttggccactcaacgaggccattatggctgtgggcatggtctccatactggcaagctcgttgctgaagaatgacatcccgatgaccgggcctttagtagccggaggtctcctgacggtgtgctatgttcttacaggccgatcagcggatctggaattggagcgcgctgccgacgtgaaatgggaggatcaagcagaaatttctgggagttcccccatcctcagcattaccatctctgaggacggaagcatgtccataaagaacgaagaggaggaacagactctgacaatcctaattcggaccggcctgcttgtcatctcaggtgtgtttccagtaagtattcccatcactgccgctgcatggtacctctgggaggtgaaaaagcagagagccggggtcctgtgggatgttcctagcccaccccctgtggaaaaggcggagttggaagacggagcttataggataaaacagcgtggcattttaggctactctcaaatcggggccggagtgtataaggagggtacattccacaccatgtggcatgtcacgcgcggcgcagtgctgatgcaccgggggaaaagaatcgagccgtcctgggccgatgttaagaaagacctcatttcatacggaggcggttggaagctggaaggggagtggaaggaaggagaggaagtacaggtgcttgctctggagccaggcaaaaatcccagggccgtccagactaagcctggcatctttaaaaccaacacagggaccataggagcagtgagtttggatttcagcccaggtacatccggctctcccattgttgaccgaaaggggaaagtggtcggactatacggcaatggtgtggtaactcggtcgggggcttatgtcagcgccatcgcgcagaccgagaagtcaattgaagataaccctgagatcgaagacgatatatttcgcaagaaaagactgacgattatggacctccatccgggagccggcaagacaaaaaggtacctgcccgcaatcgtgcgggaggctatcaagcgaggccttagaactttaattctggccccaacccgcgttgtggctgcagaaatggaggaggccctcagggggttgcctatccgttatcaaacaaccgccattaaaactgaacacaccggacgggagatagtcgacctgatgtgtcatgctacattcacgatgagactcctgtcccccgtgagggttccaaactacaatcttatcattatggatgaagcgcacttcactgaccctgcaagtatcgccgctcgcggttatatctctacccgagtggagatgggcgaggccgcagggatttttatgacagccacacccccaggaagcagagatccgttccctcagtccaacgctcccataatggacgaagaacgggaaatcccagagaggtcatggaactctggccacgaatgggtcactgattttaagggtaagacagtgtggttcgtacccagcattaaagcggggaacgacatcgccgcatgcctgcgcaagaatggcaagaaggtgattcagttgagtcgtaaaacctttgattccgagtacgttaagacgagagctaacgactgggatttcgtcgtgactacagacatcagcgagatgggcgccaattttaaggcagaacgggtgatagatcctaggcgctgtatgaaaccagtcatcctaaccgacggcgaggaacgagtaattctggccgggcccatgcctgtgacccattcttcagctgcccaaagacggggaaggatcggtcgcaacccgaagaatgagaacgaccagtatatttacatgggcgaaccactcgagaatgatgaggactgcgcgcactggaaagaagcaaagatgttactggataacatcaatactcccgaggggataattccttccatgttcgaacccgagagagaaaaagttgacgccatcgatggagagtacaggcttcggggcgaggctcgtaagacatttgtggacctgatgcgccgaggtgatctcccagtctggttggcctataaagtggctgcagaagggattaactacgccgacagaaagtggtgtttcgatggcatcaagaataaccagatactggaggaaaacatggaggttgagatctggaccaaagaaggagagaggaagaaactcaagcctcggtggctggacgctcgcatttatagtgatccccttgccctaaaagaatttaaggagttcgcagcgggcagaaagagcctgacattgaatttaatcactgaaatggggaggctgccaacgttcatgacccagaaagcccggaacgctctcgacaatctggccgtgcttcatacagcagaggctggaggtcgagcctacaaccacgcactgtcggagctccctgaaactttggagaccctgctactgctcacacttctggccaccgtcactggcgggatatttttattcttgatgtctggaaagggcatcggtaaaatgacgctggggatgtgctgcataattaccgcttccatcctcctgtggtatgcgcaaatccagccgcactggattgccgcaagcatcatacttgaatttttcctgattgtgctcttgatccccgagccagaaaagcagagaacacctcaggataatcaactgacttacgtagtgattgctatcttaaccgttgtcgccgccacaatggcaaacgagatgggctttctagagaaaaccaagaaggacctgggactcggctcaataactacacaggaaagtgagtctaatatccttgacattgatctgcgccccgcttccgcctggacgttgtatgcggtggctaccactttcgtgacaccaatgctgaggcatagcatcgaaaactcaagtgtcaatgttagcctcaccgccattgcaaaccaggccaccgtgctgatggggcttggaaaaggttggcctctctccaagatggacatcggcgtacccctgttggctattgggtgttactctcaggtgaatccgatcacactgactgcagccttactactgctcgtcgcgcactacgctataattggaccaggccttcaagccaaagcaacgcgggaggcccagaagcgtgctgccgcaggtatcatgaaaaaccctaccgtggatgggatcacagttattgacctggaacccataccatatgatcccaagtttgagaagcagttgggccaggtgatgctgctcatcctgtgcgtcactcaagtacttatgatgagaaccacatgggctttatgtgaggccctgaccctcgcgactggacctattagcacgttgtgggaaggcaatccggggaggttctggaacacaaccatcgccgtgtccatggcaaatatttttcgcggatcatacctggctggcgccggtctactgttctctatcatgaaaaacactaccaatacacggcgagggactggaaacataggcgagaccctcggtgaaaagtggaaaagtagacttaacgcactgggcaagtcggagtttcagatctataaaaagagcgggattcaggaggttgacaggacattggctaaagaaggaatcaagcgcggcgagacggatcatcacgccgtgtcccgggggtctgccaagctgagatggttcgtcgaacgtaatatggtgacccccgagggaaaagtcgtggacctcggctgcggtagagggggatggtcatactattgtggcggtctgaagaacgttcgggaagtgaaaggcttaactaaagggggaccaggccatgaggagcctattcccatgagcacatacgggtggaatcttgtacgcctgcaatccggagtggatgtctttttcacccctccagaaaaatgcgacactctcctatgtgatatcggcgagagttctcccaaccctacaatagaagcgggtcgaaccctgagagttttgaatctggtggagaactggctcaataacaatacgcagttctgcattaaggtccttaacccatatatgcccagcgtgatcgaaaagatggaggctctgcagaggaaatacgggggagcattggtacggaatccgctgtcacgcaactccacccacgagatgtactgggtgagtaatgccacaggcaacatcgttagctctgtgaatatgatttccagaatgctcataaacaggtttactatgaagcacaaaaaggctacctatgaacctgacgtcgatttaggctcagggacacgaaacatcggaattgagagcgaaatcccaaatctggacattatcggtaaacggatagagaagatcaagcaggaacatgagacttcgtggcactacgaccaagatcatccctataaaacctgggcctaccacggctcttatgagacaaagcagaccgggagtgcatccagcatggtgaacggagtcgtgcgtcttctgactaaaccttgggacgttgtaccaatggtgacgcagatggccatgacagataccactcccttcggccagcaaagagtctttaaggaaaaagtggacacccgcacacaggagccgaaggaaggtacgaagaaactaatgaagattaccgctgagtggctctggaaagagctggggaagaaaaagactcctaggatgtgtacacgggaagagttcaccagaaaagttcgctcaaatgcggccttgggagcaatctttactgatgaaaacaagtggaagtccgctagggaggccgtggaagacggccgattctgggagctggtcgatcgggagagaaatctccaccttgaaggcaaatgcgagacatgtgtgtacaacatgatggggaagagggagaagaagctgggagagtttggtaaagcaaagggctctcgcgccatttggtatatgtggttaggggctcgtttcctggaatttgaggccttgggattcctcaatgaggaccattggtttagccggggcaacagtctgtccggtgtagaaggggagggactacacagacttggctacatcctgagggatgtgggcaagaaagaagggggagcgatgtacgcagacgataccgccggttgggacacacgcattactctcgaggacctgaagaatgaagagatggttaccaaccatatgaaaggcgagcacaagaaattggctgaagccatattcaagctgacgtatcagaataaggtcgtgcgagtgcagcggcccaccccaagagggacagtcatggatatcattagcaggcgcgaccaaagaggatctggccaggttggtacttacgggctcaacacctttacaaatatggaggcacagcttatccggcaaatggaaggagagggcatcttcaaatcaattcagcatctgactgctaccgaggaaatagccgtgcagaactggttagctagggtaggccgtgagcgactgagtcgcatggccatctccggggatgactgcgtggtcaagcctattgatgacagattcgcaagcgcgttgacggccctcaatgatatgggaaaagtgcggaaggacatccagcaatgggaaccctctaggggttggaacgattggacacaggttccattttgctcgcaccacttccatgagctggtgatgaaagacggccgcgtcctagtggtaccctgtagaaaccaggatgaacttattgggcgggctaggatctcacagggagccggctggagcctgaaggagaccgcatgcctcggtaagtcctatgctcaaatgtggactctgatgtactttcaccgacgtgacttgagattagccgcaaatgccatatgtagtgcggttccttctcattgggtgccaacaagccgcaccacttggtccatccacgctaaacacgagtggatgaccacagaagatatgctggccgtctggaaccgggtgtggattcaggagaatccgtggatggaagacaagacgcccgtggagtcatgggaagaggtcccttatctcgggaaaagggaggaccagtggtgcggaagtatgatcggccttacctctagagcaacttgggccaagaacattcagacagctatcaatcaagttcgcagcctgataggcaacgaagagtacaccgattatatgccatccatgaaacggttcaggcgagaagaggaagaggccggggtgctatggtga

SEQ ID NO: 14540 - RNA, 9876 nt, synthetic construct
  misc_feature 1..9876: note = derived and/or modified CDS sequence (opt3) from DENV-2__EU482680__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataagcttcaactgaaagggatgagctacagtatgtgtacaggaaagttcaagatcgtcaaagaaattgctgagactcagcacggcaccatcgtgattagagtacagtatgagggtgacgggtctccatgcaagatacccttcgaaatcacggatttggagaaaaggcatgttctcggccggctgattaccgtgaacccgatcgtcacagaaaaggactcccctgtgaacatcgaggccgaacccccatttggagatagctacattataatcggcgtcgagcctgggcagttaaaactgaattggttcaagaagggatcgtctattggtcaaatgtttgagactaccatgcgaggcgctaaacgcatggccatcctaggggacacagcatgggatttcggatccctcggcggtgtgtttacttcaattgggaaggccctgcaccaggttttcggcgctatctacggagcggcatttagtggcgtgagctggaccatgaaaatacttatcggggtaattatcacgtggattggaatgaactccagatctacaagcttgtcagtcagtctggtgctcgttggcgtggtcaccctgtatcttggtgccatggtgcaggctgactccgggtgtgtagtgagctggaagaataaagaactgaagtgcggatctggcatcttcataactgataacgttcacacatggaccgagcagtacaagtttcaacccgaatcaccaagtaaattggccagcgcaattcagaaggcccatgaggaaggtatctgtggcattaggtccgtcactcggctcgagaatctgatgtggaaacagatcacccccgagttaaaccacatactgtctgaaaatgaggtgaagctaacaatcatgacgggggacattcgcggaatcatgcaggctggcaaaagatcgctcaggcctcaaccaaccgaactgaagtatagctggaaaacttgggggaaggccaagatgctttccacagagtcacataaccagaccttcttgattgatggaccggaaacagcagagtgccccaatactaaccgtgcgtggaatagtctggaggtggaagactacggctttggtgtcttcaccacgaacatctggctcaaactgcgggagaagcaggacgttttttgtgattctaaattaatgagcgctgccataaaggacaatcgagcagtgcacgccgatatggggtattggattgaatccgctctgaacgacacatggaaaatggagaaggcctcattcatcgaggtgaagagctgccactggcctaaatctcataccctttggtccaatggagtattggaaagtgagatgatcattccaaagaacttcgcaggccccgtcagccagcacaactacagacctggttatcatactcaaaccgctggcccatggcacctcgggaaactggaaatggattttgacctatgtgagggaacaactgtggttgtgaccgaagattgcggcaatagggggccctctctgcgcacaacgaccgcctccggaaagctcatcactgagtggtgctgtcggtcatgcacactgccgcctcttagatacaggggcgaggacggttgttggtacgggatggaaattcgcccattgaaagagaaggaagagaacctggtcaatagtttagtgaccgcgggacatggccagatagataacttcagcctcggtgttctgggcatggccctttttctggaagagatgttgcgaactcggatcgggacaaagcacgctattctcctggtggcagtatcgttcgtcaccctaatcacgggaaatatgtcctttcgtgacctgggcagagtgatggtgatggtcggggccactatgaccgatgacattggaacaggcgttacctatctcgctctgcttgccgcattcaaagtgaggcccacttttgcggccggtttgctgttacgcaagctcacatctaaagagctgatgatggctaccatcgggatagcccttctgagccagtcaacaatccctgaaactattctagagctcaccgatgcactggctttgggaatgatggtactgaagatcgtgcggaacatggaaaaataccaattagccgtcacgattatggcaatcagttgcgtgcccaatgccgttatactccagaacgcttggaaggtgtcctgtacaattctggcggccgtctctgtgagcccacttctgttgacctcctcacagcagaaggcagactggatccctctcgctctgactatcaaaggcctaaatcccaccgccattttcctgacaactcttagcagaaccagtaagaaaaggtcttggccactcaacgaggccataatggctgttggcatggtgtccatcctggcaagctcgttgctgaagaatgacattccgatgacggggcctttagtcgccggaggtctcctgacagtatgctatgtgcttaccggccgatcagcggatctggaattggagcgcgctgccgacgttaaatgggaggatcaagcagaaatctctgggagttcccccattctcagcatcactatatctgaggacggaagcatgtccatcaagaacgaagaggaggaacagacactgaccattctaatccggactggcctgcttgtgatttcaggtgtctttccagtgagtatccccataacagccgctgcatggtacctctgggaggtaaaaaagcagagagccggggtgctgtgggatgtccctagcccaccccctgttgaaaaggcggagttggaagacggagcttataggattaaacagcgtggcatcttaggctactctcaaatcggggccggagtgtataaggagggtaccttccacacgatgtggcatgtgactcgcggcgcagtcctgatgcaccgggggaaaagaattgagccgtcctgggccgatgtgaagaaagacctcatctcatacggaggcggttggaagctggaaggggagtggaaggaaggagaggaagttcaggtacttgctctggagccaggcaaaaatcccagggccgtgcagaccaagcctggcatatttaaaacaaacaccgggacaattggagcagtcagtttggatttcagcccaggtacttccggctctcccatcgtggaccgaaaggggaaagttgtgggactatacggcaatggtgtcgtgacccggtcgggggcttatgtaagcgccattgcgcagacggagaagtcaatcgaagataaccctgagatagaagacgatatttttcgcaagaaaagactgacaatcatggacctccatccgggagccggcaagactaaaaggtacctgcccgcaatcgtccgggaggctattaagcgaggccttagaaccttaatcctggccccaacacgcgtggttgctgcagaaatggaggaggccctcagggggttgcctattcgttatcaaaccactgccataaaaaccgaacacacaggacgggagatcgtggacctgatgtgtcatgctacgttcactatgagactcctgtcccccgtcagggtgccaaactacaatcttattatcatggatgaagcgcacttcaccgaccctgcaagtatcgccgctcgcggttatatttctacacgagttgagatgggcgaggccgcagggatatttatgaccgccactcccccaggaagcagagatccgttccctcagtccaacgctcccatcatggacgaagagcgggaaattccagagaggtcatggaattctggccacgaatgggtgacagattttaagggtaagaccgtctggttcgtgcccagcatcaaagcggggaacgacattgccgcatgcctgcgcaagaatggaaaaaaggtaatccagttgagtcgtaaaacgtttgattccgagtacgtgaagactagagctaacgactgggatttcgttgtcacaaccgacataagcgagatgggcgccaattttaaggcagaacgggtgatcgatcctaggcgctgtatgaaaccagtgattctaaccgacggcgaggaacgagtcatcctggccgggcccatgcctgtaactcattcttcagctgcccaaagacggggaaggattggtcgcaacccgaagaatgagaacgaccagtatatctacatgggcgaaccactcgagaatgatgaggactgcgcgcactggaaagaagcaaagatgttactggataacataaatacacccgaggggattatcccttccatgttcgaacccgagagagaaaaagtggacgccattgatggagagtacaggcttcggggcgaggctcgtaagacctttgttgacctgatgcgccgaggtgatctcccagtgtggttggcctataaagtcgctgcagaagggatcaactacgccgacagaaagtggtgtttcgatggcataaagaataaccagatcctggaggaaaacatggaggtggagatttggacaaaagaaggagagaggaagaaactcaagcctcggtggctggacgctcgcatctatagtgatccccttgccctaaaagaatttaaggagttcgcagcgggcagaaagagcctgactttgaatttaattacggaaatggggaggctgccaaccttcatgacacagaaagcccggaacgctctcgacaatctggccgttcttcatactgcagaggctggaggtcgagcctacaaccacgcactgtcggagctccctgaaaccttggagacactgctactgctcacccttctggccactgtgacgggcgggatctttttattcttgatgtctggaaagggcataggtaaaatgaccctggggatgtgctgcattatcacagcttccatcctcctgtggtatgcgcaaattcagccgcactggatcgccgcaagcataattcttgaatttttcctgatcgtcctcttgattcccgagccagaaaagcagagaactcctcaggataatcaactgacctacgtggtaatcgctatattaacagtggttgccgccaccatggcaaacgagatgggctttctagagaaaactaagaaggacctgggactcggctcaatcacaacgcaggaaagtgagtctaatattcttgacatcgatctgcgccccgcttccgcctggaccttgtatgcggtcgctactacattcgtgaccccaatgctgaggcatagcattgaaaactcaagtgtgaatgtcagcctcaccgccatcgcaaaccaggccacagttctgatggggcttggaaaaggttggcctctctccaagatggacattggcgtgcccctgttggctatcgggtgttactctcaggtaaatccgataactctgacggcagccttactactgctcgtggcgcactacgctattatcggaccaggccttcaagccaaagcaacccgggaggcccagaagcgtgctgccgcaggtatcatgaaaaaccctacagtcgatgggattactgtgatagacctggaacccatcccatatgatcccaagtttgagaagcagttgggccaggttatgctgctcattctgtgcgtgacccaagtccttatgatgagaacaacctgggctttatgtgaggccctgactctcgcgacgggacctatcagcacattgtgggaaggcaatccggggaggttctggaacaccactattgccgtatccatggcaaatatctttcgcggatcatacctggctggcgccggtctactgttctctataatgaaaaacaccacaaatactcggcgagggaccggaaacatcggcgagacactcggtgaaaagtggaaaagtagacttaacgcactgggcaagtcggagtttcagatttataaaaagagcgggatccaggaggtggacaggacgttggctaaagaaggaattaagcgcggcgagaccgatcatcacgccgtttcccgggggtctgccaagctgagatggttcgtggaacgtaatatggtcactcccgagggaaaagtggtcgacctcggctgcggtagggggggatggtcatactattgtggcggtctgaagaacgtgcgggaagttaaaggcttaacaaaggggggaccaggccatgaggagcctatccccatgagcacctacgggtggaatcttgtgcgcctgcaatccggagtagatgtgtttttcactcctccagaaaaatgcgacacactcctatgtgatataggcgagagttctcccaaccctaccattgaagcgggtcgaacgctgagagtcttgaatctggttgagaactggctcaataacaatacccagttctgcatcaaggtgcttaacccatatatgcccagcgtcatcgaaaagatggaggctctgcagaggaaatacgggggagcattggtgcggaatccgctgtcacgcaactccacacacgagatgtactgggtaagtaatgccactggcaacattgtgagctctgttaatatgatatccagaatgctcatcaacaggtttaccatgaagcacaaaaaggctacatatgaacctgacgtggatttaggctcagggactcgaaacattggaatcgagagcgaaaaaccaaatctggacattatcggtaagcggatagagaagatcaaacaggaacatgagacctcgtggcactacgaccaagatcatccctataagacatgggcctaccacggctcttatgagaccaaacagactgggagtgcatccagcatggtcaacggagtggtccgtcttctgacgaagccttgggacgtggttccaatggtaacacagatggccatgaccgatactacccccttcggccagcaaagagtgtttaaagaaaaggtcgacacacgcacgcaggagccgaaggaaggtaccaaaaagctaatgaaaattactgctgagtggctctggaaggagctggggaaaaagaaaacacctaggatgtgtacccgggaagagttcactagaaaggtgcgctcaaatgcggccttgggagcaatctttacagatgaaaacaagtggaaatccgctagggaggccgttgaagacggccgattctgggagctggtggatcgggagagaaatctccaccttgaaggcaagtgcgagacctgtgtctacaacatgatggggaaaagggaaaagaaactgggagagtttggtaaggcaaagggctctcgcgccatttggtatatgtggttaggggctcgtttcctggaatttgaggccttgggattcctcaatgaggaccattggtttagccggggcaacagtctgtccggtgtggaaggggagggactacacagacttggctacatcctgagggatgtaggcaaaaaggaagggggagcgatgtacgcagacgatacagccggttgggacactcgcattaccctcgaggacctgaaaaatgaagagatggtgacgaaccatatgaagggcgagcacaaaaagttggctgaagccatattcaagctgacctatcagaataaagttgtccgagtgcagcggcccacaccaagagggactgtgatggatatcattagcaggcgcgaccaaagaggatctggccaggtcggtacctacgggctcaacacatttactaatatggaggcacagcttatccggcaaatggaaggagagggcatcttcaagtcaattcagcatctgaccgctacggaggaaatagccgttcagaactggttagctagggtgggccgtgagcgactgagtcgcatggccatctccggggatgactgcgtagtgaaacctattgatgacagattcgcaagcgcgttgacagccctcaatgatatgggaaaggtccggaaagacatccagcaatgggaaccctctaggggttggaacgattggacccaggtgccattttgctcgcaccacttccatgagctggttatgaaggacggccgcgtgctagtcgtgccctgtagaaaccaggatgaacttattgggcgggctaggatctcacagggagccggctggagcctgaaggagactgcatgcctcggtaaatcctatgctcaaatgtggacactgatgtactttcaccgacgtgacttgagattagccgcaaatgccatatgtagtgcggtaccttctcattgggttccaaccagccgcactacctggtccatccacgctaagcacgagtggatgacaacggaagatatgctggccgtgtggaaccgggtctggattcaggagaatccgtggatggaagacaaaacccccgtggagtcatgggaagaggtgccttatctcgggaagagggaggaccagtggtgcggaagtcttatcggcctgacttctagagcaacatgggccaaaaacattcagaccgctatcaatcaagtccgcagcctaataggcaacgaagagtacactgattatatgccatccatgaagcggttcaggcgagaagaggaagaggccggggttctgtggtga

SEQ ID NO: 14541 - RNA, 9876 nt, synthetic construct
  misc_feature 1..9876: note = derived and/or modified CDS sequence (opt3) from DENV-2__EU482754__SS-prME
  source 1..9876: mol_type = other RNA
accgccggagtgatcgtaatgctgattcccacagctatggcattccacctcactacgagaaatggggagcctcatatgatagttggaaggcaggaaaagggtaaaagccttctgtttaagaccgaggacggcgtgaatatgtgcaccttgatggccatggatttaggggaactgtgtgaggacactatcacctacaaatgcccactactccggcaaaacgaaccggaggatattgactgttggtgcaattccacatctacctgggttacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggatcgagacctggattctgcggcatcctggcttcacaatcatggccgcaattttggcctacaccatcggcacgactcactttcagcgcgctctcattttcatcctgctgacagcagtggccccatccatgaccatgagatgcattgggatctctaacagggattttgtcgaaggagtgtcgggtggctcatgggtggacatagttctcgagcacgggagctgtgtgactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttatttgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccatcgttattactccacacagcggtgaggagcatgctgtgggcaatgacacggggaagcacggaaaagaaataaagatcacaccgcagtcctcaattaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatccagaaggagacacttgtgacgttcaagaaccctcatgccaaaaagcaagacgttgtggtcctgggctctcaggaaggggcgatgcacaccgccttgactggagcaacagagatacagatgtcctcaggtaatctactgtttaccggccatctcaaatgccgtctgcgcatggataaacttcaactgaaagggatgagctacagtatgtgtacaggaaagttcaagattgtgaaagaaatcgctgagactcagcacggcaccatcgtaattagagttcagtatgagggtgacgggtctccatgcaagatccccttcgaaattacggatttggagaaaaggcatgtgctcggccggctgataaccgtcaacccgatcgtgacagaaaaggactcccctgtcaacattgaggccgaacccccatttggagatagctacatcatcattggcgtggagcctgggcagttaaaactgaattggttcaagaagggatcgtctataggtcaaatgtttgagactaccatgcgaggcgctaaacgcatggccatcctaggggacacagcatgggatttcggatccctcggcggtgtttttacttcaattgggaaggccctgcaccaggtgttcggcgctatctacggagcggcatttagtggcgtaagctggaccatgaaaattcttatcggggtcataatcacgtggattggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcatcttcattactgataacatccacacatggaccgagcagtacaagtttcaacccgaatcaccaagtaaattggccagcgcaatacagaaggcccatgaggaaggtatttgtggcatcaggtccgtcactcggctcgagaatctgatgtggaaacagattacccccgagttaaaccacatcctgtctgaaaatgaggtgaagctaacaataatgacgggggacatccgcggaattatgcaggctggcaaaagatcgctcaggcctcaaccaaccgaactgaagtatagctggaaaacttgggggaaggccaagatgctttccacagagtcacataaccagaccttcttgatcgatggaccggaaacagcagagtgccccaatactaaccgtgcgtggaatagtctggaggtggaagactacggctttggtgtcttcaccacgaacatttggctcaaactgcgggagaagcaggacgtattttgtgattctaaattaatgagcgctgccatcaaggacaatcgagcagtgcacgccgatatggggtattggatagaatccgctctgaacgacacatggaaaatggagaaggcctcattcattgaggtaaagagctgccactggcctaaatctcataccctttggtccaatggagtattggaaagtgagatgatcatcccaaagaacttcgcaggccccgtcagccagcacaactacagacctggttatcatactcaaaccgctggcccatggcacctcgggaaactggaaatggattttgacctatgtgagggaacaactgtggttgtgaccgaagattgcggcaatagggggccctctctgcgcacaacgaccgcctccggaaagctcattactgagtggtgctgtcggtcatgcacactgccgcctcttagatacaggggcgaggacggttgttggtacgggatggaaatccgcccattgaaagagaaggaagagaacctggtcaatagtttagtgaccgcgggacatggccagattgataacttcagcctcggtgttctgggcatggccctttttctggaagagatgttgcgaactcggatagggacaaagcacgctatcctcctggtggcagtatcgttcgtcaccctaattacgggaaatatgtcctttcgtgacctgggcagagtgatggtgatggtcggggccactatgaccgatgacatcggaatgggcgttacatatctcgctctgcttgccgcattcaaagtgaggcccacctttgcggccggtttgctgttacgcaagctcacttctaaagagctgatgatggctacaattgggatcgcccttctgagccagtcaaccatacctgaaacaatcctagagctcactgatgcactggctttgggaatgatggtactgaagattgtgcggaacatggaaaaataccaattagccgtcaccatcatggcaattagttgcgtgcccaatgccgttatcctccagaacgcttggaaggtgtcctgtacgatactggcggccgtctctgtgagcccacttctgttgacatcctcacagcagaaggcagactggattcctctcgctctgaccatcaaaggcctaaatcccactgccatcttcctgaccacacttagcagaacaagtaagaaaaggtcttggccactcaacgaggccattatggctgttggcatggtgtccatactggcaagctcgttgctgaagaatgacatcccgatgaccgggcctttagtcgccggaggtctcctgacggtatgctatgtgcttacaggccgatcagcggatctggaattggagcgcgctgccgacgttaaatgggaggatcaagcagaaatttctgggagttcccccatcctcagcattaccatctctgaggacggaagcatgtccataaagaacgaagaggaggaacagactctgacaatcctaattcggaccggcctgcttgtgatctcaggtgtctttccagtgagtattcccatcactgccgctgcatggtacctctgggaggtcaagaagcagagagccggggtgctgtgggatgtccctagcccaccccctgttgaaaaggcggagttggaagacggagcttataggataaaacagcgtggcattttaggctactctcaaatcggggccggagtgtataaggagggtacattccacaccatgtggcatgtgacgcgcggcgcagtcctgatgcaccgggggaaaagaatcgagccgtcctgggccgatgtgaagaaagacctcatttcatacggaggcggttggaagctggaaggggagtggaaggaaggagaggaagttcaggtacttgctctggagccaggcaaaaatcccagggccgtgcagactaagcctggcatctttaaaaccaacacagggaccataggagcagtcagtttggatttcagcccaggtacatccggctctcccattgtggaccgaaaggggaaagttgtgggactatacggcaatggtgtcgtgactcggtcgggggcttatgtaagcgccatcgcgcagaccgagaagtcaattgaagataaccctgagatcgaagacgatatatttcgcaagaaaagactgacgattatggacctccatccgggagccggcaagacaaaaaggtacctgcccgcaatcgtccgggaggctatcaagcgaggccttagaactttaattctggccccaacccgcgtggttgctgcagaaatggaggaggccctcagggggttgcctatccgttatcaaacaaccgccattaaaactgaacacaccggacgggagatagtggacctgatgtgtcatgctacattcacgatgagactcctgtcccccgtcagggtgccaaactacaatcttatcattatggatgaagcgcacttcactgaccctgcaagtatcgccgctcgcggttatatctctacccgagttgagatgggcgaggccgcagggatttttatgacagccacacccccaggaagcagagatccgttccctcagtccaacgctcccataatggacgaagaacgggaaatcccagagaggtcatggaactctggccacgaatgggtgactgattttaagggtaagacagtctggttcgtgcccagcattaaagcggggaacgacatcgccgcatgcctgcgcaagaatggcaagaaggtaattcagttgagtcgtaaaacctttgattccgagtacgtgaagacgagagctaacgactgggatttcgttgtcactacagacatcagcgagatgggcgccaattttaaggcagaacgggtgatagatcctaggcgctgtatgaaaccagtgatcctaaccgacggcgaggaacgagtcattctggccgggcccatgcctgtaacccattcttcagctgcccaaagacggggaaggatcggtcgcaacccgaagaatgagaacgaccagtatatttacatgggcgaaccactcgagaatgatgaggactgcgcgcactggaaagaagcaaagatgttactggataacatcaatactcccgaggggataattccttccatgttcgaacccgagagagaaaaagtggacgccatcgatggagagtacaggcttcggggcgaggctcgtaagacatttgttgacctgatgcgccgaggtgatctcccagtgtggttggcctataaagtcgctgcagaagggattaactacgccgacagaaagtggtgtttcgatggcatcaagaataaccagatactggaggaaaacatggaggtggagatctggaccaaagaaggagagaggaagaaactcaagcctcggtggctggacgctcgcatttatagtgatccccttgccctaaaagaatttaaggagttcgcagcgggcagaaagagcctgacattgaatttaatcactgaaatggggaggctgccaacgttcatgacccagaaagcccggaacgctctcgacaatctggccgttcttcatacagcagaggctggaggtcgagcctacaaccacgcactgtcggagctccctgaaactttggagaccctgctactgctcacacttctggccaccgtgactggcgggatatttttattcttgatgtctggaaagggcatcggtaaaatgacgctggggatgtgctgcataattaccgcttccatcctcctgtggtatgcgcaaatccagccgcactggattgccgcaagcatcatacttgaatttttcctgattgtcctcttgatccccgagccagaaaagcagagaacacctcaggataatcaactgacttacgtggtaattgctatcttaaccgtggttgccgccacaatggcaaacgagatgggctttctagagaaaaccaagaaggacctgggactcggctcaataactacacaggaaagtgagtctaatatccttgacattgatctgcgccccgcttccgcctggacgttgtatgcggtcgctaccactttcgtgacaccaatgctgaggcatagcatcgaaaactcaagtgtgaatgtcagcctcaccgccattgcaaaccaggccaccgttctgatggggcttggaaaaggttggcctctctccaagatggacatcggcgtgcccctgttggctattgggtgttactctcaggtaaatccgatcacactgactgcagccttactactgctcgtggcgcactacgctataattggaccaggccttcaagccaaagcaacgcgggaggcccagaagcgtgctgccgcaggtatcatgaaaaaccctaccgtcgatgggatcacagtgattgacctggaacccataccatatgatcccaagtttgagaagcagttgggccaggttatgctgctcatcctgtgcgtgactcaagtccttatgatgagaaccacatgggctttatgtgaggccctgaccctcgcgactggacctattagcacgttgtgggaaggcaatccggggaggttctggaacacaaccatcgccgtatccatggcaaatatttttcgcggatcatacctggctggcgccggtctactgttctctatcatgaaaaacactaccaatacacggcgagggactggaaacataggcgagaccctcggtgaaaagtggaaaagtagacttaacgcactgggcaagtcggagtttcagatctataaaaagagcgggattcaggaggtggacaggacattggctaaagaaggaatcaagcgcggcgagacggatcatcacgccgtttcccgggggtctgccaagctgagatggttcgtggaacgtaatatggtcacccccgagggaaaagtggtcgacctcggctgcggtagagggggatggtcatactattgtggcggtctgaagaacgtgcgggaagttaaaggcttaactaaagggggaccaggccatgaggagcctattcccatgagcacatacgggtggaatcttgtgcgcctgcaatccggagtagatgtgtttttcacccctccagaaaaatgcgacactctcctatgtgatatcggcgagagttctcccaaccctacaatagaagcgggtcgaaccctgagagtcttgaatctggttgagaactggctcaataacaatacgcagttctgcattaaggtgcttaacccatatatgcccagcgtcatcgaaaagatggaggctctgcagaggaaatacgggggagcattggtgcggaatccgctgtcacgcaactccacccacgagatgtactgggtaagtaatgccacaggcaacatcgtgagctctgttaatatgatttccagaatgctcataaacaggtttactatgaagcacaaaaaggctacctatgaacctgacgtggatttaggctcagggacacgaaacatcggaattgagagcgaaatcccaaatctggacattatcggtaaacggatagagaagatcaagcaggaacatgagacttcgtggcactacgaccaagatcatccctataaaacctgggcctaccacggctcttatgagacaaagcagaccgggagtgcatccagcatggtcaacggagtggtccgtcttctgactaaaccttgggacgtggttccaatggtaacgcagatggccatgacagataccactcccttcggccagcaaagagtgtttaaggaaaaagtcgacacccgcacacaggagccgaaggaaggtacgaagaaactaatgaagattaccgctgagtggctctggaaagagctggggaagaaaaagactcctaggatgtgtacacgggaagagttcaccagaaaagtgcgctcaaatgcggccttgggagcaatctttactgatgaaaacaagtggaagtccgctagggaggccgttgaagacggccgattctgggagctggtggatcgggagagaaatctccaccttgaaggcaaatgcgagacatgtgtctacaacatgatggggaagagggagaaaaagctgggagagtttggtaaagcaaagggctctcgcgccatttggtatatgtggttaggggctcgtttcctggaatttgaggccttgggattcctcaatgaggaccattggtttagccggggcaacagtctgtccggtgtggaaggggagggactacacagacttggctacatcctgagggatgtaggcaagaaagaagggggagcgatgtacgcagacgataccgccggttgggacacacgcattactctcgaggacctgaagaatgaagagatggtgaccaaccatatgaaaggcgagcacaagaaattggctgaagccatattcaagctgacgtatcagaataaggttgtccgagtgcagcggcccaccccaagagggacagtgatggatatcattagcaggcgcgaccaaagaggatctggccaggtcggtacttacgggctcaacacctttacaaatatggaggcacagcttatccggcaaatggaaggagagggcatcttcaaatcaattcagcatctgactgctaccgaggaaatagccgttcagaactggttagctagggtgggccgtgagcgactgagtcgcatggccatctccggggatgactgcgtagtgaagcctattgatgacagattcgcaagcgcgttgacggccctcaatgatatgggaaaagtccggaaggacatccagcaatgggaaccctctaggggttggaacgattggacacaggtgccattttgctcgcaccacttccatgagctggttatgaaagacggccgcgtgctagtcgtgccctgtagaaaccaggatgaacttattgggcgggctaggatctcacagggagccggctggagcctgaaggagaccgcatgcctcggtaagtcctatgctcaaatgtggactctgatgtactttcaccgacgtgacttgagattagccgcaaatgccatatgtagtgcggtaccttctcattgggttccaacaagccgcaccacttggtccatccacgctaaacacgagtggatgaccacagaagatatgctggccgtgtggaaccgggtctggattcaggagaatccgtggatggaagacaagacgcccgtggagtcatgggaagaggtgccttatctcgggaaaagggaggaccagtggtgcggaagtcttatcggcctgacctctagagcaacttgggccaagaacattcagacagctatcaatcaagtccgcagcctaataggcaacgaagagtacaccgattatatgccatccatgaaacggttcaggcgagaagaggaagaggccggggttctgtggtga

SEQ ID NO: 14542 - RNA, 9876 nt, synthetic construct
  misc_feature 1..9876: note = derived and/or modified CDS sequence (opt3) from DENV-2__FJ478455__SS-prME
  source 1..9876: mol_type = other RNA
accgccggcgtgatagtcatgctgattccaactgctatggcattccacctcactacgagaaacggggaacctcatatgatagttggaaggcaggaaaagggtaaaagccttctgtttaagaccgaagacggcgtgaatatgtgcacattgatggccatcgatttaggggaactgtgtgaagacactattacctacaaatgcccactactccggcaaaacgaaccggaagatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagttgagtgccccaatactaacagggcatggaatagtctggaggtggaagactacggctttggtgtgttcaccacgaacatttggctcaagctgcgtgagaaacaggacgtattttgtgattctaagttaatgagcgcggctatcaaagacaatcgggccgtccacgcagatatggggtattggatagaatccgccctgaacgacacatggaagatggagaaggcttcattcattgaggtgaaaagctgccactggcctaagtctcataccctttggtccaatggagttttggaaagtgagatgatcatccccaagaatttcgccggccccgtgagccagcacaactaccgacctggttatcatactcaaaccgcaggcccatggcacctcgggaagctggaaatggattttgacttctgtgagggaacaactgtcgtggttaccgaagattgcggcaatagagggccctctctaaggacaacgaccgcttccggaaaactgattactgagtggtgctgtcgctcatgcacactcccgcctctgcggtacagaggcgaggacggttgttggtacgggatggaaatcaggccacttaaggagaaggaagagaacttggtgaatagtctggtaaccgccggacatggccagattgataactttagcttaggtgtcctcggcatggcgctgttccttgaagagatgctgcgcactcgaatagggacaaaacacgccatcttgctcgtggctgtgtcgtttgtcaccctgattacgggaaatatgtccttccgggacctaggccgtgttatggtgatggtaggggcaactatgaccgatgacatcggaatgggcgtgacatatctggccctcctggctgcctttaaggtcagacccaccttcgcagcgggtcttttgctgaggaaattaacttctaaggagctcatgatggccacaattgggatcgctctgcttagccagtcaaccatacctgaaacaatcctggagctaactgatgccctcgcactgggaatgatggtgttgaaaattgttcgcaacatggaaaagtaccaactggctgtgaccatcatggccattagttgcgtccccaatgcagtgatcttacagaacgcctggaaggtttcctgtacgatactcgctgcggtgtctgtcagcccactgcttctgacatcctcacagcagaaagccgactggattcctttggcactcaccatcaagggcctgaatcccactgctatctttctaaccacactgagccggacaagtaaaaagagatcttggccacttaacgaggccattatggccgtaggcatggtgtccatactcgctagctcgctgttgaaaaatgacatcccgatgaccgggcctctggttgcaggaggtttactcacggtgtgctatgtcctgacaggcaggtcagccgatcttgaactggagcgagcggctgacgtgaagtgggaggatcaagccgaaatttctgggagttcccccatcttgagcattaccatctctgaggacggaagcatgtccatcaagaacgaagaggaggaacagactctcacaatcctgattcgcaccggcctactggtaatctcaggtgtgttcccagtcagtattcccatcactgcagccgcttggtacctttgggaggttaagaagcagcgggcaggggtgctctgggatgtgcctagcccaccccctgtcgaaaaagccgagctggaagacggagcgtatagaataaagcagaggggcattttgggctactctcaaatcggggctggagtgtataaagagggtacatttcacaccatgtggcatgttacgcgtggcgccgtattaatgcaccgcgggaagcggatcgagccgtcctgggcagatgtgaaaaaggacctgatttcatacggaggcggttggaagctcgaaggggagtggaaagaaggagaggaagtccaggtgctggcccttgagccaggcaagaatcccagagctgttcagactaaacctggcatcttcaagaccaacacagggaccataggagccgtgagtctggattttagcccaggtacatccggctctcccattgtcgacaggaaagggaaggtggtaggattgtacggcaatggtgtcgtgactcgatcgggggcatatgttagcgctatcgcccagaccgagaagtcaattgaagataaccctgagatcgaagacgatatattccggaaaaagcgcctaacgattatggacctgcatccgggagcgggcaaaacaaagagatacctccccgccatcgtgagggaggcaatcaaacggggcctgcgaactcttattttagctccaaccagagtcgtggccgctgaaatggaggaggcactgcgcgggctccctatcaggtatcaaacacccgccattaagaccgaacacactggacgtgagatagttgacttgatgtgtcatgccaccttcacaatgcggctgctctccccagtgagagtccctaactacaatctgatcattatggatgaagctcactttacggaccccgcgagtatcgcagccaggggttatatctctactcgcgtggagatgggcgaggctgccgggattttcatgaccgcaacaccaccgggaagccgagatccttttccccagtccaacgccccaataatggacgaagagagagaaatccccgagcggtcatggaactctggccacgaatgggtaaccgatttcaagggtaaaactgtgtggtttgttcctagcattaaggctgggaacgacatcgcggcctgccttaggaaaaatggaaagaaagtcattcagctgagtcgcaagacattcgattccgagtacgtgaagacccgtgcaaacgactgggattttgtggtcacgactgacatcagcgagatgggcgctaatttcaaagccgaaagagtaatagatccacggaggtgtatgaagcccgtgatcttgacagacggcgaggaacgcgttattctagcagggcctatgccggtgacccattcttcagccgctcaacgaagaggacggatcggtaggaaccccaaaaatgagaacgaccagtatatttacatgggcgaacccctggagaatgatgaggactgcgcccactggaaggaagcgaaaatgctcttagataacatcaatacccctgaggggataattccctccatgtttgaaccagagcgcgaaaaggtcgacgcaatcgatggagagtacagactgaggggcgaggcccggaaaactttcgtggaccttatgcgtcgcggtgatctgcctgtttggctcgcttataaggtggccgctgaagggattaactacgcagaccgaaagtggtgttttgatggcatcaaaaataaccagatattggaggaaaacatggaggtcgagatctggacaaaggaaggagagaggaaaaagctgaaacccagatggctcgacgcccggatttatagtgatccactggctcttaaggagttcaaggagttcgccgcaggccgcaaaagcctaaccctgaatttgatcacagaaatggggagattacctacttttatgacgcagaaggcgaggaacgccctggacaatctcgctgtgctgcataccgccgaggcaggaggtcgggcttacaaccacgccctttcggagctgccggaaacactcgagactttgctgctactgaccctccttgcaacagtaaccggcgggattttcctgtttttaatgtctggaaaaggcatcggtaagatgactttggggatgtgctgcataattacggcctccatcctgctctggtatgctcaaatccagccccactggattgcggccagcatcatactggagttctttcttattgtgctgctcatcccagagcctgaaaaacagcgaaccccacaggataatcaattgacatacgttgtcattgcaatcctgactgtggtggctgccaccatggccaacgagatgggcttcttagagaagacaaagaaagacctaggactgggctcaataaccactcaggaaagtgagtctaatatcctcgacattgatcttagaccagcatccgcttggacactgtatgccgtcgcgacgacctttgttactcctatgttgcgccatagcatcgaaaactcaagtgtgaatgtaagcctgacagctattgccaaccaggcaaccgtgctcatggggctgggaaagggttggcccctttccaaaatggacatcggcgtcccgctcctggccattgggtgttactctcaggtgaatccaatcaccttgacagctgcactgttactactggttgcccactacgcgataattggacctggcctccaagctaaggccactagggaggcacagaaacgggccgctgccggtatcatgaagaaccccacggtggatgggatcaccgtcattgaccttgaaccaataccctatgatcctaagttcgagaaacagctgggccaggtaatgttgctgatcctctgcgtgacacaagttctgatgatgcgtactacctgggcactttgtgaggctttaacactggccaccggaccgattagcactctctgggaaggcaatcccgggagattttggaacacgacaatcgcggtgtccatggccaatattttcaggggatcatacttggcaggcgctggtctgctattttctatcatgaagaacaccacaagtacccgccgggggacaggaaatataggcgagactctgggtgaaaaatggaagtcgcgactcaacgcccttggcaaaagcgagttccagatctataagaaatccgggattcaggaggtcgacagaaccctggcaaaggaaggaatcaagaggggcgagacagatcatcacgctgtgtctcgcgggtcagccaaattgcggtggtttgtcgaaagaaacatggtgacgccagagggaaaggttgtggacctgggctgcggtcgtgggggatggagctactattgtggcggtctcaaaaatgtaagggaagtgaagggcctgaccaaagggggacctggccatgaggagcccattcctatgtccacttacgggtggaacttagtccggcttcaaagtggagttgatgtgttcttcacaccacccgaaaagtgcgacaccctgctctgtgatatcggcgagtctagccctaatccaactatagaagccggtcgcacactacgagtcctgaacttggtggagaattggctgaacaataacacccagttttgcattaaggtactcaatccctatatgccgtcagtgatcgagaaaatggaggcgcttcagagacagtacgggggagctctggttaggaaccctttgtcccggaatagtacgcacgagatgtactgggtgagcaacgcaaccggcaatatcgtctcttccgtgaacatgatttcacgcatgctgataaatagattcacaatgaagcacaaaaaggccacttatgaaccagacgtcgatctcggcagcgggaccaggaacatcggaattgagtcggaaatccccaacttagacattatcggtaaacgaatagagaagatcaagcaagaacatgagatttcttggcactacgaccaggatcatccttataaaacatgggcttaccacggcagttatgagactaagcagaccgggtccgccagctcaatggtgaatggagttgtacggctgcttacaaaaccatgggacgtggtccccatggtgacccagatggcaatgactgatacgacaccgtttggccaacagcgtgttttcaaggaaaaagtggacaccagaactcaggagcctaaggaaggtaccaagaaactgatgaagatcacagccgagtggctatggaaagagctcgggaagaaaaagacgccccgcatgtgtaccagggaagagtttactcggaaagtcagatccaacgctgcgctgggagccattttcacagatgaaaataagtggaagtctgcacgcgaggctgtggaagacggcaggttttgggagttggtagatcgagagcggaacctgcacctcgaaggcaaatgcgagacctgtgtgtacaatatgatggggaagagagagaagaaacttggagagttcggtaaagccaaaggcagcagggcaatctggtatatgtggctgggggcccgctttttagagttcgaggctctgggatttttgaacgaggaccattggttcagtcgtggcaattccctcagcggtgttgaaggggagggactgcaccggctaggctacattcttagagatgtcggcaagaaagaagggggagccatgtacgcggacgatactgcaggttgggacacaaggataaccctggaggacctcaagaacgaagagatggtgacaaatcatatgaaaggcgagcacaagaaactggccgaagctatctttaagttgacttatcagaacaaggtggtccgcgttcaacgaccaacccctcgggggacggtgatggatattatctctagaagggaccagcgcggatcaggccaggtaggtacctacgggctgaatacattcactaacatggaggcccaactcatcagacagatggaaggagagggcattttcaaaagtatacagcatcttaccgcaacagaggaaatcgctgtgcagaattggctggcccgggtcggcagggagcgtttatcccgaatggctattagcggggatgactgcgtggttaagcccatcgatgaccgctttgcctctgcactgactgcgttgaacgatatgggaaaagtgagaaaggacattcaacagtgggaaccatcgcggggttggaatgattggacccaggtccccttctgctcacaccactttcatgagctcgtgatgaaagacggcagggtactggttgtgccttgtcgcaaccaggatgaactaatcgggagagcccggataagccaaggagctggctggtcccttaaggagacggcctgcctgggtaagagttatgcacagatgtggacactcatgtacttccacaggcgagacctgcgtttggctgccaacgcaatctgttctgccgtcccaagccattgggtgccgacctccagaactacatggtcaattcacgcgaaacacgagtggatgaccactgaagatatgttagctgtgtggaatcgcgtctggatccaggagaacccctggatggaagacaagacccctgttgagagttgggaagaggtgccatatctggggaaacgggaggaccagtggtgcggatctctcattggccttacaagcagggccacgtgggcaaagaatatccaagccgctataaaccaggtaagatccctgattggcaatgaagagtacaccgattatatgccctcaatgaaacgctttcggagggaagaggaagaggccggggtgctatggtga

SEQ ID NO: 14543 - RNA, 9876 nt, synthetic construct
  misc_feature 1..9876: note = derived and/or modified CDS sequence (opt3) from DENV-2__EU482756__SS-prME
  source 1..9876: mol_type = other RNA
accgccggagtgatcgtcatgctgattcccacagctatggcattccacctcactacgagaaatggggagcctcatatgatagttggaaggcaggaaaagggtaaaagccttctgtttaagaccgaggacggcgtgaatatgtgcaccttgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatccgcggaattatgcaggctggcaaaagatcgctcaggcctcaaccaaccgaactgaagtatagctggaaaacttgggggaaggccaagatgctttccacagagtcacataaccagaccttcttgatcgatggaccggaaacagcagagtgccccaatactaaccgtgcgtggaatagtctggaggtcgaagactacggctttggtgttttcaccacgaacatttggctcaaactgcgggagaagcaggacgtgttttgtgattctaaattaatgagcgctgccatcaaggacaatcgagcagtgcacgccgatatggggtattggatagaatccgctctgaacgacacatggaaaatggagaaggcctcattcattgaggtaaagagctgccactggcctaaatctcataccctttggtccaatggagtcttggaaagtgagatgatcatcccaaagaacttcgcaggccccgtgagccagcacaactacagacctggttatcatactcaaaccgctggcccatggcacctcgggaaactggaaatggattttgacctatgtgagggaacaactgttgtggtcaccgaagattgcggcaatagggggccctctctgcgcacaacgaccgcctccggaaagctcattactgagtggtgctgtcggtcatgcacactgccgcctcttagatacaggggcgaggacggttgttggtacgggatggaaatccgcccattgaaagagaaggaagagaacctggtgaatagtttagttaccgcgggacatggccagattgataacttcagcctcggtgtgctgggcatggccctttttctggaagagatgttgcgaactcggatagggacaaagtatgctatcctcctggtagcagtctcgttcgtgaccctaattacgggaaatatgtcctttcgtgacctgggcagagtgatggtcatggttggggccactatgaccgatgacatcggaatgggcgtgacatacctcgctctgcttgccgcattcaaagtaaggcccacctttgcggccggtttgctgttacgcaagctcacttctaaagagctgatgatggctacaattgggatcgcccttctgagccagtcaaccatacctgaaacaatcctagagctcactgatgcactggctttgggaatgatggtgctgaagattgtccggaacatggaaaaatatcaattagccgtgaccatcatggcaattagttgcgttcccaatgccgtgatcctccagaacgcttggaaggtctcctgtacgatactggcggccgtgtctgttagcccacttctgttgacatcctcacagcagaaggcagactggattcctctcgctctgaccatcaaaggcctaaatcccactgccatcttcctgaccacacttagcagaacaagtaagaaaaggtcttggccactcaacgaggccattatggctgtgggcatggtctccatactggcaagctcgttgctgaagaatgacatcccgatgaccgggcctttagtagccggaggtctcctgacggtgtgctacgttcttacaggccgatcagcggatctggaattggagcgcgctgccgacgtgaaatgggaggatcaagcagaaatttctgggagttcccccatcctcagcattaccatctctgaggacggaagcatgtccataaagaacgaagaggaggaacagactctgacaatcctaattcggaccggcctgcttgtcatctcaggtgtgtttccagtaagtattcccatcactgccgctgcatggtatctctgggaggtgaaaaagcagagagccggggtcctgtgggatgttcctagcccaccccctgtggaaaaggcggagttggaagacggagcttacaggataaaacagcgtggcattttaggctattctcaaatcggggccggagtgtacaaggagggtacattccacaccatgtggcacgtcacgcgcggcgcagtgctgatgcatcgggggaaaagaatcgagccgtcctgggccgatgttaagaaagacctcatttcatacggaggcggttggaagctggaaggggagtggaaggaaggagaggaagtacaggtgcttgctctggagccaggcaaaaatcccagggccgtccagactaagcctggcatctttaaaaccaacacagggaccataggagcagtgagtttggatttcagcccaggtacatccggctctcccattgttgaccgaaaggggaaagtggtcggactatatggcaatggtgtggtaactcggtcgggggcttacgtcagcgccatcgcgcagaccgagaagtcaattgaagataaccctgagatcgaagacgatatatttcgcaagaaaagactgacgattatggacctccacccgggagccggcaagacaaaaaggtatctgcccgcaatcgtgcgggaggctatcaagcgaggccttagaactttaattctggccccaacccgcgttgtggctgcagaaatggaggaggccctcagggggttgcctatccgttaccaaacaaccgccattaaaactgaacataccggacgggagatagtcgacctgatgtgtcacgctacattcacgatgagactcctgtcccccgtgagggttccaaactataatcttatcattatggatgaagcgcatttcactgaccctgcaagtatcgccgctcgcggttacatctctacccgagtggagatgggcgaggccgcagggatttttatgacagccacacccccaggaagcagagatccgttccctcagtccaacgctcccataatggacgaagaacgggaaatcccagagaggtcatggaactctggccacgaatgggtcactgattttaagggtaagacagtgtggttcgtacccagcattaaagcggggaacgacatcgccgcatgcctgcgcaagaatggcaagaaggtgattcagttgagtcgtaaaacctttgattccgagtatgttaagacgagagctaacgactgggatttcgtcgtgactacagacatcagcgagatgggcgccaattttaaggcagaacgggtgatagatcctaggcgctgtatgaaaccagtcatcctaaccgacggcgaggaacgagtaattctggccgggcccatgcctgtgacccactcttcagctgcccaaagacggggaaggatcggtcgcaacccgaagaatgagaacgaccagtacatttacatgggcgaaccactcgagaatgatgaggactgcgcgcattggaaagaagcaaagatgttactggataacatcaatactcccgaggggataattccttccatgttcgaacccgagagagaaaaagttgacgccatcgatggagagtataggcttcggggcgaggctcgtaagacatttgtggacctgatgcgccgaggtgatctcccagtctggttggcctacaaagtggctgcagaagggattaactatgccgacagaaagtggtgtttcgatggcatcaagaataaccagatactggaggaaaacatggaggttgagatctggaccaaagaaggagagaggaagaaactcaagcctcggtggctggacgctcgcatttacagtgatccccttgccctaaaagaatttaaggagttcgcagcgggcagaaagagcctgacattgaatttaatcactgaaatggggaggctgccaacgttcatgacccagaaagcccggaacgctctcgacaatctggccgtgcttcacacagcagaggctggaggtcgagcctataaccatgcactgtcggagctccctgaaactttggagaccctgctactgctcacacttctggccaccgtcactggcgggatatttttattcttgatgtctggaaagggcatcggtaaaatgacgctggggatgtgctgcataattaccgcttccatcctcctgtggtacgcgcaaatccagccgcactggattgccgcaagcatcatacttgaatttttcctgattgtgctcttgatccccgagccagaaaagcagagaacacctcaggataatcaactgacttatgtagtgattgctatcttaaccgttgtcgccgccacaatggcaaacgagatgggctttctagagaaaaccaagaaggacctgggactcggctcaataactacacaggaaagtgagtctaatatccttgacattgatctgcgccccgcttccgcctggacgttgtacgcggtggctaccactttcgtgacaccaatgctgaggcacagcatcgaaaactcaagtgtcaatgttagcctcaccgccattgcaaaccaggccaccgtgctgatggggcttggaaaaggttggcctctctccaagatggacatcggcgtacccctgttggctattgggtgttactctcaggtgaatccgatcacactgactgcagccttactactgctcgtcgcgcattatgctataattggaccaggccttcaagccaaagcaacgcgggaggcccagaagcgtgctgccgcaggtatcatgaaaaaccctaccgtggatgggatcacagttattgacctggaacccataccatacgatcccaagtttgagaagcagttgggccaggtgatgctgctcatcctgtgcgtcactcaagtacttatgatgagaaccacatgggctttatgtgaggccctgaccctcgcgactggacctattagcacgttgtgggaaggcaatccggggaggttctggaacacaaccatcgccgtgtccatggcaaatatttttcgcggatcatatctggctggcgccggtctactgttctctatcatgaaaaacactaccaatacacggcgagggactggaaacataggcgagaccctcggtgaaaagtggaaaagtagacttaacgcactgggcaagtcggagtttcagatctacaaaaagagcgggattcaggaggttgacaggacattggctaaagaaggaatcaagcgcggcgagacggatcaccatgccgtgtcccgggggtctgccaagctgagatggttcgtcgaacgtaatatggtgacccccgagggaaaagtcgtggacctcggctgcggtagagggggatggtcatattactgtggcggtctgaagaacgttcgggaagtgaaaggcttaactaaagggggaccaggccacgaggagcctattcccatgagcacatatgggtggaatcttgtacgcctgcaatccggagtggatgtctttttcacccctccagaaaaatgcgacactctcctatgtgatatcggcgagagttctcccaaccctacaatagaagcgggtcgaaccctgagagttttgaatctggtggagaactggctcaataacaatacgcagttctgcattaaggtccttaacccatacatgcccagcgtgatcgaaaagatggaggctctgcagaggaaatacgggggagcattggtacggaatccgctgtcacgcaactccacccatgagatgtattgggtgagtaatgccacaggcaacatcgttagctctgtgaatatgatttccagaatgctcataaacaggtttactatgaagcacaaaaaggctacctacgaacctgacgtcgatttaggctcagggacacgaaacatcggaattgagagcgaaatcccaaatctggacattatcggtaaacggatagagaagatcaagcaggaacacgagacttcgtggcattatgaccaagatcacccctacaaaacctgggcctatcatggctcttacgagacaaagcagaccgggagtgcatccagcatggtgaacggagtcgtgcgtcttctgactaaaccttgggacgttgtaccaatggtgacgcagatggccatgacagataccactcccttcggccagcaaagagtctttaaggaaaaagtggacacccgcacacaggagccgaaggaaggtacgaagaaactaatgaagattaccgctgagtggctctggaaagagctggggaagaaaaagactcctaggatgtgtacacgggaagagttcaccagaaaagttcgctcaaatgcggccttgggagcaatctttactgatgaaaacaagtggaagtccgctagggaggccgtggaagacggccgattctgggagctggtcgatcgggagagaaatctccaccttgaaggcaaatgcgagacatgtgtgtataacatgatggggaagagggagaagaagctgggagagtttggtaaagcaaagggctctcgcgccatttggtacatgtggttaggggctcgtttcctggaatttgaggccttgggattcctcaatgaggaccactggtttagccggggcaacagtctgtccggtgtagaaggggagggactacatagacttggctacatcctgagggatgtgggcaagaaagaagggggagcgatgtatgcagacgataccgccggttgggacacacgcattactctcgaggacctgaagaatgaagagatggttaccaaccacatgaaaggcgagcataagaaattggctgaagccatattcaagctgacgtaccagaataaggtcgtgcgagtgcagcggcccaccccaagagggacagtcatggatatcattagcaggcgcgaccaaagaggatctggccaggttggtacttatgggctcaacacctttacaaatatggaggcacagcttatccggcaaatggaaggagagggcatcttcaaatcaattcagcacctgactgctaccgaggaaatagccgtgcagaactggttagctagggtaggccgtgagcgactgagtcgcatggccatctccggggatgactgcgtggtcaagcctattgatgacagattcgcaagcgcgttgacggccctcaatgatatgggaaaagtgcggaaggacatccagcaatgggaaccctctaggggttggaacgattggacacaggttccattttgctcgcatcacttccacgagctggtgatgaaagacggccgcgtcctagtggtaccctgtagaaaccaggatgaacttattgggcgggctaggatctcacagggagccggctggagcctgaaggagaccgcatgcctcggtaagtcctacgctcaaatgtggactctgatgtattttcatcgacgtgacttgagattagccgcaaatgccatatgtagtgcggttccttctcactgggtgccaacaagccgcaccacttggtccatccatgctaaacacgagtggatgaccacagaagatatgctggccgtctggaaccgggtgtggattcaggagaatccgtggatggaagacaagacgcccgtggagtcatgggaagaggtcccttacctcgggaaaagggaggaccagtggtgcggaagtcttatcggcctgacctctagagcaacttgggccaagaacattcagacagctatcaatcaagttcgcagcctaataggcaacgaagagtataccgattacatgccatccatgaaacggttcaggcgagaagaggaagaggccggggtgctgtggtga

SEQ ID NO: 14544 - RNA, 9876 nt, synthetic construct
  misc_feature 1..9876: note = derived and/or modified CDS sequence (opt3) from DENV-2__EU482757__SS-prME
  source 1..9876: mol_type = other RNA
accgcaggcgtgatagtcatgctgattcccactgctatggcattccacctcactacgagaaacggggagcctcatatgatagttggaaggcaggaaaagggtaaaagccttctgtttaagaccgaggacggcgtgaatatgtgcacgttgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggtcgaagactacggctttggtgttttcaccacgaacatttggctcaagctgcgtgagaaacaggacgtgttttgtgattctaagttaatgagcgctgccatcaaagacaatcgggcagtgcacgccgatatggggtattggatagaatccgctctgaacgacacatggaagatggagaaggcctcattcattgaggtaaaaagctgccactggcctaagtctcataccctttggtccaatggagtcttggaaagtgagatgatcatccccaagaatttcgcaggccccgtgagccagcacaactaccgacctggttatcatactcaaaccgctggcccatggcacctcgggaagctggaaatggattttgacctatgtgagggaacaactgttgtggtcaccgaagattgcggcaatagagggccctctctgaggacaacgaccgcctccggaaaactcattactgagtggtgctgtcgctcatgcacactgccgcctcttcggtacagaggcgaggacggttgttggtacgggatggaaatcaggccattgaaggagaaggaagagaacctggtgaatagtttagttaccgcgggacatggccagattgataacttcagcctcggtgtgctgggcatggccctttttctggaagagatgttgcgcactcgaatagggacaaaacacgctatcctcctggtagcagtctcgttcgtgaccctaattacgggaaatatgtcctttcgggacctgggccgtgtgatggtcatggttggggccactatgaccgatgacatcggaatgggcgtgacatatctcgctctgcttgccgcattcaaggtaagacccacctttgcggccggtttgctgttaaggaaactcacttctaaggagctgatgatggctacaattgggatcgcccttctgagccagtcaaccatacctgaaacaatcctagagctcactgatgcactggctttgggaatgatggtgctgaaaattgtccgcaacatggaaaagtaccaattagccgtgaccatcatggcaattagttgcgttcccaatgccgtgatcctccagaacgcttggaaggtctcctgtacgatactggcggccgtgtctgttagcccacttctgttgacatcctcacagcagaaagcagactggattcctctcgctctgaccatcaagggcctaaatcccactgccatcttcctgaccacacttagccggacaagtaaaaagagatcttggccactcaacgaggccattatggctgtgggcatggtctccatactggcaagctcgttgctgaaaaatgacatcccgatgaccgggcctttagtagccggaggtctcctgacggtgtgctatgttcttacaggcaggtcagcggatctggaattggagcgagctgccgacgtgaagtgggaggatcaagcagaaatttctgggagttcccccatcctcagcattaccatctctgaggacggaagcatgtccatcaaaaacgaagaggaggaacagactctgacaatcctaattcgcaccggcctgcttgtcatctcaggtgtgtttccagtaagtattcccatcactgccgctgcatggtacctctgggaggtgaagaagcagcgggccggggtcctgtgggatgttcctagcccaccccctgtggaaaaagcggagttggaagacggagcttatagaataaagcagaggggcattttaggctactctcaaatcggggccggagtgtataaagagggtacattccacaccatgtggcatgtcacgcgtggcgcagtgctgatgcaccgcgggaagcggatcgagccgtcctgggccgatgttaaaaaggacctcatttcatacggaggcggttggaagctggaaggggagtggaaagaaggagaggaagtacaggtgcttgctctggagccaggcaagaatcccagagccgtccagactaaacctggcatctttaagaccaacacagggaccataggagcagtgagtttggatttcagcccaggtacatccggctctcccattgttgacaggaaagggaaggtggtcggactatacggcaatggtgtggtaactcgatcgggggcttatgtcagcgccatcgcgcagaccgagaagtcaattgaagataaccctgagatcgaagacgatatatttcggaaaaagcgcctgacgattatggacctccatccgggagccggcaaaacaaagagatacctgcccgcaatcgtgagggaggctatcaaacggggccttcgaactttaattctggccccaaccagagttgtggctgcagaaatggaggaggccctccgcgggttgcctatcaggtatcaaacacccgccattaagaccgaacacactggacgtgagatagtcgacctgatgtgtcatgctaccttcacaatgcggctcctgtccccagtgagagttcctaactacaatcttatcattatggatgaagcgcacttcacggaccccgcaagtatcgccgctaggggttatatctctactcgcgtggagatgggcgaggccgcagggatttttatgaccgccacaccaccgggaagccgagatcctttcccccagtccaacgctccaataatggacgaagagagagaaatccccgagcggtcatggaactctggccacgaatgggtcaccgattttaagggtaaaactgtgtggttcgtacctagcattaaggcggggaacgacatcgccgcatgcctgaggaaaaatggaaagaaagtgattcagttgagtcgcaagacatttgattccgagtacgttaagacccgtgctaacgactgggatttcgtcgtgacgactgacatcagcgagatgggcgccaattttaaagcagaaagagtgatagatccacggaggtgtatgaagcccgtcatcctaacagacggcgaggaacgcgtaattctggccgggcctatgccggtgacccattcttcagctgcccaacgaagaggacggatcggtaggaaccccaaaaatgagaacgaccagtatatttacatgggcgaacccctcgagaatgatgaggactgcgcgcactggaaggaagcaaaaatgttactggataacatcaatacccctgaggggataattccctccatgttcgaaccagagcgcgaaaaggttgacgccatcgatggagagtacagacttaggggcgaggctcggaaaacttttgtggacctgatgcgtcgcggtgatctccctgtctggttggcctataaggtggctgcagaagggattaactacgccgaccgaaagtggtgtttcgatggcatcaaaaataaccagatactggaggaaaacatggaggttgagatctggacaaaggaaggagagaggaaaaagctcaaacccagatggctggacgctcggatttatagtgatccacttgccctaaaggaatttaaggagttcgcagcgggccgcaaaagcctgaccttgaatttaatcacagaaatggggagactgcctactttcatgacgcagaaggccaggaacgctctcgacaatctggccgtgcttcataccgcagaggctggaggtcgggcctacaaccacgcactgtcggagctcccggaaacattggagactctgctactgctcacccttctggccacagtcaccggcgggatatttttattcttgatgtctggaaaaggcatcggtaagatgactctggggatgtgctgcataattacggcttccatcctcctgtggtatgcgcaaatccagccccactggattgccgcaagcatcatacttgaatttttcctgattgtgctcttgatcccagagcctgaaaaacagcgaaccccacaggataatcaactgacatacgtagtgattgctatcttaactgttgtcgccgccaccatggcaaacgagatgggctttctagagaagacaaagaaagacctgggactcggctcaataaccactcaggaaagtgagtctaatatccttgacattgatctgagaccagcttccgcctggacattgtatgcggtggctacgaccttcgtgactcctatgctgcgccatagcatcgaaaactcaagtgtcaatgttagcctcacagccattgcaaaccaggccaccgtgctgatggggcttggaaagggttggcccctctccaaaatggacatcggcgtaccgctgttggctattgggtgttactctcaggtgaatccaatcaccctgacagcagccttactactgctcgtcgcgcactacgctataattggacctggccttcaagccaaggcaactagggaggcccagaaacgggctgccgcaggtatcatgaagaaccccacggtggatgggatcaccgttattgacctggaaccaataccctatgatcctaagtttgagaaacagttgggccaggtgatgctgctcatcctgtgcgtcacacaagtacttatgatgcgtactacctgggctttatgtgaggccctgacactcgcgaccggaccgattagcactttgtgggaaggcaatcccgggagattctggaacacgacaatcgccgtgtccatggcaaatatttttaggggatcatacctggctggcgccggtctactgttctctatcatgaagaacaccacaagtacccgccgggggacaggaaatataggcgagactctcggtgaaaaatggaagtcgcgacttaacgcactgggcaaaagcgagtttcagatctataagaaatccgggattcaggaggttgacagaaccttggctaaggaaggaatcaagaggggcgagacagatcatcacgccgtgtctcgcgggtcagccaaactgcggtggttcgtcgaaagaaacatggtgacgccagagggaaaggtcgtggacctcggctgcggtcgtgggggatggagctactattgtggcggtctgaaaaatgttagggaagtgaagggcttaaccaaagggggacctggccatgaggagcccattcctatgtccacttacgggtggaaccttgtacggctgcaaagtggagtggatgtctttttcacaccacccgaaaagtgcgacaccctcctatgtgatatcggcgagtctagccctaatccaactatagaagcgggtcgcacactgcgagttttgaacctggtggagaattggctcaacaataacacccagttctgcattaaggtccttaatccctatatgccgtcagtgatcgagaaaatggaggctctgcagagaaagtacgggggagcattggtaaggaaccctctgtcccggaatagtacgcacgagatgtactgggtgagcaacgccaccggcaatatcgtttcttccgtgaacatgatttcacgcatgctcataaatagatttacaatgaaacacaagaaagctacttatgaaccagacgtcgatttaggcagcgggaccaggaacatcggaattgagtcggaaatccccaacctggacattatcggtaagcgaatagagaagatcaaacaggaacatgagacatcttggcactacgaccaagatcatccttataagacttgggcctaccacggcagttatgagaccaaacagacagggtccgcaagctcaatggtgaatggagtcgtgcggcttctgaccaagccatgggacgttgtacccatggtgactcagatggccatgacggatacaaccccgttcggccagcaacgtgtctttaaagaaaaggtggacactagaacccaggagcctaaggaaggtacgaaaaagctaatgaaaattacagctgagtggctctggaaggagctggggaaaaagaaaaccccacgcatgtgtactagggaagagttcacacggaaggttagatccaacgcggccttgggagcaatctttaccgatgaaaataagtggaaatctgctcgcgaggccgtggaagacggcaggttctgggagctggtcgatcgagagcggaacctccaccttgaaggcaagtgcgagacttgtgtgtacaatatgatggggaaaagagaaaagaaactgggagagtttggtaaggcaaagggcagcagggccatttggtatatgtggttaggggctcgcttcctggaatttgaggccttgggattcctcaacgaggaccattggtttagtcgtggcaattccctgagcggtgtagaaggggagggactacaccggcttggctacatcctgagagatgtgtctaaaaaggaaggcggggcgatgtacgcagacgatacagccggatgggacaccaggattacactcgaggacctgaaaaacgaagagatggttactaatcatatgaagggtgagcacaaaaagttggctgaagccatattcaagctgacctatcagaacaaagtcgtgcgcgtgcagcgaccaacgcctcggggcaccgtcatggatatcatttcaagaagggaccaacgcgggagtggacaggttggcacatacggtctcaatacttttaccaacatggaggcacagcttatcagacaaatggaaggggagggaatcttcaagtccattcagcatctgacagctactgaggaaatagtggtacagaattggttagcccgggtgggcagggagcgtctgagccgaatggctatctctggcgatgactgcgtcgtgaaacccattgatgaccgcttcgcctcggcattgaccgcgctcaacgatatggggaaggttagaaaagacatccagcaatgggaaccatcacggggatggaatgattggacacaggtgcccttttgcagccaccacttccatgagctggtcatgaaggacggtagggtgctagtagttccttgtcgcaaccaggatgaacttattggcagagcccggatctcccagggggctggatggagtctgaaggagacagcctgcctcggcaaatcttatgcacaaatgtggaccctgatgtactttcacaggcgagacttgcgtttagctgccaacgcaatatgtagcgccgtgccatcccattgggtcccgacttcaagaacaacctggagtatccacgcgaagcacgagtggatgactaccgaagatatgctggctgtgtggaatcgcgtgtggattcaggagaacccctggatggaagacaaaacacctgtcgagtcttgggaagaggttccatatctcggtaagcgggaggaccagtggtgcgggagccttatcggactgacgtccagggccacctgggccaaaaatattcagactgccatcaaccaagtgagatcactaataggcaatgaagagtacacagattatatgcccagcatgaagcgcttccggagggaagaggaagaggctggcgtactgtggtga

SEQ ID NO: 14545 - RNA, 9876 nt, synthetic construct
  misc_feature 1..9876: note = derived and/or modified CDS sequence (opt3) from DENV-2__FJ906956__SS-prME
  source 1..9876: mol_type = other RNA
accgccggcgtgatcgtcatgctgattcccacagctatggcattccacctcactacgagaaacggggagcctcatatgatagttggaaagcaggaaaaaggtaagagccttctgtttaaaaccgaggacggcgtgaatatgtgcacattgatggccatcgatttaggggaactgtgtgaggacactattacctacaagtgcccactactcaggcaaaacgaaccggaggatatcgactgttggtgcaattccacatctacctgggtaacttatggaacatgtaccacgactggcgagcaccggcgcgaaaaacgatcagtggcgctggtcccccatgtgggtatggggcttgagacccgtacagaaacttggatgagtagcgagggagcttggaagcacgttcagagaattgagacctggatcctgaggcatcctggcttcacaataatggccgcaatcttggcctacaccattggcacgactcactttcagcgggctctcatcttcattctgctgacagcagtggccccatccatgaccatgcgctgcatcgggatatctaacagagattttgtcgaaggagtgtcgggtggctcatgggtagacattgttctcgagcacgggagctgtgtgactacaatggctaagaataaacccaccttagatttcgaactgatcaagacggaggccaaacagcctgcgacccttaggaagtattgcattgaagcaaaattgacaaacactaccacagagagtcggtgtccaactcaaggagagccctccctgaatgaagagcaggacaagcgctttatctgcaagcattctatggtcgatcgaggctggggtaacgggtgtggactattcggcaaaggcgggatcgtgacctgcgccatgtttacatgcaagaaaaatatggaaggaaaggtggtccagcctgagaacctcgaatacaccattgttataactccacacagcggtgaggagcatgctgtgggcaatgacacggggaaacacggaaaggaaatcaaaattacaccgcagtcctcaatcaccgaggccgaactgactggctatggtaccgtaacaatggagtgtagtcccagaaccgggcttgatttcaacgaaatggtgctgttgcaaatggaggacaaggcatggctcgtccacaggcagtggtttctggatttacctctgccatggctccccggcgctgacactcagggaagcaattggatacagaaggagacacttgtgacgttcaaaaaccctcatgccaagaaacaagacgttgtggtcctgggctctcaggaaggggcgatgcacaccgccttgactggagcaacagagattcagatgtcctcaggtaatctactgtttaccggccatctcaagtgccggctgcgtatggataaacttcaactgaaggggatgagctacagtatgtgtacaggaaagttcaaaatcgtgaaggaaatcgctgagactcagcacggcaccattgtaatccgcgttcagtatgagggtgacgggtctccatgcaaaattcccttcgaaataacggatttggagaagagacatgtgctcggcaggctgatcaccgtcaacccgattgtgacaggaaaagactcccctgtcaacatcgaagccgagcccccatttggcgatagctacatcattataggggtggaacctggacagttaaagctgaattggttcaagaaaggttcgtctatcggccaaatgtttgagactaccatgcggggggctaagcgaatggccattctaggagacacagcatgggatttcggctccctcggtggggtttttacttcaatcggcaaagccctgcaccaggtgttcggagctatttacggcgcggcatttagtggggtaagctggaccatgaagatccttataggagtcatcattacgtggatcggcatgaactcccgctctacaagcttgtcagtgagtctggttctcgtgggtgtcgtgaccctgtatcttggggccatggtacaggctgactccggatgtgtggttagctggaaaaataaggagctgaagtgcggctctggtattttcatcactgataacgtccacacatggaccgaacagtacaaatttcaacccgagtcaccaagtaagttggccagcgcaatacagaaagcccatgaagagggcatttgtgggatcagatccgtgactaggctcgaaaatctgatgtggaagcagattacccccgagttaaaccacatcctgtctgagaatgaagtgaaactaacaataatgacgggagacatccggggcattatgcaggctgggaagcgctcgctcagacctcaaccaaccgagctgaaatatagctggaagacttggggaaaggccaaaatgctttccacagaatcacataaccagaccttcttgatcgatggcccggagacagcagaatgccccaatactaacagggcgtggaatagtctggaggtcgaggactacggttttggggttttcaccacgaacatttggctcaagctgcgtgaaaaacaggacgtgttttgtgattctaagttaatgagcgctgccatcaaagacaatcgggcagtgcacgccgatatgggatattggatagagtccgctctgaacgacacatggaagatggaaaaggcctcattcattgaggtaaaaagctgccactggcctaagtctcataccctttggtccaatggcgtcttggagagtgaaatggtgatcccaaaaaacttcgcaggtcccgttagccagcacaactaccgacctggctatcatactcaaaccgctgggccatggcacctcggaaagctggagatggattttgacctatgtgaaggcacaactgtggtcgtgaccgaggattgcgggaatagaggaccctctctgaggacaacgaccgcctccggcaaactcatcactgaatggtgctgtcgctcatgcacactgccgcctcttcggtacagaggtgaggacgggtgttggtacggaatggagattaggccattgaaggaaaaggaggaaaacctggttaatagtttagtgaccgcgggccatggtcagatcgataacttcagcctcggcgtactggggatggccctttttctggaggaaatgttgcgcactcgaattggaacaaaacacgctatactcctggtcgcagtgtcgttcgtgaccctaatcacgggcaatatgtcctttcgggacctggggcgtgtcatggttatggtgggagccactatgaccgatgacattggcatgggtgtaacatatctcgctctgcttgccgcattcaaggtgagacccacctttgcggccgggttgctgttaaggaaactcacttctaaggagctgatgatggctacaatcggaattgcccttctgagccagtcaaccatccctgagacaatactagaactcactgatgcactggctttgggcatgatggtcctgaaaatcgtgcgcaacatggagaagtaccaattagccgttaccattatggcaatcagttgcgtgcccaatgccgtcattctccagaacgcttggaaggtgtcctgtacgatcctggcggccgtttctgtgagcccacttctgttgacatcctcacagcagaaagcagactggatacctctcgctctgaccattaagggcctaaatcccactgccatcttcctgaccacacttagccggactagtaaaaagagatcttggccactcaacgaagccatcatggctgtcgggatggtatccattctggcaagctcgttgctgaaaaatgacataccgatgaccggacctttagtggccggtggcctcctgacggtttgctatgtgcttacagggaggtcagcggatctggagttggaacgagctgccgacgtcaagtgggaggatcaagcagagatctctggaagttcccccattctcagcatcaccatttctgaagacggcagcatgtccatcaaaaacgaggaagaggagcagactctgacaatactaatccgcaccggtctgcttgtgatttcaggggtatttccagtgagtatccccattactgccgctgcatggtacctctgggaagtcaagaagcagcgggccggagttctgtgggatgtgcctagcccaccccctgtggagaaagcggaattggaggacggcgcttatagaatcaagcagaggggcatattagggtactctcaaattggagccggtgtctataaagaaggcacattccacaccatgtggcatgtgacgcgtggggcagttctgatgcaccgcggaaagcggatcgagccgtcctgggccgatgtaaaaaaggacctcatctcatacggcggtgggtggaagctggagggagaatggaaagagggcgaagaggtgcaggtccttgctctggaaccaggcaagaatcccagagccgtgcagactaaacctgggatttttaagaccaacacaggaaccatcggtgcagttagtttggatttcagcccaggcacatccgggtctcccatagtggacaggaaaggaaaggtcgtgggcctatacggtaatggggtagtcactcgatcgggagcttatgtgagcgccattgcgcagaccgagaagtcaatcgaggataaccctgaaattgaggacgatatctttcggaaaaagcgcctgacgataatggacctccatccgggcgccggcaaaacaaagagatacctgcccgcaattgttagggaagctatcaaacgggggcttcgaactttaatcctggccccaaccagagtggtcgctgcagagatggaagaggccctccgcggattgcctattaggtatcaaacaaccgccatcaagactgagcacaccggtcgtgaaattgtggacctgatgtgtcatgctacattcacgatgcggctcctgtcccccgttagagtgccaaactacaatcttataatcatggatgaggcgcacttcactgaccctgcaagtattgccgctaggggctatatctctacccgcgtcgaaatgggggaggccgcaggaatctttatgacagccacccccccaggcagccgagatccgttccctcagtccaacgctcccattatggacgaggaaagagagataccagaacggtcatggaattctggtcacgagtgggtgactgattttaaggggaaaacagtatggttcgtgcccagcatcaaggcgggaaacgacattgccgcatgcctgaggaaaaatggcaagcgcgttatccagttgagtcgtaaaacctttgattccgaatacgtcaagacgagagctaacgactgggatttcgtggtgactacagacattagcgagatgggcgccaattttaaggcagagcgggtcatcgatcctaggcgctgtatgaaaccagtaatactaaccgacggggaagagcgagtgatcctggccggacccatgcctgttacccattcttcagctgcccaaagacggggtaggattggccgcaacccgaagaatgaaaacgaccagtatatctacatgggggagccactcgaaaatgatgaggactgcgcgcactggaaagaggcaaagatgttactggataacattaatactcccgaaggaatcataccttccatgttcgagcccgaaagagagaaagtggacgccattgatggcgaatacaggcttcggggtgaggctcgtaagacatttgtcgacctgatgcgccgaggggatctcccagtgtggttggcctataaagttgctgcagagggcatcaactacgccgacagaaagtggtgtttcgatggaattaagaataaccagatcctggaagagaacatggaagtggagatatggaccaaagagggcgaaaggaagaaactcaagcctcggtggctggacgctcgcatctatagtgatccccttgccctaaaagagtttaaggaattcgcagcggggagaaagagcctgacattgaatttaattactgagatgggaaggctgccaacgttcatgacccagaaagcccggaacgctctcgacaatctggccgtccttcatacagcagaagctggtggccgagcctacaaccacgcactgtcggagctccctgagactttggaaaccctgctactgctcacacttctggccaccgtgactgggggaatctttttattcttgatgtctggcaagggtattgggaaaatgacgctgggcatgtgctgcatcataaccgcttccattctcctgtggtatgcgcaaatccagccgcactggatcgccgcaagcattatccttgagtttttcctgatagtactcttgattcccgaaccagagaagcagagaacacctcaggataatcaactgacttacgtggttatcgctattttaaccgtcgtggccgccacaatggcaaacgaaatgggatttctagagaaaaccaagaaggacctgggcctcgggtcaatcactacacaggagagtgaatctaatatacttgacatcgatctgcgccccgcttccgcctggacgttgtatgcggtggctaccactttcgtcacaccaatgctgaggcatagcattgagaactcaagtgttaatgtgagcctcaccgccatcgcaaaccaggccaccgtactgatgggacttggtaaaggctggcctctctccaagatggacattggggtgcccctgttggctatcggatgttactctcaggtcaatccgattacactgactgcagccttactactgctcgtggcgcactacgctatcataggcccaggtcttcaagccaaagcaacgcgggaagcccagaagcgtgctgccgcagggattatgaaaaaccctaccgttgatggcatcacagtgatcgacctggagcccattccatatgatcccaagtttgaaaagcagttgggacaggtcatgctgctcatactgtgcgtaactcaagtgcttatgatgagaaccacatgggctttatgtgaggccctgaccctcgcgactggccctatcagcacgttgtgggaggggaatccgggaaggttctggaacacaaccattgccgtttccatggcaaatatctttcgcggctcatacctggctggtgccgggctactgttctctattatgaaaaacactaccaatacacggcgaggaactggcaacatcggtgaaaccctcggcgagaagtggaaaagtagacttaacgcactggggaagtcggaatttcagatatataaaaagagcggaatccaggaggtggacaggacattggctaaagagggcattaagcgcggggaaacggatcatcacgccgtctcccggggatctgccaagctgagatggttcgtggagcgtaatatggtcacccccgaaggcaaagtggttgacctcggttgcgggaggggaggctggtcatactattgtggtggcctgaagaacgtgcgggaggtaaaagggttaactaagggaggcccagggcatgaagagcctatccccatgagcacatacggatggaatcttgtgcgcctgcaatccggcgtcgatgtttttttcacccctccagagaaatgcgacactctcctatgtgatattggtgaaagttctcccaaccctacaatcgaggcggggcgaaccctgagagtgttgaatctggtcgaaaactggctcaataacaatacgcagttctgcataaaggtgcttaacccatatatgcccagcgtaattgagaagatggaagctctgcagaggaaatacggaggcgcattggtgcggaatccgctgtcacgcaactccacccacgagatgtactgggttagtaatgccacaggcaacatcgtgagctctgtcaatatgatctccagaatgctcattaacaggtttactatgaagcacaaaaaggctacctatgagcctgacgtggatttagggtcaggaacacgaaacataggtatcgaaagcgagattccaaatctggacatcattggcaaacggatcgaaaagataaagcaggagcatgaaacttcgtggcactacgaccaagatcatccctataaaacctgggcctaccacgggtcttatgagacaaagcagaccggaagtgcatccagcatggtcaacggcgtggttcgtcttctgactaaaccttgggacgtagtgccaatggtcacgcagatggccatgacagataccactcccttcggtcagcaaagagtgtttaaggagaaagttgacacccgcacacaggaaccgaaggaggggacgaagaaactaatgaagatcaccgctgaatggctctggaaagagctgggaaagaaaaagactcctaggatgtgtacacgggaggaattcaccagaaaagtgcgctcaaatgcggccttgggcgcaatttttactgatgagaacaagtggaagtccgctagggaagccgtcgaggacggccgattctgggaactggtggatcgggagagaaatctccaccttgaggggaaatgcgaaacatgtgtatacaacatgatgggaaagagggagaaaaagctgggtgaatttggcaaagcaaaggggtctcgcgccatctggtatatgtggttaggagctcgtttcctggagtttgaagccttgggcttcctcaatgaggaccattggtttagccggggtaacagtctgtccggggtggagggagaaggcctacacagacttggctacattctgagggatgttgggaagaaagagggaggtgcgatgtacgcagacgataccgccggctgggacacacgcatcactctcgaagacctgaagaatgaggaaatggtcaccaaccatatgaaaggggagcacaagaaattggctgaggccattttcaagctgacgtatcagaataaggtggtgcgagtccagcggcccaccccaagaggaacagttatggatataatcagcaggcgcgaccaaagaggctctggtcaggtggggacttacggactcaacacctttacaaatatggaagcacagcttattcggcaaatggagggcgaaggcatcttcaaatcaatccagcatctgactgctaccgaggagattgccgtacagaactggttagctagggtggggcgtgaacgactgagtcgcatggccatatccggagatgactgcgtcgtgaagcctatcgatgacagattcgcaagcgcgttgacggccctcaatgatatgggtaaagttcggaaggacattcagcaatgggagccctctaggggctggaacgattggacacaggtgccattttgctcgcaccacttccatgaactggtcatgaaagacgggcgcgtgctagtagttccctgtagaaaccaggatgagcttatcggacgggctaggatttcacagggcgccggttggagcctgaaggaaaccgcatgcctcgggaagtcctatgctcaaatgtggactctgatgtactttcaccgacgtgacttgagattagccgcaaatgccatctgtagtgcggtgccttctcattgggtcccaacaagccgcaccacttggtccatacacgctaaccacgagtggatgaccacagaggatatgctggccgtgtggaatcgggtgtggatccaggaaaacccgtggatggaggacaaaacgcccgtcgaatcatgggaggaagttccttatctcggaaagagggaggaccagtggtgcggcagtcttattggcctgacctctagagcaacttgggccaaaaatatccagacagctattaaccaagtgcgcagcctaatcgggaatgaggaatacaccgattatatgccatccatgaagcggttcaggcgagaggaagaggaagccggagtactgtggtga

SEQ ID NO: 14546 - RNA, 9876 nt, synthetic construct
  misc_feature 1..9876: note = derived and/or modified CDS sequence (opt3) from DENV-2__EU482759__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctacaagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatccgcggaattatgcaggctggcaaaagatcgctcaggcctcaaccaaccgaactgaagtatagctggaaaacttgggggaaggccaagatgctttccacagagtcacataaccagaccttcttgatcgatggaccggaaacagcagagtgccccaatactaaccgtgcgtggaatagtctggaggtcgaagactacggctttggtgttttcaccacgaacatttggctcaaactgcgggagaagcaggacgtgttttgtgattctaaattaatgagcgctgccatcaaggacaatcgagcagtgcacgccgatatggggtattggatagaatccgctctgaacgacacatggaaaatggagaaggcctcattcattgaggtaaagagctgccactggcctaaatctcataccctttggtccaatggagtcttggaaagtgagatgatcatcccaaagaacttcgcaggccccgtgagccagcacaactacagacctggttatcatactcaaaccgctggcccatggcacctcgggaaactggaaatggattttgacctatgtgagggaacaactgttgtggtcaccgaagattgcggcaatagggggccctctctgcgcacaacgaccgcctccggaaagctcattactgagtggtgctgtcggtcatgcacactgccgcctcttagatacaggggcgaggacggttgttggtacgggatggaaatccgcccattgaaagagaaggaagagaacctggtgaatagtttagttaccgcgggacatggccagattgataacttcagcctcggtgtgctgggcatggccctttttctggaagagatgttgcgaactcggatagggacaaagcacgctatcctcctggtagcagtctcgttcgtgaccctaattacgggaaatatgtcctttcgtgacctgggcagagtgatggtcatggttggggccactatgaccgatgacatcggaatgggcgtgacatatctcgctctgcttgccgcattcaaagtaaggcccacctttgcggccggtttgctgttacgcaagctcacttctaaagagctgatgatggctacaattgggatcgcccttctgagccagtcaaccatacctgaaacaatcctagagctcactgatgcactggctttgggaatgatggtgctgaagattgtccggaacatggaaaaataccaattagccgtgaccatcatggcaattagttgcgttcccaatgccgtgatcctccagaacgcttggaaggtctcctgtacgatactggcggccgtgtctgttagcccacttctgttgacatcctcacagcagaaggcagactggattcctctcgctctgaccatcaaaggcctaaatcccactgccatcttcctgaccacacttagcagaactagtaagaaaaggtcttggccactcaacgaggccattatggctgtgggcatggtctccatactggcaagctcgttgctgaagaatgacatcccgatgaccgggcctttagtagccggaggtctcctgacggtgtgctatgttcttacaggccgatcagcggatctggaattggagcgcgctgccgacgtgaaatgggaggatcaagcagaaatttctgggagttcccccatcctcagcattaccatctctgaggacggaagcatgtccataaagaacgaagaggaggaacagactctgacaatcctaattcggaccggcctgcttgtcatctcaggtgtgtttccagtaagtattcccatcactgccgctgcatggtacctctgggaggtgaaaaagcagagagccggggtcctgtgggatgttcctagcccaccccctgtggaaaaggcggagttggaagacggagcttataggataaaacagcgtggcattttaggctactctcaaatcggggccggagtgtataaggagggtacattccacaccatgtggcatgtcacgcgcggcgcagtgctgatgcaccgggggaaaagaatcgagccgtcctgggccgatgttaagaaagacctcatttcatacggaggcggttggaagctggaaggggagtggaaggaaggagaggaagtacaggtgcttgctctggagccaggcaaaaatcccagggccgtccagactaagcctggcatctttaaaaccaacacagggaccataggagcagtgagtttggatttcagcccaggtacatccggctctcccattgttgaccgaaaggggaaagtggtcggactatacggcaatggtgtggtaactcggtcgggggcttatgtcagcgccatcgcgcagaccgagaagtcaattgaagataaccctgagatcgaagacgatatatttcgcaagaaaagactgacgattatggacctccatccgggagccggcaagacaaaaaggtacctgcccgcaatcgtgcggggcgctatcaagcgagggcttagaactttaattctggccccaacccgcgttgtggctgcagagatggaagaggccctcaggggattgcctatccgttatcaaacaaccgccattaaaactgagcacaccggtcgggaaatagtcgacctgatgtgtcatgctacattcacgatgagactcctgtcccccgtgagggttccaaactacaatcttatcattatggatgaggcgcacttcactgaccctgcaagtatcgccgctcgcggctatatctctacccgagtggaaatgggggaggccgcaggaatttttatgacagccacccccccaggcagcagagatccgttccctcagtccaacgctcccataatggacgaggaacgggagatcccagaaaggtcatggaattctggtcacgagtgggtcactgattttaaggggaagacagtgtggttcgtacccagcattaaagcgggaaacgacatcgccgcatgcctgcgcaagaatggcaaaaaggtgattcagttgagtcgtaaaacctttgattccgaatacgttaagacgagagctaacgactgggatttcgtcgtgactacagacatcagcgagatgggcgccaattttaaggcagagcgggtgatagatcctaggcgctgtatgaaaccagtcatcctaaccgacggggaagagcgagtaattctggccggacccatgcctgtgacccattcttcagctgcccaaagacggggtaggatcggccgcaacccgaagaatgaaaacgaccagtatatttacatgggggagccactcgaaaatgatgaggactgcgcgcactggaaagaggcaaagatgttactggataacatcaatactcccgaaggaataattccttccatgttcgagcccgaaagagagaaagttgacgccatcgatggcgaatacaggcttcggggtgaggctcgtaagacatttgtggacctgatgcgccgaggggatctcccagtctggttggcctataaagtggctgcagagggcattaactacgccgacagaaagtggtgtttcgatggaatcaagaataaccagatactggaagagaacatggaagttgagatctggaccaaagagggcgaaaggaagaaactcaagcctcggtggctggacgctcgcatttatagtgatccccttgccctaaaagagtttaaggaattcgcagcggggagaaagagcctgacattgaatttaatcactgagatgggaaggctgccaacgttcatgacccagaaagcccggaacgctctcgacaatctggccgtgcttcatacagcagaagctggtggccgagcctacaaccacgcactgtcggagctccctgagactttggaaaccctgctactgctcacacttctggccaccgtcactgggggaatttttttattcttgatgtctggcaagggtatcgggaaaatgacgctgggcatgtgctgcataattaccgcttccatcctcctgtggtatgcgcaaatccagccgcactggattgccgcaagcatcatacttgagtttttcctgattgtgctcttgatccccgaaccagagaagcagagaacacctcaggataatcaactgacttacgtagtgattgctatcttaaccgttgtcgccgccacaatggcaaacgaaatgggatttctagagaaaaccaagaaggacctgggcctcgggtcaataactacacaggagagtgaatctaatatccttgacattgatctgcgccccgcttccgcctggacgttgtatgcggtggctaccactttcgtgacaccaatgctgaggcatagcatcgagaactcaagtgtcaatgttagcctcaccgccattgcaaaccaggccaccgtgctgatgggacttggtaaaggctggcctctctccaagatggacatcggggtacccctgttggctattggatgttactctcaggtgaatccgatcacactgactgcagccttactactgctcgtcgcgcactacgctataattggcccaggtcttcaagccaaagcaacgcgggaagcccagaagcgtgctgccgcagggatcatgaaaaaccctaccgtggatggcatcacagttattgacctggagcccataccatatgatcccaagtttgaaaagcagttgggacaggtgatgctgctcatcctgtgcgtcactcaagtacttatgatgagaaccacatgggctttatgtgaggccctgaccctcgcgactggccctattagcacgttgtgggaggggaatccgggaaggttctggaacacaaccatcgccgtgtccatggcaaatatttttcgcggctcatacctggctggtgccgggctactgttctctatcatgaaaaacactaccaatacacggcgaggaactggcaacataggtgaaaccctcggcgagaagtggaaaagtagacttaacgcactggggaagtcggaatttcagatctataaaaagagcggaattcaggaggttgacaggacattggctaaagagggcatcaagcgcggggaaacggatcatcacgccgtgtcccggggatctgccaagctgagatggttcgtcgagcgtaatatggtgacccccgaaggcaaagtcgtggacctcggttgcgggaggggaggctggtcatactattgtggtggcctgaagaacgttcgggaggtgaaagggttaactaagggaggcccagggcatgaagagcctattcccatgagcacatacggatggaatcttgtacgcctgcaatccggcgtggatgtctttttcacccctccagagaaatgcgacactctcctatgtgatatcggtgaaagttctcccaaccctacaatagaggcggggcgaaccctgagagttttgaatctggtggaaaactggctcaataacaatacgcagttctgcattaaggtccttaacccatatatgcccagcgtgatcgagaagatggaagctctgcagaggaaatacggaggcgcattggtacggaatccgctgtcacgcaactccacccacgagatgtactgggtgagtaatgccacaggcaacatcgttagctctgtgaatatgatttccagaatgctcataaacaggtttactatgaagcacaaaaaggctacctatgagcctgacgtcgatttagggtcaggaacacgaaacatcggtattgaaagcgagatcccaaatctggacattatcggcaaacggatagaaaagatcaagcaggagcatgaaacttcgtggcactacgaccaagatcatccctataaaacctgggcctaccacgggtcttatgagacaaagcagaccggaagtgcatccagcatggtgaacggcgtcgtgcgtcttctgactaaaccttgggacgttgtaccaatggtgacgcagatggccatgacagataccactcccttcggtcagcaaagagtctttaaggagaaagtggacacccgcacacaggaaccgaaggaggggacgaagaaactaatgaagattaccgctgaatggctctggaaagagctgggaaagaaaaagactcctaggatgtgtacacgggaggaattcaccagaaaagttcgctcaaatgcggccttgggcgcaatctttactgatgagaacaagtggaagtccgctagggaagccgtggaggacggccgattctgggaactggtcgatcgggagagaaatctccaccttgaggggaaatgcgaaacatgtgtgtacaacatgatgggaaagagggagaaaaagctgggtgaatttggcaaagcaaaggggtctcgcgccatttggtatatgtggttaggagctcgtttcctggagtttgaagccttgggcttcctcaatgaggaccattggtttagccggggtaacagtctgtccggggtagagggagaaggcctacacagacttggctacatcctgagggatgtggggaagaaagagggaggtgcgatgtacgcagacgataccgccggctgggacacacgcattactctcgaagacctgaagaatgaggaaatggttaccaaccatatgaaaggggagcacaagaaattggctgaggccatattcaagctgacgtatcagaataaggtcgtgcgagtgcagcggcccaccccaagaggaacagtcatggatatcattagcaggcgcgaccaaagaggctctggtcaggttgggacttacggactcaacacctttacaaatatggaagcacagcttatccggcaaatggagggcgaaggcatcttcaaatcaattcagcatctgactgctaccgaggagatagccgtgcagaactggttagctagggtagggcgtgaacgactgagtcgcatggccatctccggagatgactgcgtggtcaagcctattgatgacagattcgcaagcgcgttgacggccctcaatgatatgggtaaagtgcggaaggacatccagcaatgggagccctctaggggctggaacgattggacacaggttccattttgctcgcaccacttccatgaactggtgatgaaagacgggcgcgtcctagtggtaccctgtagaaaccaggatgagcttattggacgggctaggatctcacagggcgccggttggagcctgaaggaaaccgcatgcctcgggaagtcctatgctcaaatgtggactctgatgtactttcaccgacgtgacttgagattagccgcaaatgccatatgtagtgcggttccttctcattgggtgccaacaagccgcaccacttggtccatccacgctaaacacgagtggatgaccacagaggatatgctggccgtctggaaccgggtgtggattcaggaaaatccgtggatggaggacaagacgcccgtggaatcatgggaggaagtcccttatctcggaaaaagggaggaccagtggtgcggcagtcttatcggcctgacctctagagcaacttgggccaagaacattcagacagctatcaatcaagttcgcagcctaatagggaacgaggaatacaccgattatatgccatccatgaaacggttcaggcgagaggaagaggaagccggagtgctgtggtga

SEQ ID NO: 14547 - RNA, 9876 nt, synthetic construct
  misc_feature 1..9876: note = derived and/or modified CDS sequence (opt3) from DENV-2__EU482760__SS-prME
  source 1..9876: mol_type = other RNA
accgccggagtgatcgtcatgctgattcccacggctatggcattccacctcactacgagaaatggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtgcgaccacgggcgagcaccgccgagaaaagcgttcagtggctctggtcccccatgtgggtatggggcttgagactaggaccgaaacatggatgagtagcgagggagcctggaaacacgttcagaggattgagacttggatcctgcggcatcctggcttcaccattatggcagccatcttggcttacacaattggcaccacgcactttcagcgcgcactcatcttcattctgctgactgccgtggctccatccatgacaatgagatgcatcgggatatctaacagggattttgtcgaaggagtgtcgggtggctcatgggtagacattgttctcgagcacgggagctgtgtgaccactatggccaagaataagcccacattagatttcgaactgatcaaaaccgaggcgaagcagcctgcaacgcttcggaaatattgcattgaagccaagttgaccaacacaactaccgagagtcgctgtccaacacaaggagagccctccctgaatgaggaacaggacaaacgatttatctgcaagcattctatggtcgatagaggctggggtaacgggtgtggactattcggcaagggcgggatcgtgacttgcgctatgtttacctgcaaaaagaatatggaaggaaaagtggtccagcctgagaacctcgaatacacaattgttataaccccacacagcggtgaggagcatgccgtgggcaatgacactgggaagcacggaaaagaaatcaagattacgccgcagtcctcaatcacagaggcagaactgaccggctatggtactgtaaccatggagtgtagtcccaggacagggcttgatttcaacgaaatggtgctgttgcaaatggaggacaaggcttggctcgtccaccggcagtggtttctggatttacctctgccatggctccccggcgccgacacccagggaagcaattggatacagaaggagactcttgtgacattcaagaaccctcatgcgaaaaagcaagacgttgtggtcctgggctctcaggaaggggccatgcacacggcattgaccggagctactgagattcagatgtcctcaggtaatctactgtttacaggccatctcaaatgccgtctgcgcatggataaacttcaactgaaagggatgagctacagtatgtgtaccggaaagttcaagatcgtgaaagaaatcgccgagacacagcacggcactattgtaatcagagttcagtatgagggtgacgggtctccatgcaagattcccttcgaaataaccgatttggagaaaaggcatgtgctcggccggctgatcacggtcaacccgattgtgaccgaaaaggactcccctgtcaacatcgaggctgaacccccatttggagatagctacatcattataggcgtggagcctgggcagttaaaactgaattggttcaagaagggatcgtctatcggtcaaatgtttgagacaactatgcgaggcgccaaacgcatggcaattctaggggacaccgcctgggatttcggatccctcggcggtgtttttacatcaatcgggaaggctctgcaccaggtgttcggcgcgatttacggagcagcctttagtggcgtaagctggactatgaaaatccttataggggtcatcattacctggatcggaatgaactccagatctacgagcttgtcagtgagtctggttctcgtgggcgtcgtgacactgtatcttggtgctatggtacaggccgactccgggtgtgtggttagctggaagaataaagaactgaagtgcggatctggcattttcatcaccgataacgtccacacttggacagagcagtacaagtttcaacccgaatcaccaagtaaattggcaagcgccatacagaaggctcatgaggaaggtatttgtggcatcaggtccgtgacccggctcgagaatctgatgtggaaacagattactcccgagttaaaccacatcctgtctgaaaatgaggtgaagctaaccataatgacaggggacatccgcggaattatgcaggccggcaaaagatcgctcaggcctcaaccaacggaactgaagtatagctggaaaacctgggggaaggcaaagatgctttccactgagtcacataaccagacattcttgatcgatggaccggaaaccgcggagtgccccaatacaaaccgtgcttggaatagtctggaggtcgaagactacggctttggtgttttcactaccaacatttggctcaaactgcgggagaagcaggacgtgttttgtgattctaaattaatgagcgccgcaatcaaggacaatcgagccgtgcacgctgatatggggtattggatagaatccgccctgaacgacacgtggaaaatggagaaggcatcattcattgaggtaaagagctgccactggcctaaatctcatacactttggtccaatggagtcttggaaagtgagatgatcatcccaaagaacttcgctggccccgtgagccagcacaactacagacctggttatcatacccaaactgccggcccatggcacctcgggaaactggaaatggattttgacctatgtgagggaaccacagttgtggtcactgaagattgcggcaatagggggccctctctgcgcaccacaacggcgtccggaaagctcattaccgagtggtgctgtcggtcatgcactctgccgcctcttagatacaggggcgaggacggttgttggtacgggatggaaatccgcccattgaaagagaaggaagagaacctggtgaatagtttagttacagccggacatggccagattgataacttcagcctcggtgtgctgggcatggctctttttctggaagagatgttgcgaacccggatagggactaagcacgcaatcctcctggtagccgtctcgttcgtgacactaattaccggaaatatgtcctttcgtgacctgggcagagtgatggtcatggttggggctacgatgactgatgacatcggaatgggcgtgacctatctcgccctgcttgcagcgttcaaagtaaggcccacatttgccgctggtttgctgttacgcaagctcacctctaaagagctgatgatggccactattgggatcgcacttctgagccagtcaacaatacctgaaaccatcctagagctcacagatgctctggccttgggaatgatggtgctgaagattgtccggaacatggaaaaataccaattagcagtgactatcatggccattagttgcgttcccaatgctgtgatcctccagaacgcgtggaaggtctcctgtaccatactggccgcagtgtctgttagcccacttctgttgacgtcctcacagcagaaggctgactggattcctctcgccctgacaatcaaaggcctaaatcccaccgccatcttcctgactacccttagcagaacaagtaagaaaaggtcttggccactcaacgaggctattatggcagtgggcatggtctccatactggccagctcgttgctgaagaatgacatcccgatgactgggcctttagtagcgggaggtctcctgaccgtgtgctatgttcttacgggccgatcagctgatctggaattggagcgcgccgcagacgtgaaatgggaggatcaagccgaaatttctgggagttcccccatcctcagcattacaatctctgaggacggaagcatgtccataaagaacgaagaggaggaacagaccctgactatcctaattcggacaggcctgcttgtcatctcaggtgtgtttccagtaagtattcccatcaccgctgcagcctggtacctctgggaggtgaaaaagcagagagcgggggtcctgtgggatgttcctagcccaccccctgtggaaaaggctgagttggaagacggagcctataggataaaacagcgtggcattttaggctactctcaaatcggggcaggagtgtataaggagggtactttccacacaatgtggcatgtcacccgcggcgccgtgctgatgcaccgggggaaaagaatcgagccgtcctgggctgatgttaagaaagacctcatttcatacggaggcggttggaagctggaaggggagtggaaggaaggagaggaagtacaggtgcttgccctggagccaggcaaaaatcccagggcagtccagacgaagcctggcatctttaaaactaacaccgggacaataggagctgtgagtttggatttcagcccaggtacctccggctctcccattgttgaccgaaaggggaaagtggtcggactatacggcaatggtgtggtaacacggtcgggggcctatgtcagcgcgatcgcccagactgagaagtcaattgaagataaccctgagatcgaagacgatatatttcgcaagaaaagactgaccattatggacctccatccgggagcaggcaagacgaaaaggtacctgcccgctatcgtgcgggaggccatcaagcgaggccttagaacattaattctggctccaactcgcgttgtggcagccgaaatggaggaggccctcagggggttgcctatccgttatcaaaccacagctattaaaaccgaacacactggacgggagatagtcgacctgatgtgtcatgcgaccttcacaatgagactcctgtcccccgtgagggttccaaactacaatcttatcattatggatgaagcacacttcacggaccctgccagtatcgctgcccgcggttatatctctactcgagtggagatgggcgaggcagccgggatttttatgaccgctacacccccaggaagcagagatccgttccctcagtccaacgcgcccataatggacgaagaacgggaaatcccagagaggtcatggaactctggccacgaatgggtcaccgattttaagggtaagactgtgtggttcgtacccagcattaaagccgggaacgacatcgcagcttgcctgcgcaagaatggcaagaaggtgattcagttgagtcgtaaaacatttgattccgagtacgttaagaccagagccaacgactgggatttcgtcgtgacgactgacatcagcgagatgggcgcaaattttaaggccgaacgggtgatagatcctaggcgctgtatgaaaccagtcatcctaacagacggcgaggaacgagtaattctggctgggcccatgcctgtgacccattcttcagccgcgcaaagacggggaaggatcggtcgcaacccgaagaatgagaacgaccagtatatttacatgggcgaaccactcgagaatgatgaggactgcgcacactggaaagaagccaagatgttactggataacatcaatacccccgaggggataattccttccatgttcgaacccgagagagaaaaagttgacgctatcgatggagagtacaggcttcggggcgaggcccgtaagacttttgtggacctgatgcgccgaggtgatctcccagtctggttggcttataaagtggcagccgaagggattaactacgctgacagaaagtggtgtttcgatggcatcaagaataaccagatactggaggaaaacatggaggttgagatctggacaaaagaaggagagaggaagaaactcaagcctcggtggctggacgcccgcatttatagtgatccccttgcactaaaagaatttaaggagttcgcggccggcagaaagagcctgaccttgaatttaatcacagaaatggggaggctgccaactttcatgacgcagaaagctcggaacgccctcgacaatctggcagtgcttcataccgctgaggccggaggtcgagcatacaaccacgccctgtcggagctccctgaaacattggagactctgctactgctcacccttctggctacagtcaccggcgggatatttttattcttgatgtctggaaagggcatcggtaaaatgactctggggatgtgctgcataattacggcgtccatcctcctgtggtatgcccaaatccagccgcactggattgcagctagcatcatacttgaatttttcctgattgtgctcttgatccccgagccagaaaagcagagaacccctcaggataatcaactgacatacgtagtgattgccatcttaactgttgtcgccgcaaccatggctaacgagatgggctttctagagaaaacaaagaaggacctgggactcggctcaataaccactcaggaaagtgagtctaatatccttgacattgatctgcgccccgcctccgcgtggacattgtatgctgtggccacgaccttcgtgactccaatgctgaggcatagcatcgaaaactcaagtgtcaatgttagcctcacagcaattgccaaccaggctaccgtgctgatggggcttggaaaaggttggcctctctccaagatggacatcggcgtacccctgttggcaattgggtgttactctcaggtgaatccgatcaccctgacagccgcgttactactgctcgtcgctcactacgccataattggaccaggccttcaagcaaaagccactcgggaggctcagaagcgtgccgcagctggtatcatgaaaaaccctacggtggatgggatcaccgttattgacctggaacccataccatatgatcccaagtttgagaagcagttgggccaggtgatgctgctcatcctgtgcgtcacacaagtacttatgatgagaactacctgggccttatgtgaggcgctgacactcgccaccggacctattagcactttgtgggaaggcaatccggggaggttctggaacacgacaatcgcagtgtccatggctaatatttttcgcggatcatacctggccggcgcaggtctactgttctctatcatgaaaaacaccactaatacccggcgagggacaggaaacataggcgagactctcggtgaaaagtggaaaagtagacttaacgctctgggcaagtcggagtttcagatctataaaaagagcgggattcaggaggttgacaggaccttggccaaagaaggaatcaagcgcggcgagacagatcatcacgccgtgtcccgggggtctgcgaagctgagatggttcgtcgaacgtaatatggtgacgcccgagggaaaagtcgtggacctcggctgcggtagagggggatggtcatactattgtggcggtctgaagaacgttcgggaagtgaaaggcttaaccaaagggggaccaggccatgaggagcctattcccatgagcacttacgggtggaatcttgtacgcctgcaatccggagtggatgtctttttcacacctccagaaaaatgcgacaccctcctatgtgatatcggcgagagttctcccaaccctactatagaagctggtcgaacactgagagttttgaatctggtggagaactggctcaataacaatacccagttctgcattaaggtccttaacccatatatgcccagcgtgatcgaaaagatggaggcactgcagaggaaatacgggggagccttggtacggaatccgctgtcacgcaactccacgcacgagatgtactgggtgagtaatgctaccggcaacatcgttagctctgtgaatatgatttccagaatgctcataaacaggtttacaatgaagcacaaaaaggccacttatgaacctgacgtcgatttaggctcagggacccgaaacatcggaattgagagcgaaatcccaaatctggacattatcggtaaacggatagagaagatcaagcaggaacatgagacatcgtggcactacgaccaagatcatccctataaaacttgggcataccacggctcttatgagaccaagcagacagggagtgcctccagcatggtgaacggagtcgtgcgtcttctgaccaaaccttgggacgttgtaccaatggtgactcagatggctatgacggatacaacccccttcggccagcaaagagtctttaaggaaaaagtggacactcgcacccaggagccgaaggaaggtacaaagaaactaatgaagattacggcggagtggctctggaaagagctggggaagaaaaagacccctaggatgtgtactcgggaagagttcacaagaaaagttcgctcaaatgccgcattgggagctatctttaccgatgaaaacaagtggaagtccgccagggaggcagtggaagacggccgattctgggagctggtcgatcgggagagaaatctccaccttgaaggcaaatgcgagacttgtgtgtacaacatgatggggaagagggagaaaaagctgggagagtttggtaaagccaagggctctcgcgctatttggtatatgtggttaggggcccgtttcctggaatttgaggcgttgggattcctcaatgaggaccattggtttagccggggcaacagtctgtccggtgtagaaggggagggactacacagacttggctacatcctgagggatgtgggcaagaaagaagggggagcaatgtacgccgacgatacagctggttgggacacccgcattacactcgaggacctgaagaatgaagagatggttactaaccatatgaaaggcgagcacaagaaattggccgaagcaatattcaagctgacctatcagaataaggtcgtgcgagtgcagcggcccacgccaagagggaccgtcatggatatcattagcaggcgcgaccaaagaggatctggccaggttggtacatacgggctcaacacttttaccaatatggaggctcagcttatccggcaaatggaaggagagggcatcttcaaatcaattcagcatctgacagccactgaggaaatagctgtgcagaactggttagccagggtaggccgtgagcgactgagtcgcatggcaatctccggggatgactgcgtggtcaagcctattgatgacagattcgcgagcgccttgaccgctctcaatgatatgggaaaaatccggaaggacattcagcaatgggaaccctctaggggttggaacgattggacacaggtgccattttgctcgcaccacttccatgagctggttatgaaagacggccgcgtgctagtcgtgccctgtagaaaccaggatgaacttatcgggcgggccaggatatcacagggagcaggctggagcctgaaggagacagcttgcctcggtaagtcctatgcccaaatgtggaccctgatgtactttcaccgacgtgacttgagattagcagccaatgcgatctgtagtgctgtaccttctcattgggttccaactagccgcacaacctggtccattcacgccaaacacgagtggatgactaccgaagatatgctggcagtgtggaaccgggtctggatccaggagaatccgtggatggaagacaagacacccgtggagtcatgggaagaggtgccttatctcgggaaaagggaggaccagtggtgcggaagtcttattggcctgacgtctagagccacctgggctaagaacatccagactgccataaatcaagtccgcagcctaattggcaacgaagagtacacagattatatgccatccatgaaacggttcaggcgagaagaggaagaggcaggggttctgtggtga

SEQ ID NO: 14548 - RNA, 9876 nt, synthetic construct
  misc_feature 1..9876: note = derived and/or modified CDS sequence (opt3) from DENV-2__EU482762__SS-prME
  source 1..9876: mol_type = other RNA
accgccggagtgatcgtcatgctgattcccacagctatggcattccacctcactacgagaaatggggagcctcatatgatagttggaaggcaggaaaagggtaaaagccttctgtttaagaccgaggacggcgtgaatatgtgcaccttgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatccgcggaattatgcaggctggcaaaagatcgctcaggcctcaaccaaccgaactgaagtatagctggaaaacttgggggaaggccaagatgctttccacagagtcacataaccagaccttcttgatcgatggaccggaaacagcagagtgccccaatactaaccgtgcgtggaatagtctggaggtcgaagactacggctttggtgttttcaccacgaacatttggctcaaactgcgggagaagcaggacgtgttttgtgattctaaattaatgagcgctgccatcaaggacaatcgagcagtgcacgccgatatggggtattggatagaatccgctctgaacgacacatggaaaatggagaaggcctcattcattgaggtaaagagctgctactggcctaaatctcacaccctttggtccaatggagtcttggaaagtgagatgatcatcccaaagaacttcgcaggccccgtgagccagcataactatagacctggttaccacactcaaaccgctggcccatggcatctcgggaaactggaaatggattttgacctatgtgagggaacaactgttgtggtcaccgaagattgcggcaatagggggccctctctgcgcacaacgaccgcctccggaaagctcattactgagtggtgctgtcggtcatgcacactgccgcctcttagatacaggggcgaggacggttgttggtatgggatggaaatccgcccattgaaagagaaggaagagaacctggtgaatagtttagttaccgcgggacacggccagattgataacttcagcctcggtgtgctgggcatggccctttttctggaagagatgttgcgaactcggatagggacaaagcatgctatcctcctggtagcagtctcgttcgtgaccctaattacgggaaatatgtcctttcgtgacctgggcagagtgatggtcatggttggggccactatgaccgatgacatcggaatgggcgtgacatacctcgctctgcttgccgcattcaaagtaaggcccacctttgcggccggtttgctgttacgcaagctcacttctaaagagctgatgatggctacaattgggatcgcccttctgagccagtcaaccatacctgaaacaatcctagagctcactgatgcactggctttgggaatgatggtgctgaagattgtccggaacatggaaaaatatcaattagccgtgaccatcatggcaattagttgcgttcccaatgccgtgatcctccagaacgcttggaaggtctcctgtacgatactggcggccgtgtctgttagcccacttctgttgacatcctcacagcagaaggcagactggattcctctcgctctgaccatcaaaggcctaaatcccactgccatcttcctgaccacacttagcagaacaagtaagaaaaggtcttggccactcaacgaggccattatggctgtgggcatggtctccatactggcaagctcgttgctgaagaatgacatcccgatgaccgggcctttagtagccggaggtctcctgacggtgtgctacgttcttacaggccgatcagcggatctggaattggagcgcgctgccgacgtgaaatgggaggatcaagcagaaatttctgggagttcccccatcctcagcattaccatctctgaggacggaagcatgtccataaagaacgaagaggaggaacagactctgacaatcctaattcggaccggcctgcttgtcatctcaggtgtgtttccagtaagtattcccatcactgccgctgcatggtatctctgggaggtgaaaaagcagagagccggggtcctgtgggatgttcctagcccaccccctgtggaaaaggcggagttggaagacggagcttacaggataaaacagcgtggcattttaggctattctcaaatcggggccggagtgtacaaggagggtacattccacaccatgtggcacgtcacgcgcggcgcagtgctgatgcatcgggggaaaagaatcgagccgtcctgggccgatgttaagaaagacctcatttcatacggaggcggttggaagctggaaggggagtggaaggaaggagaggaagtacaggtgcttgctctggagccaggcaaaaatcccagggccgtccagactaagcctggcatctttaaaaccaacacagggaccataggagcagtgagtttggatttcagcccaggtacatccggctctcccattgttgaccgaaaggggaaagtggtcggactatatggcaatggtgtggtaactcggtcgggggcttacgtcagcgccatcgcgcagaccgagaagtcaattgaagataaccctgagatcgaagacgatatatttcgcaagaaaagactgacgattatggacctccacccgggagccggcaagacaaaaaggtatctgcccgcaatcgtgcgggaggctatcaagcgaggccttagaactttaattctggccccaacccgcgttgtggctgcagaaatggaggaggccctcagggggttgcctatccgttaccaaacaaccgccattaaaactgaacataccggacgggagatagtcgacctgatgtgtcacgctacattcacgatgagactcctgtcccccgtgagggttccaaactataatcttatcattatggatgaagcgcatttcactgaccctgcaagtatcgccgctcgcggttacatctctacccgagtggagatgggcgaggccgcagggatttttatgacagccacacccccaggaagcagagatccgttccctcagtccaacgctcccataatggacgaagaacgggaaatcccagagaggtcatggaactctggccacgaatgggtcactgattttaagggtaagacagtgtggttcgtacccagcattaaagcggggaacgacatcgccgcatgcctgcgcaagaatggcaagaaggtgattcagttgagtcgtaaaacctttgattccgagtatgttaagacgagagctaacgactgggatttcgtcgtgactacagacatcagcgagatgggcgccaattttaaggcagaacgggtgatagatcctaggcgctgtatgaaaccagtcatcctaaccgacggcgaggaacgagtaattctggccgggcccatgcctgtgacccactcttcagctgcccaaagacggggaaggatcggtcgcaacccgaagaatgagaacgaccagtacatttacatgggcgaaccactcgagaatgatgaggactgcgcgcattggaaagaagcaaagatgttactggataacatcaatactcccgaggggataattccttccatgttcgaacccgagagagaaaaagttgacgccatcgatggagagtataggcttcggggcgaggctcgtaagacatttgtggacctgatgcgccgaggtgatctcccagtctggttggcctacaaagtggctgcagaagggattaactatgccgacagaaagtggtgtttcgatggcatcaagaataaccagatactggaggaaaacatggaggttgagatctggaccaaagaaggagagaggaagaaactcaagcctcggtggctggacgctcgcatttacagtgatccccttgccctaaaagaatttaaggagttcgcagcgggcagaaagagcctgacattgaatttaatcactgaaatggggaggctgccaacgttcatgacccagaaagcccggaacgctctcgacaatctggccgtgcttcacacagcagaggctggaggtcgagcctataaccatgcactgtcggagctccctgaaactttggagaccctgctactgctcacacttctggccaccgtcactggcgggatatttttattcttgatgtctggaaagggcatcggtaaaatgacgctggggatgtgctgcataattaccgcttccatcctcctgtggtacgcgcaaatccagccgcactggattgccgcaagcatcatacttgaatttttcctgattgtgctcttgatccccgagccagaaaagcagagaacacctcaggataatcaactgacttatgtagtgattgctatcttaaccgttgtcgccgccacaatggcaaacgagatgggctttctagagaaaaccaagaaggacctgggactcggctcaataactacacaggaaagtgagtctaatatccttgacattgatctgcgccccgcttccgcctggacgttgtacgcggtggctaccactttcgtgacaccaatgctgaggcacagcatcgaaaactcaagtgtcaatgttagcctcaccgccattgcaaaccaggccaccgtgctgatggggcttggaaaaggttggcctctctccaagatggacatcggcgtacccctgttggctattgggtgttactctcaggtgaatccgatcacactgactgcagccttactactgctcgtcgcgcattatgctataattggaccaggccttcaagccaaagcaacgcgggaggcccagaagcgtgctgccgcaggtatcatgaaaaaccctaccgtggatgggatcacagttattgacctggaacccataccatacgatcccaagtttgagaagcagttgggccaggtgatgctgctcatcctgtgcgtcactcaagtacttatgatgagaaccacatgggctttatgtgaggccctgaccctcgcgactggacctattagcacgttgtgggaaggcaatccggggaggttctggaacacaaccatcgccgtgtccatggcaaatatttttcgcggatcatatctggctggcgccggtctactgttctctatcatgaaaaacactaccaatacacggcgagggactggaaacataggcgagaccctcggtgaaaagtggaaaagtagacttaacgcactgggcaagtcggagtttcagatctacaaaaagagcgggattcaggaggttgacaggacattggctaaagaaggaatcaagcgcggcgagacggatcaccatgccgtgtcccgggggtctgccaagctgagatggttcgtcgaacgtaatatggtgacccccgagggaaaagtcgtggacctcggctgcggtagagggggatggtcatattactgtggcggtctgaagaacgttcgggaagtgaaaggcttaactaaagggggaccaggccacgaggagcctattcccatgagcacatatgggtggaatcttgtacgcctgcaatccggagtggatgtctttttcacccctccagaaaaatgcgacactctcctatgtgatatcggcgagagttctcccaaccctacaatagaagcgggtcgaaccctgagagttttgaatctggtggagaactggctcaataacaatacgcagttctgcattaaggtccttaacccatacatgcccagcgtgatcgaaaagatggaggctctgcagaggaaatacgggggagcattggtacggaatccgctgtcacgcaactccacccatgagatgtattgggtgagtaatgccacaggcaacatcgttagctctgtgaatatgatttccagaatgctcataaacaggtttactatgaagcacaaaaaggctacctacgaacctgacgtcgatttaggctcagggacacgaaacatcggaattgagagcgaaatcccaaatctggacattatcggtaaacggatagagaagatcaagcaggaacacgagacttcgtggcattatgaccaagatcacccctacaaaacctgggcctatcatggctcttacgagacaaagcagaccgggagtgcatccagcatggtgaacggagtcgtgcgtcttctgactaaaccttgggacgttgtaccaatggtgacgcagatggccatgacagataccactcccttcggccagcaaagagtctttaaggaaaaagtggacacccgcacacaggagccgaaggaaggtacgaagaaactaatgaagattaccgctgagtggctctggaaagagctggggaagaaaaagactcctaggatgtgtacacgggaagagttcaccagaaaagttcgctcaaatgcggccttgggagcaatctttactgatgaaaacaagtggaagtccgctagggaggccgtggaagacggccgattctgggagctggtcgatcgggagagaaatctccaccttgaaggcaaatgcgagacatgtgtgtataacatgatggggaagagggagaagaagctgggagagtttggtaaagcaaagggctctcgcgccatttggtacatgtggttaggggctcgtttcctggaatttgaggccttgggattcctcaatgaggaccactggtttagccggggcaacagtctgtccggtgtagaaggggagggactacatagacttggctacatcctgagggatgtgggcaagaaagaagggggagcgatgtatgcagacgataccgccggttgggacacacgcattactctcgaggacctgaagaatgaagagatggttaccaaccacatgaaaggcgagcataagaaattggctgaagccatattcaagctgacgtaccagaataaggtcgtgcgagtgcagcggcccaccccaagagggacagtcatggatatcattagcaggcgcgaccaaagaggatctggccaggttggtacttatgggctcaacacctttacaaatatggaggcacagcttatccggcaaatggaaggagagggcatcttcaaatcaattcagcacctgactgctaccgaggaaatagccgtgcagaactggttagctagggtaggccgtgagcgactgagtcgcatggccatctccggggatgactgcgtggtcaagcctattgatgacagattcgcaagcgcgttgacggccctcaatgatatgggaaaagtgcggaaggacatccagcaatgggaaccctctaggggttggaacgattggacacaggttccattttgctcgcatcacttccacgagctggtgatgaaagacggccgcgtcctagtggtaccctgtagaaaccaggatgaacttattgggcgggctaggatctcacagggagccggctggagcctgaaggagaccgcatgcctcggtaagtcctacgctcaaatgtggactctgatgtattttcatcgacgtgacttgagattagccgcaaatgccatatgtagtgcggttccttctcactgggtgccaacaagccgcaccacttggtccatccatgctaaacacgagtggatgaccacagaagatatgctggccgtctggaaccgggtgtggattcaggagaatccgtggatggaagacaagacgcccgtggagtcatgggaagaggtcccttacctcgggaaaagggaggaccagtggtgcggaagtcttatcggcctgacctctagagcaacttgggccaagaacattcagacagctatcaatcaagttcgcagcctaataggcaacgaagagtataccgattacatgccatccatgaaacggttcaggcgagaagaggaagaggccggggtgctgtggtga

SEQ ID NO: 14549 - RNA, 9876 nt, synthetic construct
  misc_feature 1..9876: note = derived and/or modified CDS sequence (opt3) from DENV-2__EU482763__SS-prME
  source 1..9876: mol_type = other RNA
accgccggagtgatcgtcatgctgattcccacagctatggcattccacctcactacgagaaatggggagcctcatatgatagttggaaggcaggaaaagggtaaaagccttctgtttaagaccgaggacggcgtgaatatgtgcaccttgatggccatggatttaggggaactgtgtgaggacactatcacctacaaatgcccactactccggcaaaacgaaccggaggatattgactgttggtgcaattccacatctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggatcgagacctggattctgcggcatcctggcttcacaatcatggccgcaatattggcctacaccatcggcacgactcactttcagcgcgctctcattttcatcctgctgacagcagtggccccatccatgaccatgagatgcattgggatctctaacagggattttgtcgaaggagtgtcgggtggctcatgggtagacatagttctcgagcacgggagctgtgtgactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttatttgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccatcgttattactccacacagcggtgaggagcatgctgtgggcaatgacacggggaagcacggaaaagaaataaagatcacaccgcagtcctcaattaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatccagaaggagacacttgtgacgttcaagaaccctcatgccaaaaagcaagacgttgtggtcctgggctctcaggaaggggcgatgcacaccgccttgactggagcaacagagatacagatgtcctcaggtaatctactgtttaccggccatctcaaatgccgtctgcgcatggataaacttcaactgaaagggatgagctacagtatgtgtacaggaaagttcaagattgtgaaagaaatcgctgagactcagcacggcaccatcgtaattagagttcagtatgagggtgacgggtctccatgcaagatccccttcgaaattacggatttggagaaaaggcatgtgctcggccggctgataaccgtcaacccgatcgtgacagaaaaggactcccctgtcaacattgaggccgaacccccatttggagatagctacatcatcattggcgtggagcctgggcagttaaaactgaattggttcaagaagggatcgtctataggtcaaatgtttgagactaccatgcgaggcgctaaacgcatggccatcctaggggacacagcatgggatttcggatccctcggcggtgtttttacttcaattgggaaggccctgcaccaggtgttcggcgctatctacggagcggcatttagtggcgtaagctggaccatgaaaattcttatcggggtcataatcacgtggattggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcatcttcattactgataacgtccacacatggaccgagcagtacaagtttcaacccgaatcaccaagtaaattggccagcgcaatccagaaggcccatgaggaaggtatatgtggcattaggtccgtgactcggctcgagaatctgatgtggaaacagatcacccccgagttaaaccacattctgtctgaaaatgaggtgaagctaacaatcatgacgggggacatacgcggaatcatgcaggctggcaaaagatcgctcaggcctcaaccaaccgaactgaagtatagctggaaaacttgggggaaggccaagatgctttccacagagtcacataaccagaccttcttgattgatggaccggaaacagcagagtgccccaatactaaccgtgcgtggaatagtctggaggtcgaagactacggctttggtgttttcaccacgaacatctggctcaaactgcgggagaagcaggacgtgttttgtgattctaaattaatgagcgctgccattaaggacaatcgagcagtgcacgccgatatggggtattggatcgaatccgctctgaacgacacatggaaaatggagaaggcctcattcatagaggtaaagagctgccactggcctaaatctcataccctttggtccaatggagtcttggaaagtgagatgattatcccaaagaacttcgcaggccccgtgagccagcacaactacagacctggttatcatactcaaaccgctggcccatggcacctcgggaaactggaaatggattttgacctatgtgagggaacaactgttgtggtcaccgaagattgcggcaatagggggccctctctgcgcacaacgaccgcctccggaaagctcatcactgagtggtgctgtcggtcatgcacactgccgcctcttagatacaggggcgaggacggttgttggtacgggatggaaattcgcccattgaaagagaaggaagagaacctggtgaatagtttagttaccgcgggacatggccagatcgataacttcagcctcggtgtgctgggcatggccctttttctggaagagatgttgcgaactcggattgggacaaagcacgctatactcctggtagcagtctcgttcgtgaccctaatcacgggaaatatgtcctttcgtgacctgggcagagtgatggtcatggttggggccactatgaccgatgacattggaatgggcgtgacatatctcgctctgcttgccgcattcaaagtaaggcccacctttgcggccggtttgctgttacgcaagctcacttctaaagagctgatgatggctacaatcgggattgcccttctgagccagtcaaccatccctgaaacaatactagagctcactgatgcactggctttgggaatgatggtgctgaagatcgtccggaacatggaaaaataccaattagccgtgaccattatggcaatcagttgcgttcccaatgccgtgattctccagaacgcttggaaggtctcctgtacgatcctggcggccgtgtctgttagcccacttctgttgacatcctcacagcagaaggcagactggatacctctcgctctgaccattaaaggcctaaatcccactgccatcttcctgaccacacttagcagaacaagtaagaaaaggtcttggccactcaacgaggccatcatggctgtgggcatggtctccattctggcaagctcgttgctgaagaatgacataccgatgaccgggcctttagtagccggaggtctcctgacggtgtgctatgttcttacaggccgatcagcggatctggaattggagcgcgctgccgacgtgaaatgggaggatcaagcagaaatctctgggagttcccccattctcagcatcaccatttctgaggacggaagcatgtccatcaagaacgaagaggaggaacagactctgacaatactaatccggaccggcctgcttgtcatttcaggtgtgtttccagtaagtatccccattactgccgctgcatggtacctctgggaggtgaaaaagcagagagccggggtcctgtgggatgttcctagcccaccccctgtggaaaaggcggagttggaagacggagcttataggatcaaacagcgtggcatattaggctactctcaaattggggccggagtgtataaggagggtacattccacaccatgtggcatgtcacgcgcggcgcagtgctgatgcaccgggggaaaagaatcgagccgtcctgggccgatgttaagaaagacctcatctcatacggaggcggttggaagctggaaggggagtggaaggaaggagaggaagtacaggtgcttgctctggagccaggcaaaaatcccagggccgtccagactaagcctggcatttttaaaaccaacacagggaccatcggagcagtgagtttggatttcagcccaggtacatccggctctcccatagttgaccgaaaggggaaagtggtcggactatacggcaatggtgtggtaactcggtcgggggcttatgtcagcgccattgcgcagaccgagaagtcaatcgaagataaccctgagattgaagacgatatctttcgcaagaaaagactgacgataatggacctccatccgggagccggcaagacaaaaaggtacctgcccgcaattgtgcgggaggctatcaagcgaggccttagaactttaatcctggccccaacccgcgttgtggctgcagaaatggaggaggccctcagggggttgcctattcgttatcaaacaaccgccatcaaaactgaacacaccggacgggagattgtcgacctgatgtgtcatgctacattcacgatgagactcctgtcccccgtgagggttccaaactacaatcttataatcatggatgaagcgcacttcactgaccctgcaagtattgccgctcgcggttatatctctacccgagtggagatgggcgaggccgcagggatctttatgacagccacacccccaggaagcagagatccgttccctcagtccaacgctcccattatggacgaagaacgggaaataccagagaggtcatggaactctggccacgaatgggtcactgattttaagggtaagacagtgtggttcgtacccagcatcaaagcggggaacgacattgccgcatgcctgcgcaagaatggcaagaaggtgatccagttgagtcgtaaaacctttgattccgagtacgttaagacgagagctaacgactgggatttcgtcgtgactacagacattagcgagatgggcgccaattttaaggcagaacgggtgatcgatcctaggcgctgtatgaaaccagtcatactaaccgacggcgaggaacgagtaatcctggccgggcccatgcctgtgacccattcttcagctgcccaaagacggggaaggattggtcgcaacccgaagaatgagaacgaccagtatatctacatgggcgaaccactcgagaatgatgaggactgcgcgcactggaaagaagcaaagatgttactggataacattaatactcccgaggggatcataccttccatgttcgaacccgagagagaaaaagttgacgccattgatggagagtacaggcttcggggcgaggctcgtaagacatttgtggacctgatgcgccgaggtgatctcccagtctggttggcctataaagtggctgcagaagggatcaactacaccgacagaaagtggtgtttcgatggcattaagaataaccagatcctggaggaaaacatggaggttgagatatggacaaaagaaggagagaggaagaaactcaagcctcggtggctggacgcccgcatctatagtgatccccttgctctaaaagaatttaaggagttcgccgcaggcagaaagagcctgactttgaatttaattacggaaatggggaggctgccaaccttcatgacacagaaagcgcggaacgccctcgacaatctggctgtgcttcatactgccgaggcaggaggtcgagcttacaaccacgccctgtcggagctccctgaaaccttggagacactgctactgctcacccttctggcaactgtcacgggcgggatctttttattcttgatgtctggaaagggcattggtaaaatgaccctggggatgtgctgcatcataacagcctccattctcctgtggtatgctcaaatccagccgcactggatcgcggccagcattatccttgaatttttcctgatagtgctcttgattcccgagccagaaaagcagagaactcctcaggataatcaactgacctacgtagtgatcgcaattttaacagttgtcgctgccaccatggccaacgagatgggctttctagagaaaactaagaaggacctgggactcggctcaatcacaacgcaggaaagtgagtctaatatacttgacatcgatctgcgccccgcatccgcttggaccttgtatgccgtggcgactacattcgtgaccccaatgctgaggcatagcattgaaaactcaagtgtcaatgttagcctcaccgctatcgccaaccaggcaacagtgctgatggggcttggaaaaggttggcctctctccaagatggacattggcgtacccctgttggccatcgggtgttactctcaggtgaatccgattactctgacggctgcattactactgctcgtcgcccactacgcgatcataggaccaggccttcaagctaaagccacccgggaggcacagaagcgtgccgctgccggtattatgaaaaaccctacagtggatgggatcactgttatcgacctggaacccattccatatgatcccaagtttgagaagcagttgggccaggtgatgctgctcatactgtgcgtcacccaagtacttatgatgagaacaacctgggcattatgtgaggctctgactctcgccacgggacctatcagcacattgtgggaaggcaatccggggaggttctggaacaccactattgcggtgtccatggccaatatctttcgcggatcatacctggcaggcgctggtctactgttctctattatgaaaaacaccacaaatactcggcgagggaccggaaacatcggcgagacactcggtgaaaagtggaaaagtagacttaacgccctgggcaagtcggagtttcagatatataaaaagagcgggatccaggaggttgacaggacgttggcaaaagaaggaattaagcgcggcgagaccgatcatcacgctgtgtcccgggggtctgccaagctgagatggttcgtcgaacgtaatatggtgactcccgagggaaaagtcgtggacctcggctgcggtagagggggatggtcatactattgtggcggtctgaagaacgttcgggaagtgaaaggcttaacaaaagggggaccaggccatgaggagcctatccccatgagcacctacgggtggaatcttgtacgcctgcaatccggagtggatgtctttttcactcctccagaaaaatgcgacacactcctatgtgatattggcgagagttctcccaaccctaccatcgaagccggtcgaacgctgagagttttgaatctggtggagaactggctcaataacaatacccagttctgcataaaggtccttaacccatatatgcccagcgtgattgaaaagatggaggcgctgcagaggaaatacgggggagctttggtacggaatccgctgtcacgcaactccacacacgagatgtactgggtgagtaatgcaactggcaacatcgttagctctgtgaatatgatctccagaatgctcattaacaggtttaccatgaagcacaaaaaggccacatatgaacctgacgtcgatttaggctcagggactcgaaacataggaatcgagagcgaaattccaaatctggacatcattggtaaacggatcgagaagataaagcaggaacatgagacctcgtggcactacgaccaagatcatccctataaaacatgggcttaccacggctcttatgagaccaagcagactgggagtgcctccagcatggtgaacggagtcgtgcgtcttctgacgaaaccttgggacgttgtaccaatggtgacacagatggcaatgaccgatactacccccttcggccagcaaagagtctttaaggaaaaagtggacacacgcacgcaggagccgaaggaaggtaccaagaaactaatgaagatcactgccgagtggctctggaaagagctggggaagaaaaagacacctaggatgtgtacccgggaagagttcactagaaaagttcgctcaaatgctgcgttgggagccatttttacagatgaaaacaagtggaagtccgcaagggaggctgtggaagacggccgattctgggagctggtcgatcgggagagaaatctccaccttgaaggcaaatgcgagacctgtgtgtacaacatgatggggaagagggagaagaagctgggagagtttggtaaagccaagggctctcgcgcaatctggtatatgtggttaggggcccgtttcctggaatttgaggctttgggattcctcaatgaggaccattggtttagccggggcaacagtctgtccggtgtagaaggggagggactacacagacttggctacattctgagggatgtgggcaagaaagaagggggagccatgtacgcggacgatacagcaggttgggacactcgcatcaccctcgaggacctgaagaatgaagagatggttacgaaccatatgaaaggcgagcacaagaaattggccgaagctattttcaagctgacctatcagaataaggtcgtgcgagtgcagcggcccacaccaagagggactgtcatggatataatcagcaggcgcgaccaaagaggatctggccaggttggtacctacgggctcaacacatttactaatatggaggcccagcttattcggcaaatggaaggagagggcatcttcaaatcaatccagcatctgaccgcaacggaggaaattgctgtgcagaactggttagccagggtaggccgtgagcgactgagtcgcatggctatatccggggatgactgcgtggtcaagcctatcgatgacagattcgccagcgcattgacagcgctcaatgatatgggaaaagtgcggaaggacattcagcaatgggaaccctctaggggttggaacgattggacccaggttccattttgctcgcaccacttccatgagctggtgatgaaagacggccgcgtcctagtggtaccctgtagaaaccaggatgaacttatcgggcgggccaggatttcacagggagctggctggagcctgaaggagactgcctgcctcggtaagtcctatgcacaaatgtggacactgatgtactttcaccgacgtgacttgagattagctgccaatgcaatctgtagtgccgttccttctcattgggtgccaaccagccgcactacctggtccatacacgcgaaacacgagtggatgacaacggaagatatgctggctgtctggaaccgggtgtggatccaggagaatccgtggatggaagacaagacccccgtggagtcatgggaagaggtcccttatctcgggaaaagggaggaccagtggtgcggaagtcttattggcctgacttctagagccacatgggcaaagaacatccagaccgccattaatcaagttcgcagcctaatcggcaacgaagagtacactgattatatgccatccatgaaacggttcaggcgagaagaggaagaggctggggtgctgtggtga

SEQ ID NO: 14550 - RNA, 9876 nt, synthetic construct
  misc_feature 1..9876: note = derived and/or modified CDS sequence (opt3) from DENV-2__EU482444__SS-prME
  source 1..9876: mol_type = other RNA
accgccggagtgatcgtcatgctgattcccacggctatggcattccacctcactacgagaaatggggagcctcatatgatagttggaaggcaggaaaagggtaaaagccttctgtttaagaccgaggacggcgtgaatatgtgcaccttgatggccatggatttaggggaactgtgtgaggacactatcacctacaaatgcccactactccggcaaaacgaaccggaggatattgactgttggtgcaattccacatctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggatcgagacctggattctgcggcatcctggcttcacaatcatggccgcaatattggcctacaccatcggcacgactcactttcagcgcgctctcattttcatcctgctgacagcagtggccccatccatgaccatgagatgcattgggatctctaacagggattttgtcgaaggagtgtcgggtggctcatgggtagacatagttctcgagcacgggagctgtgtgactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttatttgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccatcgttattactccacacagcggtgaggagcatgctgtgggcaatgacacggggaagcacggaaaagaaataaagatcacaccgcagtcctcaattaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatccagaaggagacacttgtgacgttcaagaaccctcatgccaaaaagcaagacgttgtggtcctgggctctcaggaaggggcgatgcacaccgccttgactggagcaacagagatacagatgtcctcaggtaatctactgtttaccggccatctcaaatgccgtctgcgcatggataaacttcaactgaaagggatgagctacagtatgtgtacaggaaagttcaagattgtgaaagaaatcgctgagactcagcacggcaccatcgtaattagagttcagtatgagggtgacgggtctccatgcaagatccccttcgaaattacggatttggagaaaaggcatgtgctcggccggctgataaccgtcaacccgatcgtgacagaaaaggactcccctgtcaacattgaggccgaacccccatttggagatagctacatcatcattggcgtggagcctgggcagttaaaactgaattggttcaagaagggatcgtctataggtcaaatgtttgagactaccatgcgaggcgctaaacgcatggccatcctaggggacacagcatgggatttcggatccctcggcggtgtttttacttcaattgggaaggccctgcaccaggtgttcggcgctatctacggagcggcatttagtggcgtaagctggaccatgaaaattcttatcggggtcataatcacgtggattggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcatcttcattactgataacgtccacacatggaccgagcagtacaagtttcaacccgaatcaccaagtaaattggccagcgcaatccagaaggcccatgaggaaggtatatgtggcattaggtccgtgactcggctcgagaatctgatgtggaaacagatcacccccgagttaaaccacattctgtctgaaaatgaggtgaagctaacaatcatgacgggggacatacgcggaatcatgcaggctggcaaaagatcgctcaggcctcaaccaaccgaactgaagtatagctggaaaacttgggggaaggccaagatgctttccacagagtcacataaccagaccttcttgattgatggaccggaaacagcagagtgccccaatactaaccgtgcgtggaatagtctggaggtcgaagactacggctttggtgttttcaccacgaacatctggctcaaactgcgggagaagcaggacgtgttttgtgattctaaattaatgagcgctgccattaaggacaatcgagcagtgcacgccgatatggggtattggatcgaatccgctctgaacgacacatggaaaatggagaaggcctcattcatagaggtaaagagctgccactggcctaaatctcataccctttggtccaatggagtcttggaaagtgagatgattatcccaaagaacttcgcaggccccgtgagccagcacaactacagacctggttatcatactcaaaccgctggcccatggcacctcgggaaactggaaatggattttgacctatgtgagggaacaactgttgtggtcaccgaagattgcggcaatagggggccctctctgcgcacaacgaccgcctccggaaagctcatcactgagtggtgctgtcggtcatgcacactgccgcctcttagatacaggggcgaggacggttgttggtacgggatggaaattcgcccattgaaagagaaggaagagaacctggtgaatagtttagttaccgcgggacatggccagatcgataacttcagcctcggtgtgctgggcatggccctttttctggaagagatgttgcgaactcggattgggacaaagcacgctatactcctggtagcagtctcgttcgtgaccctaatcacgggaaatatgtcctttcgtgacctgggcagagtgatggtcatggttggggccactatgaccgatgacattggaatgggcgtgacatatctcgctctgcttgccgcattcaaagtaaggcccacctttgcggccggtttgctgttacgcaagctcacttctaaagagctgatgatggctacaatcgggattgcccttctgagccagtcaaccatccctgaaacaatactagagctcactgatgcactggctttgggaatgatggtgctgaagatcgtccggaacatggaaaaataccaattagccgtgaccattatggcaatcagttgcgttcccaatgccgtgattctccagaacgcttggaaggtctcctgtacgatcctggcggccgtgtctgttagcccacttctgttgacatcctcacagcagaaggcagactggatacctctcgctctgaccattaaaggcctaaatcccactgccatcttcctgaccacacttagcagaacaagtaagaaaaggtcttggccactcaacgaggccatcatggctgtgggcatggtctccattctggcaagctcgttgctgaagaatgacataccgatgaccgggcctttagtagccggaggtctcctgacggtgtgctatgttcttacaggccgatcagcggatctggaattggagcgcgctgccgacgtgaaatgggaggatcaagcagaaatctctgggagttcccccattctcagcatcaccatttctgaggacggaagcatgtccatcaagaacgaagaggaggaacagactctgacaatactaatccggaccggcctgcttgtcatttcaggtgtgtttccagtaagtatccccattactgccgctgcatggtacctctgggaggtgaaaaagcagagagccggggtcctgtgggatgttcctagcccaccccctgtggaaaaggcggagttggaagacggagcttataggatcaaacagcgtggcatattaggctactctcaaattggggccggagtgtataaggagggtacattccacaccatgtggcatgtcacgcgcggcgcagtgctgatgcaccgggggaaaagaatcgagccgtcctgggccgatgttaagaaagacctcatctcatacggaggcggttggaagctggaaggggagtggaaggaaggagaggaagtacaggtgcttgctctggagccaggcaaaaatcccagggccgtccagactaagcctggcatttttaaaaccaacacagggaccatcggagcagtgagtttggatttcagcccaggtacatccggctctcccatagttgaccgaaaggggaaagtggtcggactatacggcaatggtgtggtaactcggtcgggggcttatgtcagcgccattgcgcagaccgagaagtcaatcgaagataaccctgagattgaagacgatatctttcgcaagaaaagactgacgataatggacctccatccgggagccggcaagacaaaaaggtacctgcccgcaattgtgcgggaggctatcaagcgaggccttagaactttaatcctggccccaacccgcgttgtggctgcagaaatggaggaggccctcagggggttgcctattcgttatcaaacaaccgccatcaaaactgaacacaccggacgggagattgtcgacctgatgtgtcatgctacattcacgatgagactcctgtcccccgtgagggttccaaactacaatcttataatcatggatgaagcgcacttcactgaccctgcaagtattgccgctcgcggttatatctctacccgagtggagatgggcgaggccgcagggatctttatgacagccacacccccaggaagcagagatccgttccctcagtccaacgctcccattatggacgaagaacgggaaataccagagaggtcatggaactctggccacgaatgggtcactgattttaagggtaagacagtgtggttcgtacccagcatcaaagcggggaacgacattgccgcatgcctgcgcaagaatggcaagaaggtgatccagttgagtcgtaaaacctttgattccgagtacgttaagacgagagctaacgactgggatttcgtcgtgactacagacattagcgagatgggcgccaattttaaggcagaacgggtgatcgatcctaggcgctgtatgaaaccagtcatactaaccgacggcgaggaacgagtaatcctggccgggcccatgcctgtgacccattcttcagctgcccaaagacggggaaggattggtcgcaacccgaagaatgagaacgaccagtatatctacatgggcgaaccactcgagaatgatgaggactgcgcgcactggaaagaagcaaagatgttactggataacattaatactcccgaggggatcataccttccatgttcgaacccgagagagaaaaagttgacgccattgatggagagtacaggcttcggggcgaggctcgtaagacatttgtggacctgatgcgccgaggtgatctcccagtctggttggcctataaagtggctgcagaagggatcaactacgccgacagaaagtggtgtttcgatggcattaagaataaccagatcctggaggaaaacatggaggttgagatatggaccaaagaaggagagaggaagaaactcaagcctcggtggctggacgctcgcatctatagtgatccccttgccctaaaagaatttaaggagttcgcagcgggcagaaagagcctgacattgaatttaattactgaaatggggaggctgccaacgttcatgacccagaaagcccggaacgctctcgacaatctggccgtgcttcatacagcagaggctggaggtcgagcctacaaccacgcactgtcggagctccctgaaactttggagaccctgctactgctcacacttctggccaccgtcactggcgggatctttttattcttgatgtctggaaagggcattggtaaaatgacgctggggatgtgctgcatcataaccgcttccattctcctgtggtatgcgcaaatccagccgcactggatcgccgcaagcattatccttgaatttttcctgatagtgctcttgattcccgagccagaaaagcagagaacacctcaggataatcaactgacttacgtagtgatcgctattttaaccgttgtcgccgccacaatggcaaacgagatgggctttctagagaaaaccaagaaggacctgggactcggctcaatcactatacaggaaagtgagtctaatatccttgacattgatctgcgccccgcttccgcctggacattgtatgcggtggctacgaccttcgtgactccaatgctgaggcatagcatcgaaaactcaagtgtcaatgttagcctcacagccattgcaaaccaggccaccgtgctgatggggcttggaaaaggttggcctctctccaagatggacatcggcgtacccctgttggctattgggtgttactctcaggtgaatccgatcaccctgacagcagccttactactgctcgtcgcgcactacgctataattggaccaggccttcaagccaaagcaactcgggaggcccagaagcgtgctgccgcaggtatcatgaaaaaccctacggtggatgggatcaccgttattgacctggaacccataccatatgatcccaagtttgagaagcagttgggccaggtgatgctgctcatcctgtgcgtcacacaagtacttatgatgagaactacctgggctttatgtgaggccctgacactcgcgaccggacctattagcactttgtgggaaggcaatccggggaggttctggaacacgacaatcgccgtgtccatggcaaatatttttcgcggatcatacctggctggcgccggtctactgttctctatcatgaaaaacaccactaatacccggcgagggacaggaaacataggcgagactctcggtgaaaagtggaaaagtagacttaacgcactgggcaagtcggagtttcagatctataaaaagagcgggattcaggaggttgacaggaccttggctaaagaaggaatcaagcgcggcgagacagatcatcacgccgtgtcccgggggtctgccaagctgagatggttcgtcgaacgtaatatggtgacgcccgagggaaaagtcgtggacctcggctgcggtagagggggatggtcatactattgtggcggtctgaagaacgttcgggaagtgaaaggcttaaccaaagggggaccaggccatgaggagcctattcccatgagcacttacgggtggaatcttgtacgcctgcaatccggagtggatgtctttttcacacctccagaaaaatgcgacaccctcctatgtgatatcggcgagagttctcccaaccctactatagaagcgggtcgaacactgagagttttgaatctggtggagaactggctcaataacaatacccagttctgcattaaggtccttaacccatatatgcccagcgtgatcgaaaagatggaggctctgcagaggaaatacgggggagcattggtacggaatccgctgtcacgcaactccacgcacgagatgtactgggtgagtaatgccaccggcaacatcgttagctctgtgaatatgatttccagaatgctcataaacaggtttacaatgaagcacaaaaaggctacttatgaacctgacgtcgatttaggctcagggacccgaaacatcggaattgagagcgaaatcccaaatctggacattatcggtaaacggatagagaagatcaagcaggaacatgagacatcgtggcactacgaccaagatcatccctataaaacttgggcctaccacggctcttatgagaccaagcagacagggagtgcatccagcatggtgaacggagtcgtgcgtcttctgaccaaaccttgggacgttgtaccaatggtgactcagatggccatgacggatacaacccccttcggccagcaaagagtctttaaggaaaaagtggacactcgcacccaggagccgaaggaaggtacaaagaaactaatgaagattacggctgagtggctctggaaagagctggggaagaaaaagacccctaggatgtgtactcgggaagagttcacaagaaaagttcgctcaaatgcggccttgggagcaatctttaccgatgaaaacaagtggaagtccgctagggaggccgtggaagacggccgattctgggagctggtcgatcgggagagaaatctccaccttgaaggcaaatgcgagacttgtgtgtacaacatgatggggaagagggagaagaagctgggagagtttggtaaagcaaagggctctcgcgccatttggtatatgtggttaggggctcgtttcctggaatttgaggccttgggattcctcaatgaggaccattggtttagccggggcaacagtctgtccggtgtagaaggggagggactacacagacttggctacatcctgagggatgtgggcaagaaagaagggggagttatgtacgcggacgatacagcaggttgggacacccgcattacactcgaggacctgaagaatgaagagttggtcactaaccatatgaaaggcgagcacaagaaactggccgaagctatattcaagctcacctatcagaataaggtggtgcgagtccagcggcccacgccaagagggaccgttatggatatcattagcaggcgcgaccaaagaggatctggccaggtgggtacatacgggcttaacacttttaccaatatggaggcccagctgatccggcaaatggaaggagagggcatcttcaaatcaattcagcatttaacagcaactgaggaaatagctgtacagaactggctggccagggtgggccgtgagcgattgagtcgcatggctatctccggggatgactgcgtcgtgaagcctattgatgacagattcgccagcgcactcaccgcgctgaatgatatgggaaaagttcggaaggacatccagcaatgggaaccctctaggggttggaacgattggacacaggtgccattttgctcgcaccacttccatgagctagtcatgaaagacggccgcgtgcttgtagttccctgtagaaaccaggatgaactgattgggcgggccaggatctcacagggagctggctggagcctcaaggagacagcctgcctgggtaagtcctatgcacaaatgtggaccttgatgtactttcaccgacgtgacttaagactggctgccaatgcaatatgtagtgccgtgccttctcattgggtcccaactagccgcacaacctggtccatccacgcgaaacacgagtggatgactaccgaagatatgctcgctgtgtggaaccgggtgtggattcaggagaatccgtggatggaagacaagacacccgtcgagtcatgggaagaggttccttatcttgggaaaagggaggaccagtggtgcggaagtctgatcggcctaacgtctagagccacctgggcaaagaacattcagactgccatcaatcaagtgcgcagcctgataggcaacgaagagtacacagattatatgccatccatgaaacggttcaggcgagaagaggaagaggctggggtactctggtga

SEQ ID NO: 14551 - RNA, 9876 nt, synthetic construct
  misc_feature 1..9876: note = derived and/or modified CDS sequence (opt3) from DENV-2__EU482684__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccaccatcttggcatacacgattggcactacacactttcagcgcgccctcatcttcattctgctgaccgctgtggcaccatccatgactatgagatgcatcgggatatctaacagggattttgtcgaaggagtgtcgggtggctcatgggtagacattgttctcgagcacgggagctgtgtgacaaccatggccaagaataagcccacgttagatttcgaactgatcaaaaccgaggctaagcagcctgccacacttcggaaatattgcattgaagcgaagttgactaacaccacaactgagagtcgctgtccaacccaaggagagccctccctgaatgaagagcaggacaaacgatttatctgcaagcattctatggtcgatagaggctggggtaacgggtgtggactattcggcaagggcgggatcgtgacatgcgcaatgtttacctgcaaaaagaatatggaaggaaaagtggtccagcctgagaacctcgaatacactattgttataacgccacacagcggtgaggagcatgccgtgggcaatgacacagggaagcacggaaaagaaatcaagattaccccgcagtcctcaatcactgaggctgaactgaccggctatggtacagtaaccatggagtgtagtcccaggactgggcttgatttcaacgaaatggtgctgttgcaaatggaggacaaagcctggctcgtccaccggcagtggtttctggatttacctctgccatggctccccggcgcagacacacagggaagcaattggatacagaaggagacgcttgtgaccttcaagaaccctcatgctaaaaagcaagacgttgtggtcctgggctctcaggaaggggccatgcacactgcgttgacaggagccaccgagattcagatgtcctcaggtaatctactgtttacaggccatctcaaatgccgtctgcgcatggataagcttcaactgaaagggatgagctacagtatgtgtactggaaagttcaagatcgtgaaagaaatcgcagagacccagcacggcacgattgtaatcagagttcagtatgagggtgacgggtctccatgcaagattcccttcgaaataaccgatttggagaaaaggcatgtgctcggccggctgatcacagtcaacccgattgtgactgaaaaggactcccctgtcaacatcgaggctgaacccccatttggagatagctacatcattataggcgtggagcctgggcagttaaaactgaattggttcaagaagggatcgtctatcggtcaaatgtttgagaccacaatgcgaggcgccaaacgcatggctattctaggggacactgcctgggatttcggatccctcggcggtgtttttacctcaatcgggaaggcactgcaccaggtgttcggcgccatttacggagctgcgtttagtggcgtaagctggacgatgaaaatccttataggggtcatcattacatggatcggaatgaactccagatctaccagcttgtcagtgagtctggttctcgtgggcgtcgtgactctgtatcttggtgcagtagtgcaggccgactccgggtgtgttgtcagctggaagaataaagaactgaagtgcggatctggcattttcatcacagataacgtgcacacctggactgagcagtacaagtttcaacccgaatcaccaagtaaattggctagcgccatacagaaggcacatgaggaaggtatttgtggcatcaggtccgtgacccggctcgagaatctgatgtggaaacagattacacccgagttaaaccacatcctgtctgaaaatgaggtcaagctaacgataatgaccggggacatcaaaggaattatgcaggccggcaagcgctcgctcagacctcaaccaactgaactgaaatatagctggaagacatgggggaaggctaaaatgctttccaccgagtcacataaccagacattcttgatcgatggaccggaaactgccgagtgccccaataccaacagggcatggaatagtctggaggttgaagactacggctttggtgtgttcacgacaaacatttggctcaagctgcgtgagaaacaggacgtgttttgtgattctaagttaatgagcgcggctatcaaagacaatcgggccgtacacgcagatatggggtattggatagaatccgccctgaacgacacctggaagatggagaaggcttcattcattgaggtcaaaagctgccactggcctaagtctcatactctttggtccaatggagtgttggaaagtgagatgatcatcccaaaaaacttcgccggccccgttagccagcacaactaccgacctggttatcatacccaaacagcaggcccatggcacctcgggaagctggaaatggattttgacttctgtgagggaactaccgtggtcgtgacagaagattgcggcaatagagggccctctctaaggacgaccactgcttccggaaaactgattacagagtggtgctgtcgctcatgcaccctcccgcctctgcggtacagaggcgaggacggttgttggtacgggatggaaatcaggccacttaaggagaaggaagagaacttggttaatagtctggtgactgccggacatggccagattgataactttagcttaggtgtactcggcatggcgctgttccttgaagagatgctgcgcacacgaatagggaccaaacacgccatcttgctcgtcgctgtgtcgtttgtgacgctgattactggaaatatgtccttccgggacctaggccgtgtcatggttatggtgggggcaaccatgacagatgacatcggaatgggcgtaacctatctggccctcctggctgcctttaaggtgagacccactttcgcagcgggtcttttgctgaggaaattaacatctaaggagctcatgatggccaccattgggatcgctctgcttagccagtcaacaatacctgaaactatcctggagctaaccgatgccctcgcactgggaatgatggtcttgaaaattgtgcgcaacatggaaaagtaccaactggctgttacgatcatggccattagttgcgtgcccaatgcagtcatcttacagaacgcctggaaggtgtcctgtacaatactcgctgcggtttctgtgagcccactgcttctgacctcctcacagcagaaagccgactggattcctttggcactcactatcaagggcctgaatcccaccgctatctttctaacaactctgagccggaccagtaaaaagagatcttggccacttaacgaggccattatggccgtcggcatggtatccatactcgctagctcgctgttgaaaaatgacatcccgatgacggggcctctggtggcaggaggtttactcacagtttgctatgtgctgaccggcaggtcagccgatcttgaactggagcgagcggctgacgtcaagtgggaggatcaagccgaaatttctgggagttcccccatcttgagcattactatctctgaggacggaagcatgtccataaaaaacgaagaggaggaacagacactcaccatcctgattcgcactggcctactggtgatctcaggtgtattcccagtgagtattcccatcacagcagccgcttggtacctttgggaggtcaagaagcagcgggcaggggttctctgggatgtgcctagcccaccccctgtggaaaaagccgagctggaagacggagcgtatagaataaagcagaggggcattttgggctactctcaaatcggggctggagtctataaagagggtacctttcacacgatgtggcatgtgactcgtggcgccgttttaatgcaccgcgggaagcggatcgagccgtcctgggcagatgtaaaaaaggacctgatttcatacggaggcggttggaagctcgaaggggagtggaaagaaggagaggaagtgcaggtcctggcccttgagccaggcaagaatcccagagctgtgcagaccaaacctggcatcttcaagacaaacaccgggacaataggagccgttagtctggattttagcccaggtacttccggctctcccattgtggacaggaaagggaaggtcgtgggattgtacggcaatggtgtagtcacccgatcgggggcatatgtgagcgctatcgcccagacggagaagtcaattgaagataaccctgagatcgaagacgatatattccggaaaaagcgcctaacaattatggacctgcatccgggagcgggcaaaactaagagatacctccccgccatcgttagggaggcaatcaaacggggcctgcgaacccttattttagctccaacaagagtggtcgccgctgaaatggaggaggcactgcgcgggctccctatcaggtatcaaacccccgccattaagactgaacacaccggacgtgagatagtggacttgatgtgtcatgccacattcacgatgcggctgctctccccagttagagtgcctaactacaatctgatcattatggatgaagctcactttactgaccccgcgagtatcgcagccaggggttatatctctacccgcgtcgagatgggcgaggctgccgggattttcatgacagcaaccccaccgggaagccgagatccttttccccagtccaacgccccaataatggacgaagagagagaaatccccgagcggtcatggaattctggccacgaatgggtgactgatttcaagggtaaaacagtatggtttgtgcctagcattaaggctgggaacgacatcgcggcctgccttaggaaaaatggaaagaaagttattcagctgagtcgcaagaccttcgattccgagtacgtcaagacgcgtgcaaacgactgggattttgtggtgactacagacatcagcgagatgggcgctaatttcaaagccgaaagagtcatagatccacggaggtgtatgaagcccgtaatcttgaccgacggcgaggaacgcgtgattctagcagggcctatgccggttacccattcttcagccgctcaacgaagaggacggatcggtaggaacccaaaaaatgagaacgaccagtatatttacatgggcgaacccctggagaatgatgaggactgcgcccactggaaggaagcgaaaatgctcttagataacatcaatactcctgaggggataattccctccatgtttgaaccagagcgcgaaaaggtggacgcaatcgatggagagtacagactgaggggcgaggcccggaaaacattcgtcgaccttatgcgtcgcggtgatctgcctgtgtggctcgcttataaggttgccgctgaagggattaactacgcagaccgaaagtggtgttttgatggcatcaaaaataaccagatattggaggaaaacatggaggtggagatctggaccaaggaaggagagagaaaaaagctgaaacccaggtggctcgacgcccggatttatagtgatccactggctcttaaggaattcaaggagttcgccgcaggccgcaaaagcctaacactgaatttgatcactgaaatggggagattacctacgtttatgacccagaaggcgaggaacgccctggacaatctcgctgtcctgcatacagccgaggcaggaggtcgggcttacaaccacgccctttcggagctgccggaaactctcgagaccttgctgctactgacactccttgcaaccgtgactggcgggattttcctgtttttaatgtctggaaaaggcatcggtaagatgacgttggggatgtgctgcataattaccgcctccatcctgctctggtatgctcaaatccagccccactggattgcggccagcatcatactggaattctttcttattgtactgctcatcccagagcctgaaaaacagcgaacaccccaggataatcaattgacttacgtggttattgcaatcctgaccgtcgtggctgccacaatggccaacgagatgggcttcttagagaagaccaagaaagacctaggactgggctcaataactacacaggaaagtgagtctaatatcctcgacattgatcttagaccagcatccgcttggacgctgtatgccgtggcgaccacttttgtcacacctatgttgcgccatagcatcgaaaactcaagtgttaatgtgagcctgaccgctattgccaaccaggcaaccgtactcatggggctgggaaagggttggcccctttccaaaatggacatcggcgtgccgctcctggccattgggtgttactctcaggtcaatccaatcacattgactgctgcactgttactactggtggcccactacgcgataattggacctggcctccaagctaaggccacgagggaggcacagaaacgggccgctgccggtatcatgaagaaccccaccgttgatgggatcacagtgattgaccttgaaccaataccctatgatcctaagttcgagaaacagctgggccaggtcatgttgctgatcctctgcgtaactcaagtgctgatgatgcgtaccacatgggcactttgtgaggctttaaccctggccactggaccgattagcacgctctgggaaggcaatcccgggagattttggaacacaaccatcgcggtttccatggccaatattttcaggggatcatacttggcaggcgctggtctgctattttctatcatgaagaacactaccagtacacgccgggggactggaaatataggcgagaccctgggtgaaaaatggaagtcgcgactcaacgcccttggcaaaagcgagttccagatctataagaaatccgggattcaggaggtggacagaacactggcaaaggaaggaatcaagaggggcgagacggatcatcacgctgtctctcgcgggtcagccaaattgcggtggtttgtggaaagaaacatggtcaccccagagggaaaggtggttgacctgggctgcggtcgtgggggatggagctactattgtggcggtctcaaaaatgtgagggaagtaaagggcctgactaaagggggacctggccatgaggagcccattcctatgtccacatacgggtggaacttagtgcggcttcaaagtggagtcgatgttttcttcaccccacccgaaaagtgcgacactctgctctgtgatatcggcgagtctagccctaatccaacaatagaagccggtcgcaccctacgagtgctgaacttggtcgagaattggctgaacaataacacgcagttttgcattaaggtgctcaatccctatatgccgtcagtaatcgaaaaaatggaggcgcttcagagacagtacgggggagctctggtgaggaaccctttgtcccggaatagtacccacgagatgtactgggttagcaacgcaacaggcaatatcgtgtcttccgtcaacatgatttcacgcatgctgataaatagattcactatgaagcacaaaaaggccacctatgaaccagacgtggatctcggcagcgggacaaggaacatcggaattgagtcggaaatccccaacttagacattatcggtaaacgaatagagaagatcaagcaagaacatgagatttcttggcactacgaccaggatcatccttataaaacttgggcttaccacggcagttatgagaccaagcagacagggtccgccagctcaatggtcaatggagtggttcggctgcttaccaaaccatgggacgtagtgcccatggtcactcagatggcaatgacggatacaaccccgtttggccaacagcgtgtgttcaaggaaaaagttgacactagaacccaggagcctaaggaaggtacaaagaaactgatgaagatcacggccgagtggctatggaaagagctcgggaagaaaaagaccccccgcatgtgtactagggaagagtttacaaaaaaggtgcggtccaacgctgcgctgggagccattttcaccgatgaaaataagtggaaatctgcaagagaggctgtcgaagacggccgcttttgggagttggtggatagggagcgaaacctgcacctcgaaggcaagtgcgagacttgtgtatacaatatgatggggaaacgggaaaagaaacttggagagttcggtaaggccaagggcagcagagcaatctggtatatgtggctgggggccaggtttttagaattcgaggctctgggatttttgaacgaggaccattggttcagtcgcggcaattccctcagcggtgtggaaggggagggactgcaccgtctaggctacattcttcgggatgttggcaaaaaggaagggggagccatgtacgcggacgatacagcaggttgggacaccagaataacactggaggacctcaaaaacgaagagatggtcactaatcatatgaagggcgagcacaaaaagctggccgaagctatctttaagttgacctatcagaacaaagtggtgagggtccaacgcccaacgcctcgagggaccgttatggatattatctctcggagagaccagaggggatcaggccaggtgggtacatacgggctgaatactttcaccaacatggaggcccaactcatccgccagatggaaggagagggcattttcaagagtatacagcatcttacagcaactgaggaaatcgctgtacagaattggctggccagagtgggccgggagaggttatcccgtatggctattagcggggatgactgcgtcgtgaaacccatcgatgaccgatttgcctctgcactgaccgcgttgaacgatatgggaaaggttcgcaaagacattcaacagtgggaaccatcgagaggttggaatgattggacgcaggtgcccttctgctcacaccactttcatgagctcgtcatgaaggacggccgggtgctggtagttccttgtaggaaccaggatgaactaatcgggcgcgccagaataagccaaggagctggctggtcccttaaggagacagcctgcctgggtaaaagttatgcacagatgtggaccctcatgtacttccaccggagggacctgcgattggctgccaacgcaatctgttctgccgtgccaagccattgggtcccgacttcccgtacaacctggtcaattcacgcgaagcacgagtggatgactaccgaagatatgttagctgtgtggaatagagtgtggatccaggagaacccctggatggaagacaaaacacctgtcgagagttgggaagaggttccatatctggggaagcgcgaggaccagtggtgcggatctctcattggccttacgagccgggccacctgggcaaaaaatatccaaactgccataaaccaggtgaggtccctgattggcaatgaagagtacacagattatatgccctcaatgaagagatttcgccgggaagaggaagaggctggggtactatggtga

SEQ ID NO: 14552 - RNA, 9876 nt, synthetic construct
  misc_feature 1..9876: note = derived and/or modified CDS sequence (opt3) from DENV-2__EU482685__SS-prME
  source 1..9876: mol_type = other RNA
accgccggcgtgatagtaatgctgattcccactgctatggctttccacctcactacgagaaacggggaacctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatagaatccgctctgaacgacacatggaagatggagaaggcctcattcattgaggtcaaaagctgccactggcctaagtctcataccctttggtccaatggagtgttggaaagtgagatgatcatccccaagaacttcgcaggccccgttagccagcacaactaccgacctggttatcatactcaaaccgctggcccatggcacctcgggaagctggaaatggattttgacttctgtgagggaacaactgtggtcgtgaccgaagattgcggcaatagagggccctctctaaggacaacgaccgcctccggaaaactgattactgagtggtgctgtcgctcatgcacactcccgcctctgcggtacagaggcgaggacggttgttggtacgggatggaaatcaggccacttaaggagaaggaagagaacttggttaatagtctggtgaccgcgggaaacggccagattgataattttagcttaggtgtactcggcatggccctgttccttgaagagatgctgcgcactcgaatagggacaaaacatgctatcttgctcgtcgcagtgtcgtttgtgaccctgattacgggaaacatgtccttccgggacctaggccgtgtcatggttatggtgggggccactatgaccgatgacatcggaatgggcgtaacatatctggctctcctggccgcatttaaggtgagacccaccttcgcggccggtcttttgctgaggaaattaacttctaaggagctcatgatggctacaattgggatcgccctgcttagccagtcaaccatacctgaaacaatcctggagctaactgatgcactcgctctgggaatgatggtcttgaaaattgtgcgcaatatggaaaagtaccaactggccgttaccatcatggcaattagttgcgtgcccaacgccgtcatcttacagaatgcttggaaggtgtcctgtacgatactcgcggccgtttctgtgagcccactgcttctgacatcctcacagcagaaagcagactggattcctttggctctcaccatcaagggcctgaaccccactgccatctttctaaccacactgagccggacaagtaaaaagagatcttggccacttaatgaggccattatggctgtcggcatggtatccatactcgcaagctcgctgttgaaaaacgacatcccgatgaccgggcctctggtggccggaggtttactcacggtttgctatgtgctgacaggcaggtcagcggatcttgaactggagcgagctgccgacgtcaagtgggaggatcaagcagaaatttctgggagttcccccatcttgagcattaccatctctgaggacggaagcatgtccatcaaaaatgaagaggaggaacagactctcacaatcctgattcgcaccggcctactggtgatctcaggtgtattcccagtgagtattcccatcactgccgctgcatggtacctttgggaggtcaagaagcagcgggccggggttctctgggatgtgcctagcccaccccctgtggaaaaagcggagctggaagacggagcttatagaataaagcagaggggcattttgggctactctcaaatcggggccggagtctataaagagggtacatttcacaccatgtggcacgtgacgcgtggcgcagttttaatgcatcgcgggaagcggatcgagccgtcctgggccgatgtcaaaaaggacctgatttcatacggaggcggttggaagctcgaaggggagtggaaagaaggagaggaagtgcaggtcctggctcttgagccaggcaagaaccccagagccgtgcagactaaacctggcatcttcaagaccaatacagggaccataggagcagttagtctggattttagcccaggtacatccggctctcccattgtggacaggaaagggaaggtcgtgggattgtacggcaacggtgtagtcactcgatcgggggcttatgtgagcgccatcgcgcagaccgagaagtcaattgaagataaccctgagatcgaagacgatatattccggaaaaagcgcctaacgattatggacctgcacccgggagccggcaaaacaaagagatacctccccgcaatcgttagggaggctatcaaacggggcctgcgaactcttattttagccccaaccagagtggtcgctgcagaaatggaggaggccctgcgcgggctccctatcaggtatcaaacacccgccattaagaccgaacatactggacgtgagatagtggacttgatgtgtcacgctaccttcacaatgcggctgctctccccagttagagtgcctaattacaacctgatcattatggatgaagcgcattttacggaccccgcaagtatcgccgctaggggttatatctctactcgcgtcgagatgggcgaggccgcagggattttcatgaccgccacaccaccgggaagccgagatccttttccccagtccaatgctccaataatggacgaagagagagaaatccccgagcggtcatggaactctggccacgaatgggtgaccgatttcaagggtaaaactgtatggtttgtgcctagcattaaggcggggaatgacatcgccgcatgccttaggaaaaacggaaagaaagttattcagctgagtcgcaagacattcgattccgagtacgtcaagacccgtgctaatgactgggattttgtggtgacgactgacatcagcgagatgggcgccaacttcaaagcagaaagagtcatagatccacggaggtgtatgaagcccgtaatcttgacagacggcgaggaacgcgtgattctagccgggcctatgccggttacccactcttcagctgcccaacgaagaggacggatcggtaggaatcccaaaaacgagaatgaccagtatatttacatgggcgaacccctggagaacgatgaggactgcgcgcattggaaggaagcaaaaatgctcttagataatatcaacacccctgaggggataattccctccatgtttgaaccagagcgcgaaaaggtggacgccatcgatggagagtacagactgaggggcgaggctcggaaaactttcgtcgaccttatgcgtcgcggtgatctgcctgtgtggctcgcctataaggttgctgcagaagggattaattacgccgaccgaaagtggtgttttgatggcatcaaaaacaaccagatattggaggaaaatatggaggtggagatctggacaaaggaaggagagaggaaaaagctgaaacccagatggctcgacgctcggatttatagtgatccactggcccttaaggagttcaaggagttcgcagcgggccgcaaaagcctaaccctgaacttgatcacagaaatggggagattacctacttttatgacgcagaaggccaggaatgctctggacaacctcgccgtcctgcacaccgcagaggctggaggtcgggcctacaatcatgcactttcggagctgccggaaacactcgagactttgctgctactgaccctccttgccacagtgaccggcgggattttcctgtttttaatgtctggaaaaggcatcggtaagatgactttggggatgtgctgcataattacggcttccatcctgctctggtatgcgcaaatccagccccactggattgccgcaagcatcatactggagttctttcttattgtactgctcatcccagagcctgaaaaacagcgaaccccacaggataaccaattgacatacgtggttattgctatcctgactgtcgtggccgccaccatggcaaatgagatgggcttcttagagaagacaaagaaagacctaggactgggctcaataaccactcaggaaagtgagtctaacatcctcgacattgatcttagaccagcttccgcctggacactgtatgcggtggctacgacctttgtcactcctatgttgcgccacagcatcgaaaattcaagtgttaacgtgagcctgacagccattgcaaatcaggccaccgtactcatggggctgggaaagggttggcccctttccaaaatggacatcggcgtgccgctcctggctattgggtgttactctcaggtcaacccaatcaccttgacagcagccctgttactactggtggcgcattacgctataattggacctggcctccaagccaaggcaactagggaggcccagaaacgggctgccgcaggtatcatgaagaatcccacggttgatgggatcaccgtgattgaccttgaaccaataccctatgatcctaagttcgagaaacagctgggccaggtcatgttgctgatcctctgcgtaacacaagtgctgatgatgcgtactacctgggctctttgtgaggccttaacactggcgaccggaccgattagcactctctgggaaggcaaccccgggagattttggaatacgacaatcgccgtttccatggcaaacattttcaggggatcatacttggctggcgccggtctgctattttctatcatgaagaataccacaagtacccgccgggggacaggaaacataggcgagactctgggtgaaaaatggaagtcgcgactcaacgcacttggcaaaagcgagttccagatctataagaaatccgggattcaggaggtggacagaaccctggctaaggaaggaatcaagaggggcgagacagatcaccatgccgtctctcgcgggtcagccaaattgcggtggtttgtggaaagaaatatggtcacgccagagggaaaggtggttgacctgggctgcggtcgtgggggatggagctactattgtggcggtctcaaaaacgtgaggcaagtaaagggcctgaccaaagggggacctggccacgaagaaccaattcctatgtccacttacgggtggaatttagtgcggcttcagagtggagtcgatgttttcttcacaccacccgagaagtgcgacaccctgctctgtgatatcggcgaatctagccctaacccaactatagaggcgggtcgcacactacgagtgctgaatttggtcgaaaactggctgaataacaatacccagttttgcattaaggtgctcaacccctatatgccgtcagtaatcgagaaaatggaagcacttcagagacaatacgggggagcactggtgaggaatcctttgtcccggaacagtacgcatgagatgtactgggttagcaatgccaccggcaacatcgtgtcttccgtcaatatgatttcacgcatgctgataaacagattcacaatgaagcacaaaaaggctacttatgagccagacgtggatctcggcagcgggaccaggaacatcggaattgaatcggagatccccaatttagacattatcggtaaacgaatagaaaagatcaagcaggagcacgaaatttcttggcattacgaccaggatcacccttataaaacatgggcctaccatggcagttatgagactaagcagaccgggtccgcaagctcaatggtcaacggagtggttcggctgcttacaaaaccatgggacgtagtgcccatggtcacccaaatggccatgactgatacgacaccgtttggccagcagcgtgtgttcaaggagaaagttgacaccagaactcaggaacctaaggagggtaccaagaaactgatgaagatcacagctgaatggctatggaaagagctcgggaagaaaaagacgccccgcatgtgtaccagggaggaatttactaaaaaggtgcggtccaatgcggccctgggagcaattttcacagatgagaacaagtggaaatctgctagagaagccgtcgaggacggccgcttttgggaattggtggatagggagcgaaatctgcacctcgagggcaagtgcgaaacctgtgtatacaacatgatggggaaacgggagaagaaacttggagagttcggtaaggcaaagggcagcagagccatctggtatatgtggctgggggctaggtttttagagttcgaagccctgggatttttgaatgaggaccactggttcagtcgcggcaactccctcagcggtgtggagggggaaggactgcatcgtctaggctacattcttcgggatgttggcaaaaaggaagggggagcgatgtacgcagacgatactgccggttgggacacaagaataaccctggaagacctcaaaaatgaggaaatggtcacaaaccacatgaagggcgagcataaaaagctggctgaggccatctttaagttgacttatcaaaataaagtggtgagggtccagcgcccaacccctcgagggacggttatggatattatctctcggagagaccagaggggatcaggccaagtgggtacctacgggctgaacacattcactaatatggaagcacagctcatccgccagatggagggagaaggcattttcaagagtatacagcaccttaccgctacagaggagatcgccgtacaaaactggctggctagagtgggccgggaaaggttatcccgtatggccattagcggggatgactgcgtcgtgaaacccatcgatgaccgatttgcatctgcgctgactgccttgaatgatatgggaaaggttcgcaaagacattcagcagtgggagccatcgagaggttggaacgattggacccaggtgcccttctgctcacatcactttcacgaactcgtcatgaaggacggccgggtgctggtagttccttgtaggaaccaagatgagctaatcgggcgcgctagaataagccagggagccggctggtcccttaaggaaacggcatgcctgggtaaaagttatgctcagatgtggacactcatgtacttccatcggagggacctgcgattggccgcaaatgccatctgttctgcggtgccaagccactgggtcccgacctcccgtactacatggtcaattcatgctaagcacgagtggatgaccactgaggatatgttagccgtgtggaacagagtgtggatccaggaaaatccctggatggaggacaaaacccctgtcgaaagttgggaggaagttccatatctggggaagcgcgaggaccaatggtgcggatctctcattggccttacaagccgggcaacgtgggccaaaaacatccagaccgctataaatcaggtgaggtccctgattggcaacgaggaatacactgattatatgccctcaatgaagagatttcgccgggaggaagaggaagccggggtactatggtga

SEQ ID NO: 14553 - RNA, 9876 nt, synthetic construct
  misc_feature 1..9876: note = derived and/or modified CDS sequence (opt3) from DENV-2__EU482687__SS-prME
  source 1..9876: mol_type = other RNA
accgccggcgtgatcgtcatgctgattccaactgctatggctttccacctcactacgagaaacggggaacctcatatgatagttggaaggcaggaaaagggtaaaagccttctgtttaagaccgaagacggcgtgaatatgtgcacattgatggccatcgatttaggggaactgtgtgaagacactattacctacaaatgcccactactccggcaaaacgaaccggaagatatcgactgttggtgcaattccacatctacctgggtcacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcagtgttggcctacaccatcggcacgactcactttcagcgcgctctcattttcgtcctgctgacagcagtggccccatccatgaccatgagatgcatcgggatttctaacagggattttgtagaaggagtttcgggtggctcatgggtggacatcgtcctcgagcacgggagctgtgtgactacaatggctaagaataagcccaccttagatttcgaactgataaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtggatagaggctggggtaacgggtgtggactattcggcaagggcgggattgtaacctgcgccatgtttacatgcaaaaagaatatggaaggaaaagttgtgcagcctgagaacctcgaatacaccatcgtaatcactccacacagcggtgaggagcatgctgtgggcaatgacacggggaagcacggaaaagaaattaagataacaccgcagtcctcaatcaccgaggccgaactgactggctatggtaccgtcacaatggagtgtagtcccaggaccgggcttgatttcaacgaaatggtgctgttgcaaatggaggacaaagcatggctcgttcaccggcagtggtttctggatttacctctgccatggctccccggcgctgacactcagggaagcaattggattcagaaggagacacttgtgacgttcaagaaccctcatgccaaaaagcaagacgtcgtggtactgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatagttaaagaaattgctgagactcagcacggcaccatcgtgatcagagtccagtatgagggtgacgggtctccatgcaagattcccttcgaaatcacggatttggagaaaaggcatgtgctcggccggctgattaccgtcaacccgatagtgacagaaaaggactcccctgttaacatcgaggccgaacccccatttggagatagctacattatcatcggcgtggagcctgggcagttaaaactgaattggttcaagaagggatcgtctattggtcaaatgtttgagactaccatgcgaggcgctaaacgcatggccatactaggggacacagcatgggatttcggatccctcggcggtgtatttacttcaatcgggaaggccctgcaccaggtcttcggcgctatttacggagcggcatttagtggcgtgagctggaccatgaaaatccttattggggttatcataacgtggatcggaatgaactccagatctactagcttgtcagtgagtctggtcctcgtgggcgtagtgaccctgtatcttggtgccgttgtccaggctgactccgggtgtgtggtgagctggaagaataaagaactgaagtgcggatctggcattttcatcactgataacgtccacacatggaccgagcagtacaagtttcaacccgaatcaccaagtaaattggccagcgcaattcagaaggcccatgaggaaggtatctgtggcataaggtccgttactcggctcgagaatctgatgtggaaacagattacccccgagttaaaccacatcctgtctgaaaatgaggtgaagctaacaattatgacgggggacatcaaaggaataatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggtggaagactacggctttggtgtattcaccacgaacatttggctcaagctgcgtgagaaacaggacgtcttttgtgattctaagttaatgagcgctgccatcaaagacaatcgggcagtgcacgccgatatggggtattggattgaatccgctctgaacgacacatggaagatggagaaggcctcattcatcgaggttaaaagctgccactggcctaagtctcataccctttggtccaatggagtgttggaaagtgagatgataattcccaagaatttcgcaggccccgtcagccagcacaactaccgacctggttatcatactcaaaccgctggcccatggcacctcgggaagctggaaatggattttgacttctgtgagggaacaactgtggttgtgaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaatcaggccacttaaggagaaggaagagaacttggtaaatagtctggtcaccgcgggacatggccagattgataactttagcttaggtgtgctcggcatggccctgttccttgaagagatgctgcgcactcgaatcgggacaaaacacgctattttgctcgtggcagtctcgtttgttaccctgataacgggaaatatgtccttccgggacctaggccgtgtgatggtaatggtgggggccactatgaccgatgacatcggaatgggcgtcacatatctggctctcctggccgcatttaaggtgagacccaccttcgcggccggtcttttgctgaggaaattaacttctaaggagctcatgatggctacaattgggatcgccctgcttagccagtcaaccattcctgaaacaatcctggagctaactgatgcactcgctctgggaatgatggttttgaaaatagtgcgcaacatggaaaagtaccaactggccgtcaccatcatggcaattagttgcgtgcccaatgccgttatcttacagaacgcttggaaggtgtcctgtacgattctcgcggccgtctctgtaagcccactgcttctgacatcctcacagcagaaagcagactggatccctttggctctcaccataaagggcctgaatcccactgccatttttctaaccacactgagccggacaagtaaaaagagatcttggccacttaacgaggccatcatggctgtgggcatggtttccatcctcgcaagctcgctgttgaaaaatgacattccgatgaccgggcctctggtggccggaggtttactcacggtctgctatgtgctgacaggcaggtcagcggatcttgaactggagcgagctgccgacgtaaagtgggaggatcaagcagaaatatctgggagttcccccatcttgagcattaccatctctgaggacggaagcatgtccattaaaaacgaagaggaggaacagactctcacaatcctgatacgcaccggcctactggtgatctcaggtgtcttcccagttagtattcccatcactgccgctgcatggtacctttgggaggtgaagaagcagcgggccggggtgctctgggatgtccctagcccaccccctgtggaaaaagcggagctggaagacggagcttatagaattaagcagaggggcatcttgggctactctcaaataggggccggagtttataaagagggtacatttcacaccatgtggcatgtaacgcgtggcgcagtgttaatgcaccgcgggaagcggattgagccgtcctgggccgatgtcaaaaaggacctgatctcatacggaggcggttggaagctcgaaggggagtggaaagaaggagaggaagtgcaggttctggctcttgagccaggcaagaatcccagagccgtgcagactaaacctggcatcttcaagaccaacacagggaccattggagcagtcagtctggattttagcccaggtacatccggctctcccatcgtggacaggaaagggaaggtagtcggattgtacggcaatggtgtggttactcgatcgggggcttatgtgagcgccatagcgcagaccgagaagtcaattgaagataaccctgagatcgaagacgatattttccggaaaaagcgcctaacgatcatggacctgcatccgggagccggcaaaacaaagagatacctccccgcaatagtcagggaggctattaaacggggcctgcgaactcttatcttagccccaaccagagtggttgctgcagaaatggaggaggccctgcgcgggctccctatcaggtatcaaacacccgccattaagaccgaacacactggacgtgagatcgtggacttgatgtgtcatgctaccttcacaatgcggctgctctccccagtcagagtgcctaactacaatctgattataatggatgaagcgcactttacggaccccgcaagtatcgccgctaggggttatatttctactcgcgtagagatgggcgaggccgcagggatcttcatgaccgccacaccaccgggaagccgagatccttttccccagtccaacgctccaatcatggacgaagagagagaaattcccgagcggtcatggaactctggccacgaatgggtgaccgatttcaagggtaaaactgtttggtttgtccctagcataaaggcggggaacgacatcgccgcatgccttaggaaaaatggaaagaaagtgattcagctgagtcgcaagacattcgattccgagtacgtgaagacccgtgctaacgactgggattttgtcgtaacgactgacatcagcgagatgggcgccaatttcaaagcagaaagagtgattgatccacggaggtgtatgaagcccgttatcttgacagacggcgaggaacgcgtgatactagccgggcctatgccggtcacccattcttcagctgcccaacgaagaggacggatcggtaggaaccccaagaatgagaacgaccagtatatttacatgggcgaacccctggagaatgatgaggactgcgcgcactggaaggaagcaaaaatgctcttagataacatcaatacccctgaggggattatcccctccatgtttgaaccagagcgcgaaaaggtggacgccatagatggagagtacagactgaggggcgaggctcggaaaactttcgttgaccttatgcgtcgcggtgatctgcctgtgtggctcgcctataaggtcgctgcagaagggattaactacgccgaccgaaagtggtgttttgatggcatcaaaaataaccagattttggaggaaaacatggaggtggagatctggacaaaggaaggagagaggaaaaagctgaaacccagatggctcgacgctcggatatatagtgatccactggcccttaaggagttcaaggagttcgcagcgggccgcaaaagcctaaccctgaatttgatcacagaaatggggagattacctacttttatgacgcagaaggccaggaacgctctggacaatctcgccgtactgcataccgcagaggctggaggtcgggcctacaaccacgcactttcggagctgccggaaacactcgagactttgctgctactgaccctccttgccacagtgaccggcgggattttcctgtttttaatgtctggaaaaggcatcggtaagatgactttggggatgtgctgcattatcacggcttccatactgctctggtatgcgcaaattcagccccactggatcgccgcaagcatcattctggagttctttcttatcgttctgctcataccagagcctgaaaaacagcgaaccccacaggataatcaattgacatacgtcgtgattgctatcctgactgtggtcgccgccaccatggcaaacgagatgggcttcttagagaagacaaagaaagacctaggactgggctcaattaccactcaggaaagtgagtctaatatcctcgacatagatcttagaccagcttccgcctggacactgtatgcggttgctacgacctttgtgactcctatgttgcgccatagcatcgaaaactcaagtgtaaatgtgagcctgacagccattgcaaaccaggccaccgtcctcatggggctgggaaagggttggcccctttccaaaatggacatcggcgtgccgctcctggctattgggtgttactctcaggttaatccaatcaccttgacagcagccctgttactactggtggcgcactacgctattatcggacctggcctccaagccaaggcaactagggaggcccagaaacgggctgccgcaggtataatgaagaaccccacggtcgatgggattaccgtaatcgaccttgaaccaatcccctatgatcctaagttcgagaaacagctgggccaggtgatgttgctgattctctgcgttacacaagtgctgatgatgcgtactacctgggctctttgtgaggccttaacactggcgaccggaccgataagcactctctgggaaggcaatcccgggagattttggaacacgacaatcgccgtctccatggcaaatattttcaggggatcatacttggctggcgccggtctgctattttctatcatgaagaacaccacaagtacccgccgggggacaggaaatattggcgagactctgggtgaaaaatggaagtcgcgactcaacgcacttggcaaaagcgagttccagatctataagaaatccgggatacaggaggtggacagaaccctggctaaggaaggaatcaagaggggcgagacagatcatcacgccgtctctcgcgggtcagccaaattgcggtggtttgtggaaagaaacatggttacgccagagggaaaggtggtagacctgggctgcggtcgtgggggatggagctactattgtggcggtctcaaaaatgtgagggaagtcaagggcctgaccaaagggggacctggccatgaggagcccattcctatgtccacttacgggtggaacttagttcggcttcaaagtggagtggatgtcttcttcacaccacccgaaaagtgcgacaccctgctctgtgatatcggcgagtctagccctaatccaactattgaagcgggtcgcacactacgagtgctgaacttggtagagaattggctgaacaataacacccagttttgcatcaaggtgctcaatccctatatgccgtcagttatagagaaaatggaggcacttcagagacagtacgggggagcactggtgaggaaccctttgtcccggaatagtacgcacgagatgtactgggtcagcaacgccaccggcaatattgtgtcttccgtcaacatgatctcacgcatgctgatcaatagattcacaatgaagcacaaaaaggctacttatgaaccagacgtggatctcggcagcgggaccaggaacattggaatagagtcggaaatccccaacttagacattatcggtaaacgaattgagaagatgaagcaagaacatgagatctcttggcactacgaccaggatcatccttataaaacatgggcctaccacggcagttatgagactaagcagaccgggtccgcaagctcaatggttaatggagtagtgcggctgcttacaaaaccatgggacgtcgtgcccatggttacccagatggccatgactgatacgacaccgtttggccaacagcgtgtgttcaaggaaaaagtcgacaccagaactcaggagcctaaggaaggtaccaagaaactgatgaagataacagctgagtggctatggaaagagctcgggaagaaaaagacgccccgcatgtgtaccagggaagagtttactcggaaagtgagatccaacgcggccctgggagcaatcttcacagatgaaaataagtggaagtctgctcgcgaggccgtagaagacggcaggttttgggagttggtggatcgagagcggaacctgcacctcgaaggcaaatgcgagacctgtgtttacaatatgatggggaagagagagaagaaacttggagagttcggtaaagcaaaaggcagcagggccatttggtatatgtggctgggggctcgctttttagagttcgaggccctgggatttttgaacgaggaccattggttcagtcgtggcaattccctcagcggtgtcgaaggggagggactgcaccggctaggctacatccttagagatgtgggcaagaaagaagggggagcgatgtacgcagacgatactgccggttgggacacaaggattaccctggaggacctcaagaacgaagagatggtgacaaatcatatgaaaggcgagcacaagaaactggctgaagccatctttaagttgacttatcagaacaaggtcgttcgcgtgcaacgaccaacccctcgggggacggtaatggatattatatctagaagggaccagcgcggatcaggccaggtgggtacctacgggctgaatacattcactaacatggaggcacaactcatcagacagatggaaggagagggcattttcaaaagtatccagcatcttaccgctacagaggaaatcgccgtccagaattggctggctcgggtgggcagggagcgtttatcccgaatggccattagcggggatgactgcgttgtgaagcccatagatgaccgctttgcatctgcgctgactgccttgaacgatatgggaaaagtcagaaaggacatccaacagtgggaaccatcgcggggttggaatgattggacccaggtgcccttctgctcacaccactttcatgagctcgtaatgaaagacggcagggttctggtggtcccttgtcgcaaccaggatgaactaattgggagagctcggatcagccaaggagccggctggtcccttaaggagacggcatgcctgggtaagagttatgctcagatgtggacactcatgtacttccacaggcgagacctgcgtttggccgcaaacgccatttgttctgcggtgccaagccattgggtgccgacctccagaactacatggtcaatccacgctaaacacgagtggatgaccactgaagatatgttagccgtctggaatcgcgtttggatacaggagaacccctggatggaagacaagacccctgtggagagttgggaagaggtaccatatctggggaaacgggaggaccagtggtgcggatctctcatcggccttacaagcagggcaacgtgggccaagaatattcaagctgccatcaaccaggtgagatccctgattggcaatgaagagtacaccgattatatgccctcaatgaaacgctttcggagggaagaggaagaggcaggggtcctatggtga

SEQ ID NO: 14554 - RNA, 9876 nt, synthetic construct
  misc_feature 1..9876: note = derived and/or modified CDS sequence (opt3) from DENV-2__EU482688__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgatcgaaaaggactcccctgtcaacatcgaggccgaacccccatttggagatagctacattataatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtttttacatcaattgggaaggccctgcaccaggtgttcggcgctatctacggagcggcatttagtggcgtaagctggactatgaaaatacttatcggggtcattatcacctggattggaatgaactccagatctacgagcttgtcagtgagtctggttctcgtgggcgtcgtgacactgtatcttggtgccatggtacaggctgactccgggtgtgtggttagctggaagaataaagaactgaagtgcggatctggcatcttcataaccgataacgtccacacttggacagagcagtacaagtttcaacccgaatcaccaagtaaattggccagcgcaattcagaaggcccatgaggaaggtatctgtggcattaggtccgtgacccggctcgagaatctgatgtggaaacagatcactcccgagttaaaccacatactgtctgaaaatgaggtgaagctaaccatcatgacaggggacattcgcggaatcatgcaggctggcaaaagatcgctcaggcctcaaccaacggaactgaagtatagctggaaaacctgggggaaggccaagatgctttccactgagtcacataaccagacattcttgattgatggaccggaaaccgcagagtgccccaatacaaaccgtgcgtggaatagtctggaggtcgaagactacggctttggtgttttcactaccaacatctggctcaaactgcgggagaagcaggacgtgttttgtgattctaaattaatgagcgctgccataaaggacaatcgagcagtgcacgccgatatggggtattggattgaatccgctctgaacgacacgtggaaaatggagaaggcctcattcatcgaggtaaagagctgccactggcctaaatctcatacactttggtccaatggagtcttggaaagtgagatgatcattccaaagaacttcgcaggccccgtgagccagcacaactacagacctggttatcatacccaaactgctggcccatggcacctcgggaaactggaaatggattttgacctatgtgagggaaccacagttgtggtcactgaagattgcggcaatagggggccctctctgcgcaccacaacggcctccggaaagctcatcaccgagtggtgctgtcggtcatgcactctgccgcctcttagatacaggggcgaggacggttgttggtacgggatggaaattcgcccattgaaagagaaggaagagaacctggtgaatagtttagttacagcgggacatggccagatagataacttcagcctcggtgtgctgggcatggccctttttctggaagagatgttgcgaacccggatcgggactaagcacgctattctcctggtagcagtctcgctagtgacactgatcaccggaaatatgtccttccgtgacctcggcagagtgatggtcatggttggggccacgatgactgatgacattggaatgggcgtgacctatctggctcttttggccgcatttaaagtaaggcccacattcgcggccggtctgttactccgcaagctgacctctaaagagcttatgatggctactatcgggatagccctgctaagccagtcaacaatccctgaaaccattctcgagctgacagatgcattggctctgggaatgatggtgttaaagatcgtccggaacatggaaaaataccaactcgccgtgactattatggcaatcagttgcgttcccaatgccgtgatactgcagaacgcttggaaggtctcctgtaccattcttgcggccgtgtctgttagcccactgttgctcacgtcctcacagcagaaggcagactggatccctctggctctaacaatcaaaggcctgaatcccaccgccatttttcttactaccctcagcagaacaagtaagaaaaggtcttggccactgaacgaggccataatggctgtgggcatggtctccatcttggcaagctcgctgttaaagaatgacattccgatgactgggcctctcgtagccggaggtctgcttaccgtgtgctatgttctgacgggccgatcagcggatttggaactcgagcgcgctgccgacgtgaaatgggaggatcaagcagaaatctctgggagttcccccattctgagcatcacaatatctgaggacggaagcatgtccatcaagaacgaagaggaggaacagaccctaactattctgatccggacaggccttctcgtcatttcaggtgtgttcccagtaagtatccccataaccgccgctgcatggtacctgtgggaggtgaaaaagcagagagccggggtcttgtgggatgttcctagcccaccccctgtggaaaaggcggagttagaagacggagcttataggattaaacagcgtggcatcctgggctactctcaaatcggggccggagtgtataaggagggtacttttcacacaatgtggcatgtcacccgcggcgcagtgctcatgcaccgggggaaaagaattgagccgtcctgggccgatgttaagaaagacctgatctcatacggaggcggttggaagcttgaaggggagtggaaggaaggagaggaagtacaggtgctggctttggagccaggcaaaaatcccagggccgtccagacgaagcctggcatattcaaaactaacaccgggacaattggagcagtgagtctagattttagcccaggtacctccggctctcccatcgttgaccgaaaggggaaagtggtcggactgtacggcaatggtgtggtaacacggtcgggggcttatgtcagcgccattgcgcagactgagaagtcaatcgaagataaccctgagatagaagacgatattttccgcaagaaaagactcaccatcatggacctgcatccgggagccggcaagacgaaaaggtaccttcccgcaatcgtgcgggaggctattaagcgaggcttaagaacactgatcctcgccccaactcgcgttgtggctgcagaaatggaggaggccttgagggggctgcctattcgttatcaaaccacagccataaaaaccgaacacactggacgggagatcgtcgacctcatgtgtcatgctacctttacaatgagactgctttcccccgtgagggttccaaactacaatctgattatcatggatgaagcgcacttcacggaccctgcaagtatcgccgctcgcggttatatttctactcgagtggagatgggcgaggccgcagggatattcatgaccgccacacccccaggaagcagagatccgtttcctcagtccaacgctcccatcatggacgaagagcgggaaattccagagaggtcatggaattctggccacgaatgggtcaccgatttcaagggtaagactgtgtggtttgtacccagcatcaaagcggggaacgacattgccgcatgcttgcgcaagaatggaaaaaaggtgatccagctaagtcgtaaaacattcgattccgagtacgttaagaccagagctaacgactgggattttgtcgtgacgactgacataagcgagatgggcgccaatttcaaggcagaacgggtgatcgatcctaggcgctgtatgaaaccagtcattctgacagacggcgaggaacgagtaatcctcgccgggcccatgcctgtgacccattcttcagctgcccaaagacggggaaggattggtcgcaacccgaagaatgagaacgaccagtatatctacatgggcgaaccattagagaatgatgaggactgcgcgcactggaaagaagcaaagatgctgcttgataacataaatacccccgaggggattatcccttccatgtttgaacccgagagagaaaaagttgacgccattgatggagagtacaggctgcggggcgaggctcgtaagactttcgtggacctcatgcgccgaggtgatttgccagtctggctggcctataaagtggctgcagaagggatcaactacgccgacagaaagtggtgttttgatggcataaagaataaccagatcctcgaggaaaacatggaggttgagatttggacaaaagaaggagagaggaagaaactgaagcctcggtggcttgacgctcgcatctatagtgatcccctagccctgaaagaattcaaggagtttgcagcgggcagaaagagcttgaccttaaatctgattacagaaatggggaggctcccaactttcatgacgcagaaagcccggaacgctctggacaatcttgccgtgctgcataccgcagaggctggaggtcgagcctacaaccacgcactctcggagttgcctgaaacactggagactctactgctccttaccctgttagccacagtcaccggcgggatcttcttgtttctgatgtctggaaagggcataggtaaaatgactctcgggatgtgctgcattatcacggcttccatcctgctttggtatgcgcaaattcagccgcactggatcgccgcaagcataattctggaattctttctcatcgtgttgctgattcccgagccagaaaagcagagaacccctcaggataatcaattaacatacgtagtgatcgctatactaactgttgtcgccgccaccatggcaaacgagatgggcttcctggagaaaacaaagaaggacctcggacttggctcaatcaccactcaggaaagtgagtctaatattctggacatcgatttgcgccccgcttccgcctggacactgtatgcggtggctacgacctttgtgactccaatgctcaggcatagcattgaaaactcaagtgtcaatgttagcctgacagccatcgcaaaccaggccaccgtgcttatggggctcggaaaaggttggcctctgtccaagatggacattggcgtacccttgctggctatcgggtgttactctcaggtgaatccgataaccttaacagcagccctactgctccttgtcgcgcactacgctattatcggaccaggcctgcaagccaaagcaactcgggaggcccagaagcgtgctgccgcaggtatcatgaaaaaccctacggtggatgggattaccgttatagacttggaacccatcccatatgatcccaagttcgagaagcagctgggccaggtgatgctcctgattctttgcgtcacacaagtattaatgatgagaactacctgggctctgtgtgaggccctcacattggcgaccggacctatcagcactctgtgggaaggcaatccggggaggttttggaacacgacaattgccgtgtccatggcaaatatcttccgcggatcatacctagctggcgccggtctgctcttttctataatgaaaaacaccactaatacccggcgagggacaggaaacatcggcgagactcttggtgaaaagtggaaaagtagactgaacgcattgggcaagtcggagttccagatttataaaaagagcgggatccaggaggttgacaggaccctggctaaagaaggaattaagcgcggcgagacagatcatcacgccgtgtcccgggggtctgccaagctcagatggtttgtcgaacgtaatatggtgacgcccgagggaaaagtcgtggacctgggctgcggtagggggggatggtcatactattgtggcggtttaaagaacgttcgggaagtgaaaggccttaccaaggggggaccaggccatgaggagcctatccccatgagcacttacgggtggaatctggtacgcctccaatccggaatagatgtgttctttacacctccagaaaaatgcgacaccctactgtgtgatattggcgagagttctcccaaccctactatcgaagcgggtcgaacattgagagtcctgaatctcgttgagaactggcttaataacaatacccagttctgcatcaaggtgctgaacccatatatgcccagcgtcattgaaaagatggaggctttgcagaggaaatacgggggagcactggtgcggaatccgctctcacgcaactccacgcacgagatgtactgggtaagtaatgccaccggcaacatagtgagctctgttaatatgatctccagaatgttaattaacaggttcacaatgaagcacaaaaaggctacttatgaacctgacgtggatctgggctcagggacccgaaacatcggaattgagagcgaaatcccaaatcttgacataatcggtaaacggattgagaagatcaagcaggaacatgagacatcgtggcactacgaccaagatcatccctataaaacttgggcctaccacggctcttatgagaccaagcagacagggagtgcatccagcatggtcaacggagtggtccgtctgctaaccaaaccttgggacgtggttccaatggtaactcagatggccatgacggatacaaccccctttggccagcaaagagtgttcaaggaaaaagtcgacactcgcacccaggagccgaaggaaggtacaaagaaactcatgaagattacggctgagtggctgtggaaagagttggggaagaaaaagacccctaggatgtgtactcgggaagagtttacaagaaaagtgcgctcaaatgcggccctgggagcaatcttcaccgatgaaaacaagtggaagtccgctagggaggccgttgaagacggccgattttgggagctcgtggatcgggagagaaatcttcacctggaaggcaaatgcgagacttgtgtctacaacatgatggggaagagggaaaaaaagttaggagagttcggtaaagcaaagggctctcgcgccatttggtatatgtggctgggggctcgttttttggaattcgaggccctcggatttctgaatgaggaccattggttcagccggggcaacagtctatccggtgtggaaggggagggacttcacagactgggctacatactcagggatgtaggcaagaaagaagggggagcgatgtacgcagacgatacagccggttgggacacccgcatcacactggaggacttgaagaatgaagagatggtgactaaccatatgaaaggcgagcacaagaaactggctgaagccatttttaagctcacctatcagaataaggttgtccgagtgcagcggcccacgccaagagggaccgtgatggatatcatcagcaggcgcgaccaaagaggatctggccaggtcggtacatacgggcttaacactttcaccaatatggaggcacagctgattcggcaaatggaaggagagggcatatttaaatcaatccagcatttaacagctactgaggaaattgccgttcagaactggctggctagggtgggccgtgagcgattgagtcgcatggccatctccggggatgactgcgtagtgaagcctattgatgacagattcgcaagcgcgctcaccgccctgaatgatatgggaaaagtccggaaggacatccagcaatgggaaccctctaggggttggaacgattggacgcaggtgccattctgctcgcaccactttcatgagctagttatgaaagacggccgcgtgcttgtcgtgccctgtagaaaccaggatgaactgatagggcgggctaggatctcacagggagccggctggagcctcaaggagacagcatgcctgggtaagtcctatgctcaaatgtggaccttgatgtacttccaccgacgtgacttaagactggccgcaaatgccatttgtagtgcggtaccttctcattgggttccaactagccgcacaacctggtccatccacgctaaacacgagtggatgactaccgaagatatgctcgccgtgtggaaccgggtctggattcaggagaatccgtggatggaagacaagacacccgtggagtcatgggaagaggtgccttatcttgggaaaagggaggaccagtggtgcggaagtatgatcggcctgacgtctagagcaacctgggccaagaacatacagactgctattaatcaagtccgcagcctaatcggcaacgaagagtacacagattatatgccatccatgaaacggtttaggcgagaagaggaagaggccggggttctgtggtga

SEQ ID NO: 14555 - RNA, 9876 nt, synthetic construct
  misc_feature 1..9876: note = derived and/or modified CDS sequence (opt3) from DENV-2__EU482691__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctacaagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatattaacagggcgtggaatagtctggaggttgaagactacggctttggtgtgttcactaccaacatctggctcaagctgcgtgagaaacaggacgtgttttgtgattctaagttaatgagcgctgccataaaagacaatcgggcagtacacgccgatatggggtattggattgaatccgctctgaacgacacgtggaagatggagaaggcctcattcatcgaggtcaaaagctgccactggcctaagtctcatacactttggtccaatggagtgttggaaagtgagatgatcattccaaaaaacttcgcaggccccgttagccagcacaactaccgacctggttatcatacccaaactgctggcccatggcacctcgggaagctggaaatggattttgacttctgtgagggaaccacagtggtcgtgactgaagattgcggcaatagagggccctctctaaggaccacaacggcctccggaaaactgatcaccgagtggtgctgtcgctcatgcactctcccgcctctgcggtacagaggcgaggacggttgttggtacgggatggaaattaggccacttaaggagaaggaagagaacttggttaatagtctggtgacagcgggacatggccagatagataactttagcttaggtgtactcggcatggccctgttccttgaagagatgctgcgcacccgaatcgggactaaacacgctattttgctcgtcgcagtgtcgtttgtgacactgatcaccggaaatatgtccttccgggacctaggccgtgtcatggttatggtgggggccacgatgactgatgacattggaatgggcgtaacctatctggctctcctggccgcatttaaggtgagacccacattcgcggccggtcttttgctgaggaaattaacctctaaggagctcatgatggctactatcgggatagccctgcttagccagtcaacaatccctgaaaccattctggagctaacagatgcactcgctctgggaatgatggtcttgaaaatcgtgcgcaacatggaaaagtaccaactggccgttactattatggcaatcagttgcgtgcccaatgccgtcatattacagaacgcttggaaggtgtcctgtaccattctcgcggccgtttctgtgagcccactgcttctgacgtcctcacagcagaaagcagactggatccctttggctctcacaatcaagggcctgaatcccaccgccatttttctaactaccctgagccggacaagtaaaaagagatcttggccacttaacgaggccataatggctgtcggcatggtatccatcctcgcaagctcgctgttgaaaaatgacattccgatgactgggcctctggtggccggaggtttactcaccgtttgctatgtgctgacgggcaggtcagcggatcttgaactggagcgagctgccgacgtccgctgggaggatcaagcagaaatctctgggagttcccccattttgagcatcacaatatctgaggacggaagcatgtccatcaagaacgaagaggaggaacagaccctcactattctgatccggacaggcctactggtgatttcaggtgtattcccagtgagtatccccataaccgccgctgcatggtacctttgggaggtcaaaaagcagagagccggggttctctgggatgtgcctagcccaccccctgtggaaaaggcggagctggaagacggagcttataggattaaacagcgtggcatcttgggctactctcaaatcggggccggagtctataaggagggtacttttcacacaatgtggcatgtgacccgcggcgcagttttaatgcaccgggggaaaagaattgagccgtcctgggccgatgtaaagaaagacctgatctcatacggaggcggttggaagctcgaaggggagtggaaggaaggagaggaagtgcaggtcctggctcttgagccaggcaaaaatcccagggccgtgcagacgaagcctggcatattcaaaactaacaccgggacaattggagcagttagtctggattttagcccaggtacctccggctctcccatcgtggaccgaaaggggaaagtcgtgggattgtacggcaatggtgtagtcacacggtcgggggcttatgtgagcgccattgcgcagactgagaagtcaatcgaagataaccctgagatagaagacgatattttccgcaagaaaagactaaccatcatggacctgcatccgggagccggcaagacgaaaaggtacctccccgcaatcgttcgggaggctattaagcgaggcctgagaacacttatcttagccccaactcgcgtggtcgctgcagaaatggaggaggccctgagggggctccctattcgttatcaaacccccgccataaaaacagaacacaccggacgggagatcgtggacttgatgtgtcatgctactttcaccatgagactgctctccccagttagggtgcctaactacaatctgattatcatggatgaagcgcactttacagaccccgcaagtatcgccgctcgcggttatatttctacgcgagtcgagatgggcgaggccgcagggatattcatgactgccaccccaccgggaagcagagatccttttccccagtccaacgctccaatcatggacgaagagcgggaaattcccgagaggtcatggaattctggccacgaatgggtgacagatttcaagggtaagaccgtatggtttgtgcctagcatcaaagcggggaacgacattgccgcatgccttcgcaagaatggaaaaaaggttatccagctgagtcgtaaaactttcgattccgagtacgtcaagacaagagctaacgactgggattttgtggtgaccacggacataagcgagatgggcgccaatttcaaggcagaacgggtcatcgatccaaggcgctgtatgaaacccgtaattttgactgacggcgaggaacgagtgatcctagccgggcctatgccggttacacattcttcagctgcccaaagacggggaaggattggtcgcaacccaaagaatgagaacgaccagtatatctacatgggcgaacccctggagaatgatgaggactgcgcgcactggaaagaagcaaagatgctcttagataacataaatacccctgaggggattatcccctccatgtttgaaccagagagagaaaaagtggacgccattgatggagagtacaggctgcggggcgaggctcgtaagaccttcgtcgaccttatgcgccgaggtgatctgcctgtgtggctcgcctataaagttgctgcagaagggatcaactacactgacagaaagtggtgttttgatggcataaagaataaccagatcttggaggaaaacatggaggtggagatttggacaaaagaaggagagaggaagaaactgaagccccggtggctcgacgcccgcatctatagtgatccactggctcttaaagaattcaaggagttcgccgcaggcagaaagagcctaaccctgaatttgattacagaaatggggaggttacctacttttatgacgcagaaagcgcggaacgccctggacaatctcgctgtcctgcataccgccgaggcaggaggtcgagcttacaaccacgccctttcggagctgccggaaacactcgagactttgctgctactgaccctccttgcaacagtgaccggcgggatcttcctgtttttaatgtctggaaagggcataggtaaaatgactttggggatgtgctgcattatcacggcctccatcctgctctggtatgctcaaattcagccccactggatcgcggccagcataattctggaattctttcttatcgtactgctcattccagagcctgaaaagcagagaaccccccaggataatcaattgacatacgtggttatcgcaatactgactgtcgtggctgccaccatggccaacgagatgggcttcttagagaaaacaaagaaggacctaggactgggctcaatcaccactcaggaaagtgagtctaatattctcgacatcgatcttcgcccagcatccgcttggacactgtatgccgtggcgacgacctttgtcactcctatgttgaggcatagcattgaaaactcaagtgttaatgtgagcctgacagctatcgccaaccaggcaaccgtactcatggggctgggaaaaggttggcccctttccaagatggacattggcgtgccgctcctggccatcgggtgttactctcaggtcaatccaataaccttgacagctgcactgttactactggtggcccactacgcgattatcggacctggcctccaagctaaagccactcgggaggcacagaagcgtgccgctgccggtatcatgaaaaaccccacggttgatgggattaccgtgatagaccttgaaccaatcccctatgatcctaagttcgagaagcagctgggccaggtcatgttgctgattctctgcgtaacacaagtgctgatgatgagaactacctgggcactttgtgaggctttaacactggccaccggaccgatcagcactctctgggaaggcaatcccgggaggttttggaacacgacaattgcggtttccatggccaatatcttccgcggatcatacttggcaggcgctggtctgctattttctataatgaaaaacaccactagtacccggcgagggacaggaaatatcggcgagactctgggtgaaaagtggaaatcgagactcaacgcccttggcaagagcgagttccagatttataaaaagtccgggatccaggaggtggacaggaccctggcaaaagaaggaattaagcgcggcgagacagatcatcacgctgtctctcgggggtcagccaagttgagatggtttgtggaacgtaacatggtcacgccagagggaaaagtggttgacctgggctgcggtagggggggatggagctactattgtggcggtctcaagaatgtgcgggaagtaaaaggcctgaccaaggggggacctggccatgaggagcccatccctatgtccacttacgggtggaacttagtgcgccttcaaagtggagtcgatgttttcttcacaccacccgaaaaatgcgacaccctgctctgtgatataggcgagtctagccctaatccaactattgaagccggtcgaacactaagagtgctgaacttggtcgagaattggctgaacaataacacccagttttgcgtgaaggtactcaatccctatatgccgtcagtgatcgaaaagatggaggcgcttcagaggcagtacgggggagctctggttcggaaccctttgtcccgcaatagtacgcacgagatgtactgggtgagcaacgcaaccggcaatatcgtctcttccgtgaacatgatttcaagaatgctgataaataggttcacaatgaaacacaagaaagccacttatgaaccagacgtcgatctcggcagcgggacccgaaacatcggaattgagtcggaaatccccaacttagacattatcggtaagcggatagagaaaatcaagcaagaacatgagatttcttggcactacgaccaggatcatccttataagacatgggcttaccacggcagttatgagactaaacagaccgggtccgccagctcaatggtgaatggagttgtacgtctgcttacaaagccatgggacgtggtccccatggtgacccagatggcaatgactgatacgacaccgtttggccaacagagagttttcaaagaaaaggtggacacccgcactcaggagcctaaagaaggtaccaagaagctgatgaaaatcacagccgagtggctatggaaggagctcgggaaaaagaaaacgcccaggatgtgtacccgggaagagtttactagaaaggtccgctccaacgctgcgctgggagccattttcacagatgaaaataaatggaagtctgcaagggaggctgtggaagacggccgattttgggagttggtagatcgggagagaaacctgcacctcgaaggcaagtgcgagacctgtgtgtacaatatgatggggaaaagggaaaagaaacttggagagttcggtaaggccaaaggcagccgcgcaatctggtatatgtggctgggggcccgttttttagaattcgaggctctgggatttttgaacgaggaccattggttcagtcggggcaattccctcagcggtgttgaaggggagggactgcacagactaggctacattcttagggatgtcggcaagaaggaagggggagccatgtacgcggacgatactgcaggttgggacacacgcataaccctggaggacctcaaaaacgaagagatggtgacaaatcatatgaagggcgagcacaaaaagctggccgaagctatctttaaattgacttatcagaacaaggtggtccgagttcaacggccaacccctagagggacggtgatggatattatctctaggcgcgaccagagaggatcaggccaggtaggtacctacgggctgaatacattcactaacatggaggcccaactcatccggcagatggaaggagagggcattttcaagagtatacagcatcttaccgcaacagaggaaatcgctgtgcagaattggctggccagggtcggccgtgagcgattatcccgcatggctattagcggggatgactgcgtggttaaacccatcgatgacagatttgcctctgcactgactgcgttgaacgatatgggaaaggtgcggaaagacattcaacagtgggaaccatcgaggggttggaatgattggacccaggtccccttctgctcacaccactttcatgagctcgtgatgaaggacggccgcgtactggttgtgccttgtagaaaccaggatgaactaatcgggcgggccaggataagccaaggagctggctggtcccttaaagagacggcctgcctgggtaagagttatgcacagatgtggacactcatgtacttccaccgacgtgacctgagattggctgccaacgcaatctgttctgccgtcccaagccattgggtgccgacctcccgcactacatggtcaattcacgcgaagcacgagtggatgaccactgaagatatgttagctgtgtggaatcgggtctggatccaggagaacccctggatggaagacaaaacccctgttgagagttgggaagaggtgccatatctggggaagagggaggaccagtggtgcggatctctcattggccttacaagcagagccacgtgggcaaaaaatatccaaaccgccataaaccaggtacgctccctgattggcaatgaagagtacactgattatatgccctcaatgaagcggtttaggcgagaagaggaagaggctggggtgctatggtga

SEQ ID NO: 14556 - RNA, 9876 nt, synthetic construct
  misc_feature 1..9876: note = derived and/or modified CDS sequence (opt3) from DENV-2__EU482693__SS-prME
  source 1..9876: mol_type = other RNA
acagccggcgtgatcgtaatgctgattccaacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtaccacatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggttgacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctaccagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatagaatccgctctgaacgacacatggaagatggagaaggcctcattcattgaggtcaaaagctgccactggcctaagtctcataccctttggtccaatggagtgttggaaagtgagatgatcatccccaagaatttcgcaggccccgttagccagcacaactaccgacctggttatcatactcaaaccgctggcccatggcacctcgggaagctggaaatggattttgacctatgtgagggaacaactgtggtcgtgaccgaagattgcggcaatagagggccctctctgaggacaacgaccgcctccggaaaactcattactgagtggtgctgtcgctcatgcacactgccgcctcttcggtacagaggcgaggacggttgttggtacgggatggaaatcaggccattgaaggagaaggaagagaacctggttaatagtttagtgaccgcgggacatggccagattgataacttcagcctcggtgtactgggcatggccctttttctggaagagatgttgcgcactcgaatagggacaaaacacgctaccctcctggtcgcagtgtcgttcgtgacgctaatcactggaaatatgtcctttcgggacctgggccgtgtcatggttatggtgggggccaccatgacagatgacattggaatgggcgtaacctatctcgctctgcttgccgcattcaaggtgagacccacttttgcggccggtttgctgttaaggaaactcacatctaaggagctgatgatggctaccatcgggattgcccttctgagccagtcaacaatccctgaaactatactagagctcaccgatgcactggctttgggaatgatggtcctgaaaatcgtgcgcaacatggaaaagtaccaattagccgttacgattatggcaatcagttgcgtgcccaatgccgtcattctccagaacgcttggaaggtgtcctgtacaatcctggcggccgtttctgtgagcccacttctgttgacctcctcacagcagaaagcagactggatacctctcgctctgactattaagggcctaaatcccaccgccatcttcctgacaactcttagccggaccagtaaaaagagatcttggccactcaacgaggccatcatggctgtcggcatggtatccattctggcaagctcgttgctgaaaaatgacataccgatgacggggcctttagtggccggaggtctcctgacagtttgctatgtgcttaccggcaggtcagcggatctggaattggagcgagctgccgacgtcaagtgggaggatcaagcagaaatctctgggagttcccccattctcagcatcactatttctgaggacggaagcatgtccatcaaaaacgaagaggaggaacagacactgaccatactaatccgcactggcctgcttgtgatttcaggtgtatttccagtgagtatccccattacagccgctgcatggtacctctgggaggtcaagaagcagcgggccggggttctgtgggatgtgcctagcccaccccctgtggaaaaagcggagttggaagacggagcttatagaatcaagcagaggggcatattaggctactctcaaattggggccggagtctataaagagggtaccttccacacgatgtggcatgtgactcgtggcgcagttctgatgcaccgcgggaagcggatcgagccgtcctgggccgatgtcaaaaaggacctcatctcatacggaggcggttggaagctggaaggggagtggaaagaaggagaggaagtgcaggtccttgctctggagccaggcaagaatcccagagccgtgcagaccaaacctggcatttttaagacaaacaccgggacaatcggagcagttagtttggatttcagcccaggtacttccggctctcccatagtggacaggaaagggaaggtcgtgggactatacggcaatggtgtagtcacccgatcgggggcttatgtgagcgccattgcgcagacggagaagtcaatcgaagataaccctgagattgaagacgatatctttcggaaaaagcgcctgacaataatggacctccatccgggagccggcaaaactaagagatacctgcccgcaattgttagggaggctatcaaacggggccttcgaaccttaatcctggccccaacaagagtggtcgctgcagaaatggaggaggccctccgcgggttgcctattaggtatcaaacccccgccatcaagactgaacacaccggacgtgagattgtggacctgatgtgtcatgctacattcacgatgcggctcctgtccccagttagagtgcctaactacaatcttataatcatggatgaagcgcacttcactgaccccgcaagtattgccgctaggggttatatctctacccgcgtcgagatgggcgaggccgcagggatctttatgacagccaccccaccgggaagccgagatcctttcccccagtccaacgctccaattatggacgaagagagagaaatacccgagcggtcatggaactctggccacgaatgggtgactgattttaagggtaaaacagtatggttcgtgcctagcatcaaggcggggaacgacattgccgcatgcctgaggaaaaatggaaagaaagttatccagttgagtcgcaagacctttgattccgagtacgtcaagacgcgtgctaacgactgggatttcgtggtgactacagacattagcgagatgggcgccaattttaaagcagaaagagtcatcgatccacggaggtgtatgaagcccgtaatactaaccgacggcgaggaacgcgtgatcctggccgggcctatgccggttacccattcttcagctgcccaacgaagaggacggattggtaggaaccccaaaaatgagaacgaccagtatatctacatgggcgaacccctcgagaatgatgaggactgcgcgcactggaaggaagcaaaaatgttactggataacattaatactcctgaggggatcataccctccatgttcgaaccagagcgcgaaaaggtggacgccattgatggagagtacagacttaggggcgaggctcggaaaacatttgtcgacctgatgcgtcgcggtgatctccctgtgtggttggcctataaggttgctgcagaagggatcaactacgccgaccgaaagtggtgtttcgatggcattaaaaataaccagatcctggaggaaaacatggaggtggagatatggaccaaggaaggagagaggaaaaagctcaaacccagatggctggacgctcggatctatagtgatccacttgccctaaaggaatttaaggagttcgcagcgggccgcaaaagcctgacattgaatttaattactgaaatggggagactgcctacgttcatgacccagaaggccaggaacgctctcgacaatctggccgtccttcatacagcagaggctggaggtcgggcctacaaccacgcactgtcggagctcccggaaactttggagaccctgctactgctcacacttctggccaccgtgactggcgggatctttttattcttgatgtctggaaaaggcattggtaagatgacgctggggatgtgctgcatcataaccgcttccattctcctgtggtatgcgcaaatccagccccactggatcgccgcaagcattatccttgaatttttcctgatagtactcttgattccagagcctgaaaaacagcgaacaccccaggataatcaactgacttacgtggttatcgctattttaaccgtcgtggccgccacaatggcaaacgagatgggctttctagagaagaccaagaaagacctgggactcggctcaatcactacacaggaaagtgagtctaatatacttgacatcgatctgagaccagcttccgcctggacgttgtatgcggtggctaccactttcgtcacacctatgctgcgccatagcattgaaaactcaagtgttaatgtgagcctcaccgccatcgcaaaccaggccaccgtactgatggggcttggaaagggttggcccctctccaaaatggacattggcgtgccgctgttggctatcgggtgttactctcaggtcaatccaattacactgactgcagccttactactgctcgtggcgcactacgctatcataggacctggccttcaagccaaggcaacgagggaggcccagaaacgggctgccgcaggtattatgaagaaccccaccgttgatgggatcacagtgatcgacctggaaccaattccctatgatcctaagtttgagaaacagttgggccaggtcatgctgctcatactgtgcgtaactcaagtgcttatgatgcgtaccacatgggctttatgtgaggccctgaccctcgcgactggaccgatcagcacgttgtgggaaggcaatcccgggagattctggaacacaaccattgccgtttccatggcaaatatctttaggggatcatacctggctggcgccggtctactgttctctattatgaagaacactaccagtacacgccgggggactggaaatatcggcgagaccctcggtgaaaaatggaagtcgcgacttaacgcactgggcaaaagcgagtttcagatatataagaaatccgggatccaggaggtggacagaacattggctaaggaaggaattaagaggggcgagacggatcatcacgccgtctctcgcgggtcagccaaactgcggtggttcgtggaaagaaacatggtcaccccagagggaaaggtggttgacctcggctgcggtcgtgggggatggagctactattgtggcggtctgaaaaatgtgagggaagtaaagggcttaactaaagggggacctggccatgaggagcccatccctatgtccacatacgggtggaaccttgtgcggctgcaaagtggagtcgatgtatttttcaccccacccgaaaagtgcgacactctcctatgtgatattggcgagtctagccctaatccaacaatcgaagcgggtcgcaccctgcgagtgttgaacctggtcgagaattggctcaacaataacacgcagttctgcataaaggtgcttaatccctatatgccgtcagtaattgagaaaatggaggctctgcagagaaagtacgggggagcattggtgaggaaccctctgtcccggaatagtacccacgagatgtactgggttagcaacgccacaggcaatatcgtgtcttccgtcaacatgatctcacgcatgctcattaatagatttactatgaaacacaagaaagctacctatgaaccagacgtggatttaggcagcgggacaaggaacataggaatcgagtcggaaattcccaacctggacatcattggtaagcgaatcgagaagataaaacaggaacatgagacttcttggcactacgaccaagatcatccttataagacctgggcctaccacggcagttatgagacaaaacagaccgggtccgcaagctcaatggtcaatggagtggttcggcttctgactaagccatgggacgtagtgcccatggtcacgcagatggccatgacagataccactccgttcggccagcaacgtgtgtttaaagaaaaggttgacaccagaacacaggagcctaaggaaggtacgaaaaagctaatgaaaatcaccgctgagtggctctggaaggagctggggaaaaagaaaactccccgcatgtgtacaagggaagagttcacccggaaggtgagatccaacgcggccttgggagcaatttttactgatgaaaataagtggaaatctgctcgcgaggccgtcgaagacggcaggttctgggagctggtggatcgagagcggaacctccaccttgaaggcaagtgcgagacatgtgtatacaatatgatggggaaaagagaaaagaaactgggagagtttggtaaggcaaagggcagcagggccatctggtatatgtggttaggggctcgcttcctggaatttgaggccttgggattcctcaacgaggaccattggtttagtcgtggcaattccctgagcggtgtggaaggggagggactacaccggcttggctacattctgagagatgtttctaaaaaggaaggcggggcgatgtacgcagacgataccgccggatgggacacaaggatcactctcgaggacctgaaaaacgaagagatggtcaccaatcatatgaagggtgagcacaaaaagttggctgaagccattttcaagctgacgtatcagaacaaagtggtgcgcgtccagcgaccaacccctcggggcacagttatggatataatctcaagaagggaccaacgcgggagtggacaggtgggcacttacggtctcaatacctttacaaacatggaggcacagcttattagacaaatggaaggggagggaatcttcaagtccatccagcatctgactgctgccgaggaaaatgtagtgcagaactggttagctcgggtcggcagggagcgtctgagccgaatggccatttctggcgatgactgcgtggttaaacccatagatgaccgcttcgcatcggcgttgaccgccctcaatgatatggggaaggtgagaaaagacatccagcaatgggaaccatcacggggatggaacgattggacgcaggtccccttttgcagccaccacttccatgagctggtgatgaaggacggtagggtcctagttgtgccttgtcgcaaccaggatgaacttattggcagagctcggatctcccagggggccggatggagtctgaaggagacagcatgcctcggcaaatcttatgctcaaatgtggaccctgatgtactttcacaggcgagacttgcgtttagccgcaaatgccatttgtagcgcggtcccatcccattgggtgccgacttcaagaacaacctggagtatccacgctaagcacgagtggatgactaccgaagatatgctggccgtgtggaaccgcgtctggatacaggagaatccctggatggaagacaaaacacctgttgagtcttgggaagaggtgccatatctcggtaagcgggaggaccagtggtgcgggagccttatcggactgacgtccagggcaacctgggccaaaaacattcagactgctatcaatcaagtaagatcactaattggcaacgaagagtacacagattatatgcccagcatgaagcgcttccggagggaagaggaagaggccggcgtgctgtggtga

SEQ ID NO: 14557 - RNA, 9876 nt, synthetic construct
  misc_feature 1..9876: note = derived and/or modified CDS sequence (opt3) from DENV-2__EU596483__SS-prME
  source 1..9876: mol_type = other RNA
accgccggcgtgatcgtaatgctgattccaacggctatggcattccacctcactacgagaaacggggaacctcatatgatagttggaaggcaggaaaagggtaaaagccttctgtttaagaccgaagacggcgtgaatatgtgcacattgatggccatcgatttaggggaactgtgtgaagacactattacctacaaatgcccactactccggcaaaacgaaccggaagatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccgtagtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggttgaagactacggctttggtgtgttcaccacgaacatttggctcaagctgcgtgagaaacaggacgtgttttgtgattctaagttaatgagcgctgccatcaaagacaatcgggcagtacacgccgatatggggtattggatggaatccgctctgaacgacacatggaagatggagaaggcctcattcatagaggtcaaaagctgccactggcctaagtctcataccctttggtccaatggagtgttggaaagtgagatgattatccccaagaatttcgcaggccccgttagccagcacaactaccgacctggttatcatactcaaaccgctggcccatggcacctcgggaagctggaaatggattttgacttctgtgagggaacaactgtggtcgtgaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaattaggccacttaaggagaaggaagagaacttggttaatagtctggtgaccgcgggacatggccagatcgataactttagcttaggtgtactcggcatggccctgttccttgaagagatgctgcgcactcgaattgggacaaaacacgctatattgctcgtcgcagtgtcgtttgtgaccctgatcacgggaaatatgtccttccgggacctaggccgtgtcatggttatggtgggggccactatgaccgatgacattggaatgggcgtaacatatctggctctcctggccgcatttaaggtgagacccaccttcgcggccggtcttttgctgaggaaattaacttctaaggagctcatgatggctacaatcgggattgccctgcttagccagtcaaccatccctgaaacaatactggagctaactgatgcactcgctctgggaatgatggtcttgaaaatcgtgcgcaacatggaaaagtaccaactggccgttaccattatggcaatcagttgcgtgcccaatgccgtcattttacagaacgcttggaaggtgtcctgtacgatcctcgcggccgtttctgtgagcccactgcttctgacatcctcacagcagaaagcagactggatacctttggctctcaccattaagggcctgaatcccactgccatctttctaaccacactgagccggacaagtaaaaagagatcttggccacttaacgaggccatcatggctgtcggcatggtatccattctcgcaagctcgctgttgaaaaatgacataccgatgaccgggcctctggtggccggaggtttactcacggtttgctatgtgctgacaggcaggtcagcggatcttgaactggagcgagctgccgacgtcaagtgggaggatcaagcagaaatctctgggagttcccccattttgagcatcaccatttctgaggacggaagcatgtccatcaaaaacgaagaggaggaacagactctcacaatactgatccgcaccggcctactggtgatttcaggtgtattcccagtgagtatccccattactgccgctgcatggtacctttgggaggtcaagaagcagcgggccggggttctctgggatgtgcctagcccaccccctgtggaaaaagcggagctggaagacggagcttatagaatcaagcagaggggcatattgggctactctcaaattggggccggagtctataaagagggtacatttcacaccatgtggcatgtgacgcgtggcgcagttttaatgcaccgcgggaagcggatcgagccgtcctgggccgatgtcaagaaggacctgatctcatacggaggcggttggaagctcgaaggggagtggaaagaaggagaggaagtgcaggtcctggctcttgagccaggcaagaatcccagagccgtgcagactaaacctggcattttcaagaccaacacagggaccatcggagcagttagtctggattttagcccaggtacatccggctctcccatagtggacaggaaagggaaggtcgtgggattgtacggcaatggtgtagtcactcgatcgggggcttatgtgagcgccattgcgcagaccgagaagtcaatcgaagataaccctgagattgaagacgatatcttccggaaaaagcgcctaacgataatggacctgcatccgggagccggcaaaacaaagagatacctccccgcaattgttagggaggctatcaaacggggcctgcgaactcttatcttagccccaaccagagtggtcgctgcagaaatggaggaggccctgcgcgggctccctattaggtatcaaacacccgccatcaagaccgaacacactggacgtgagattgtggacttgatgtgtcatgctaccttcacaatgcggctgctctccccagttagagtgcctaactacaatctgataatcatggatgaagcgcactttacggaccccgcaagtattgccgctaggggttatatctctactcgcgtcgagatgggcgaggccgcagggatcttcatgaccgccacaccaccgggaagccgagatccttttccccagtccaacgctccaattatggacgaagagagagaaatacccgagcggtcatggaactctggccacgaatgggtgaccgatttcaagggtaaaactgtatggtttgtgcctagcatcaaggcggggaacgacattgccgcatgccttaggaaaaatggaaagaaagttatccagctgagtcgcaagacattcgattccgagtacgtcaagacccgtgctaacgactgggattttgtggtgacgactgacattagcgagatgggcgccaatttcaaagcagaaagagtcatcgatccacggaggtgtatgaagcccgtaatattgacagacggcgaggaacgcgtgatcctagccgggcctatgccggttacccattcttcagctgcccaacgaagaggacggattggtaggaaccccaaaaatgagaacgaccagtatatctacatgggcgaacccctggagaatgatgaggactgcgcgcactggaaggaagcaaaaatgctcttagataacattaatacccctgaggggatcataccctccatgtttgaaccagagcgcgaaaaggtggacgccattgatggagagtacagactgaggggcgaggctcggaaaactttcgtcgaccttatgcgtcgcggtgatctgcctgtgtggctcgcctataaggttgctgcagaagggatcaactacacagaccgaaagtggtgttttgatggcattaaaaataaccagatcttggaggaaaacatggaggtggagatatggaccaaggaaggagagaggaaaaagctgaaacccagatggctcgacgcccggatctatagtgatccactggctcttaaggagttcaaggagttcgccgcaggccgcaaaagcctaacactgaatttgattactgaaatggggagattacctacgtttatgacccagaaggcgaggaacgccctggacaatctcgctgtcctgcatacagccgaggcaggaggtcgggcttacaaccacgccctttcggagctgccggaaactctcgagaccttgctgctactgacactccttgcaaccgtgactggcgggatcttcctgtttttaatgtctggaaaaggcattggtaagatgacgttggggatgtgctgcatcataaccgcctccattctgctctggtatgctcaaatccagccccactggatcgcggccagcattatcctggagttctttcttatagtactgctcattccagagcctgaaaaacagcgaacaccccaggataatcaattgacttacgtggttatcgcaattctgaccgtcgtggctgccacaatggccaacgagatgggcttcttagagaagaccaagaaagacctaggactgggctcaatcactacacaggaaagtgagtctaatatactcgacatcgatcttagaccagcatccgcttggacgctgtatgccgtggcgaccacttttgtcacacctatgttgcgccatagcattgaaaactcaagtgttaatgtgagcctgaccgctatcgccaaccaggcaaccgtactcatggggctgggaaagggttggcccctttccaaaatggacattggcgtgccgctcctggccatcgggtgttactctcaggtcaatccaattacattgactgctgcactgttactactggtggcccactacgcgatcataggacctggcctccaagctaaggccacgagggaggcacagaaacgggccgctgccggtattatgaagaaccccaccgttgatgggatcacagtgatcgaccttgaaccaattccctatgatcctaagttcgagaaacagctgggccaggtcatgttgctgatactctgcgtaactcaagtgctgatgatgcgtaccacatgggcactttgtgaggctttaaccctggccactggaccgatcagcacgctctgggaaggcaatcccgggagattttggaacacaaccattgcggtttccatggccaatatcttcaggggatcatacttggcaggcgctggtctgctattttctattatgaagaacactaccagtacacgccgggggactggaaatatcggcgagaccctgggtgaaaaatggaagtcgcgactcaacgcccttggcaaaagcgagttccagatatataagaaatccgggatccaggaggtggacagaacactggcaaaggaaggaattaagaggggcgagacggatcatcacgctgtctctcgcgggtcagccaaattgcggtggtttgtggaaagaaacatggtcaccccagagggaaaggtggttgacctgggctgcggtcgtgggggatggagctactattgtggcggtctcaaaaatgtgagggaagtaaagggcctgactaaagggggacctggccatgaggagcccatccctatgtccacatacgggtggaacttagtgcggcttcaaagtggagtcgatgttttcttcaccccacccgaaaagtgcgacactctgctctgtgatattggcgagtctagccctaatccaacaatcgaagccggtcgcaccctacgagtgctgaacttggtcgagaattggctgaacaataacacgcagttttgcataaaggtgctcaatccctatatgccgtcagtaattgagaaaatggaggcgcttcagagacagtacgggggagctctggtgaggaaccctttgtcccggaatagtacccacgagatgtactgggttagcaacgcaacaggcaatatcgtgtcttccgtcaacatgatctcacgcatgctgattaatagattcactatgaagcacaaaaaggccacctatgaaccagacgtggatctcggcagcgggacaaggaacataggaatcgagtcggaaattcccaacttagacatcattggtaaacgaatcgagaagataaagcaagaacatgagatctcttggcactacgaccaggatcatccttataaaacttgggcttaccacggcagttatgagaccaagcagacagggtccgccagctcaatggtcaatggagtggttcggctgcttaccaaaccatgggacgtagtgcccatggtcactcagatggcaatgacggatacaaccccgtttggccaacagcgtgtgttcaaggaaaaagttgacactagaacccaggagcctaaggaaggtacaaagaaactgatgaagattacggccgagtggctatggaaagagctcgggaagaaaaagaccccacgcatgtgtactagggaagagtttacacggaaagtgagatccaacgctgcgctgggagccatcttcaccgatgaaaataagtggaagtctgcacgcgaggctgtcgaagacggcaggttttgggagttggtggatcgagagcggaacctgcacctcgaaggcaaatgcgagacttgtgtatacaatatgatggggaagagagagaagaaacttggagagttcggtaaagccaaaggcagcagggcaatttggtatatgtggctgggggcccgctttttagagttcgaggctctgggatttttgaacgaggaccattggttcagtcgtggcaattccctcagcggtgtggaaggggagggactgcaccggctaggctacatccttagagatgttggcaagaaagaagggggagccatgtacgcggacgatacagcaggttgggacaccaggattacactggaggacctcaagaacgaagagatggtcactaatcatatgaaaggcgagcacaagaaactggccgaagctatatttaagttgacctatcagaacaaggtggtgcgcgtccaacgaccaacgcctcgggggaccgttatggatatcatttctagaagggaccagcgcggatcaggccaggtgggtacatacgggctgaatactttcaccaacatggaggcccaactcatcagacagatggaaggagagggcatcttcaaaagtattcagcatcttacagcaactgaggaaatagctgtacagaattggctggcccgggtgggcagggagcgtttatcccgaatggctatcagcggggatgactgcgtcgtgaagcccattgatgaccgctttgcctctgcactgaccgcgttgaacgatatgggaaaagttagaaaggacatccaacagtgggaaccatcgcggggttggaatgattggacacaggtgcccttctgctcacaccactttcatgagctcgtcatgaaagacggcagggtgctggtagttccttgtcgcaaccaggatgaactaattgggagagcccggatcagccaaggagctggctggtcccttaaggagacagcctgcctgggtaagagttatgcacagatgtggaccctcatgtacttccacaggcgagacctgcgtttggctgccaacgcaatatgttctgccgtgccaagccattgggtcccgacttccagaacaacctggtcaatccacgcgaaacacgagtggatgactaccgaagatatgttagctgtgtggaatcgcgtgtggattcaggagaacccctggatggaagacaagacacctgtcgagagttgggaagaggttccatatctggggaaacgggaggaccagtggtgcggatctctcatcggccttacgagcagggccacctgggcaaagaatattcaaactgccatcaaccaggtgagatccctgataggcaatgaagagtacacagattatatgccctcaatgaaacgctttcggagggaagaggaagagaccggggtactatggtga

SEQ ID NO: 14558 - RNA, 9876 nt, synthetic construct
  misc_feature 1..9876: note = derived and/or modified CDS sequence (opt3) from DENV-2__EU482597__SS-prME
  source 1..9876: mol_type = other RNA
accgccggagtgatcgtcatgctgattcccactgctatggcattccacctcactacgagaaatggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacctctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgtctgaggaacaggacaaacgatttatctgcaagcatagcatggtcgatagaggctggggtaatgggtgtggactattcggcaagggcgggatcgtgacctgcgccatgtttacatgcaaaaagaacatggaaggaaaagtggtccagcctgagaatctcgaatacaccattgttataactccacactccggtgaggagcatgctgtgggcaacgacacggggaagcacggaaaagaaatcaagattacaccgcagtcaagtatcaccgaggccgaactgactggctatggtaccgtaacaatggagtgtagccccaggaccgggcttgatttcaatgaaatggtgctgttgcaaatggaggacaaagcatggctcgtccaccggcagtggtttctggatttacctctgccatggctccccggcgctgacactcagggatctaactggatacagaaggagacacttgtgacgttcaagaatcctcatgccaaaaagcaagacgttgtggtcctgggctcccaggaaggggcgatgcacaccgccttgactggagcaacagagattcagatgtcaagcggtaacctactgtttaccggccatctcaaatgccgtctgcgcatggataaacttcaactgaaagggatgagttactctatgtgtacaggaaagttcaagatcgtgaaagaaatcgctgagactcagcacggcaccattgtaatcagagttcagtatgagggtgacgggtccccatgcaagattcccttcgaaataacggatttggagaaaaggcatgtgctcggccggctgatcaccgtcaatccgattgtgacagaaaaggacagccctgtcaacatcgaggccgaacccccatttggagattcgtacatcattataggcgtggagcctgggcagttaaaactgaactggttcaagaagggatcttccatcggtcaaatgtttgagactaccatgcgaggcgctaaacgcatggccattctaggggacacagcatgggatttcggatcactcggcggtgtttttacaagtatcgggaaggccctgcaccaggtgttcggcgctatttacggagcggcatttagcggcgtatcctggaccatgaaaatccttataggggtcatcattacgtggatcggaatgaactctagaagcacatcattgagtgtgtccctggttctcgtgggcgtcgtgaccctgtatcttggtgccatggtacaggctgacagcgggtgtgtggtttcttggaagaacaaagaactgaagtgcggatcaggcattttcatcactgataatgtccacacatggaccgagcagtacaagtttcaacccgaaagtccaagcaaattggcctccgcaatacagaaggcccatgaggaaggtatttgtggcatcaggtctgtgactcggctcgagaacctgatgtggaaacagattacccccgagttaaatcacatcctgtcggaaaacgaggtgaagctaacaataatgacgggggacatccgcggaattatgcaggctggcaaaagaagcctcaggcctcaaccaaccgaactgaagtattcctggaaaacttgggggaaggccaagatgctttcaacagagagtcataatcagaccttcttgatcgatggaccggaaacagcagagtgccccaacactaatcgtgcgtggaactctctggaggtcgaagactacggctttggtgttttcaccacgaatatttggctcaaactgcgggagaagcaggacgtgttttgtgatagcaaattaatgtccgctgccatcaaggacaaccgagcagtgcacgccgatatggggtattggatagaatcagctctgaatgacacatggaaaatggagaaggccagcttcattgaggtaaagtcttgccactggcctaaatcccataccctttggagtaacggagtcttggaaagcgagatgatcatcccaaagaatttcgcaggccccgtgtctcagcacaactacagacctggttatcatactcaaaccgctggcccatggcacctcgggaaactggaaatggattttgacctatgtgagggaacaactgttgtggtcaccgaagattgcggcaacagggggccctccctgcgcacaacgaccgcctcaggaaagctcattactgagtggtgctgtcggagttgcacactgccgcctcttagatacaggggcgaggacggttgttggtacgggatggaaatccgcccattgaaagagaaggaagagaatctggtgaacagcttagttaccgcgggacatggccagattgataatttctcgctcggtgtgctgggcatggccctttttctggaagagatgttgcgaactcggatagggacaaagcacgctatcctcctggtagcagtctccttcgtgaccctaattacgggaaacatgtcttttcgtgacctgggcagagtgatggtcatggttggggccactatgaccgatgacatcggaatgggcgtgacatatctcgctctgcttgccgcattcaaagtaaggcccacctttgcggccggtttgctgttacgcaagctcactagcaaagagctgatgatggctacaattgggatcgcccttctgtcacagagtaccatacctgaaacaatcctagagctcactgatgcactggctttgggaatgatggtgctgaagattgtccggaatatggaaaaataccaattagccgtgaccatcatggcaatttcctgcgttcccaacgccgtgatcctccagaatgcttggaaggtctcttgtacgatactggcggccgtgagcgtttccccacttctgttgacatcaagccagcagaaggcagactggattcctctcgctctgaccatcaaaggcctaaaccccactgccatcttcctgaccacacttagtagaacttctaagaaaaggtcctggccactcaatgaggccattatggctgtgggcatggtcagcatactggcatcgtcattgctgaagaacgacatcccgatgaccgggcctttagtagccggaggtctcctgacggtgtgctatgttcttacaggccgatctgcggatctggaattggagcgcgctgccgacgtgaaatgggaggatcaagcagaaattagtgggtccagccccatcctctctattaccatcagcgaggacggatccatgtcaataaagaatgaagaggaggaacagactctgacaatcctaattcggaccggcctgcttgtcatcagtggtgtgtttccagtaagcattcccatcactgccgctgcatggtacctctgggaggtgaaaaagcagagagccggggtcctgtgggatgttccttctccaccccctgtggaaaaggcggagttggaagacggagcttataggataaaacagcgtggcattttaggctactcccaaatcggggccggagtgtataaggagggtacattccacaccatgtggcatgtcacgcgcggcgcagtgctgatgcaccgggggaaaagaatcgagccgtcatgggccgatgttaagaaagacctcattagttacggaggcggttggaagctggaaggggagtggaaggaaggagaggaagtacaggtgcttgctctggagccaggcaaaaaccccagggccgtccagactaagcctggcatctttaaaaccaatacagggaccataggagcagtgagcttggatttctccccaggtacatctggctcgcccattgttgaccgaaaggggaaagtggtcggactatacggcaacggtgtggtaactcggagcggggcttatgtctcagccatcgcgcagaccgagaagtccattgaagataatcctgagatcgaagacgatatatttcgcaagaaaagactgacgattatggacctccatccgggagccggcaagacaaaaaggtacctgcccgcaatcgtgcgggaggctatcaagcgaggccttagaactttaattctggccccaacccgcgttgtggctgcagaaatggaggaggccctcagggggttgcctatccgttatcaaacaaccgccattaaaactgaacacaccggacgggagatagtcgacctgatgtgtcatgctacattcacgatgagactcctgagtcccgtgagggttccaaactacaaccttatcattatggatgaagcgcacttcactgaccctgcatctatcgccgctcgcggttatatcagcacccgagtggagatgggcgaggccgcagggatttttatgacagccacacccccaggatccagagatccgttccctcagtcaaatgctcccataatggacgaagaacgggaaatcccagagaggtcttggaacagcggccacgaatgggtcactgattttaagggtaagacagtgtggttcgtacccagtattaaagcggggaatgacatcgccgcatgcctgcgcaagaacggcaagaaggtgattcagttgtcccgtaaaacctttgatagcgagtacgttaagacgagagctaatgactgggatttcgtcgtgactacagacatctctgagatgggcgccaactttaaggcagaacgggtgatagatcctaggcgctgtatgaaaccagtcatcctaaccgacggcgaggaacgagtaattctggccgggcccatgcctgtgacccattcatccgctgcccaaagacggggaaggatcggtcgcaatccgaagaacgagaatgaccagtatatttacatgggcgaaccactcgagaacgatgaggactgcgcgcactggaaagaagcaaagatgttactggataatatcaacactcccgaggggataattcctagtatgttcgaacccgagagagaaaaagttgacgccatcgatggagagtacaggcttcggggcgaggctcgtaagacatttgtggacctgatgcgccgaggtgatctcccagtctggttggcctataaagtggctgcagaagggattaattacgccgacagaaagtggtgtttcgatggcatcaagaacaatcagatactggaggaaaacatggaggttgagatctggaccaaagaaggagagaggaagaaactcaagcctcggtggctggacgctcgcatttatagcgatccccttgccctaaaagaatttaaggagttcgcagcgggcagaaagtcgctgacattgaacttaatcactgaaatggggaggctgccaacgttcatgacccagaaagcccggaatgctctcgacaacctggccgtgcttcatacagcagaggctggaggtcgagcctacaatcacgcactgtctgagctccctgaaactttggagaccctgctactgctcacacttctggccaccgtcactggcgggatatttttattcttgatgtccggaaagggcatcggtaaaatgacgctggggatgtgctgcataattaccgctagcatcctcctgtggtatgcgcaaatccagccgcactggattgccgcatcaatcatacttgaatttttcctgattgtgctcttgatccccgagccagaaaagcagagaacacctcaggataaccaactgacttacgtagtgattgctatcttaaccgttgtcgccgccacaatggcaaatgagatgggctttctagagaaaaccaagaaggacctgggactcggcagtataactacacaggaatctgagtccaacatccttgacattgatctgcgccccgctagcgcctggacgttgtatgcggtggctaccactttcgtgacaccaatgctgaggcattcaatcgaaaatagtagcgtcaacgtttccctcaccgccattgcaaatcaggccaccgtgctgatggggcttggaaaaggttggcctctctctaagatggacatcggcgtacccctgttggctattgggtgttacagccaggtgaacccgatcacactgactgcagccttactactgctcgtcgcgcactacgctataattggaccaggccttcaagccaaagcaacgcgggaggcccagaagcgtgctgccgcaggtatcatgaaaaatcctaccgtggatgggatcacagttattgacctggaacccataccatatgatcccaagtttgagaagcagttgggccaggtgatgctgctcatcctgtgcgtcactcaagtacttatgatgagaaccacatgggctttatgtgaggccctgaccctcgcgactggacctatttccacgttgtgggaaggcaacccggggaggttctggaatacaaccatcgccgtgtcaatggcaaacatttttcgcggatcttacctggctggcgccggtctactgttcagtatcatgaaaaatactaccaacacacggcgagggactggaaatataggcgagaccctcggtgaaaagtggaaatcgagacttaacgcactgggcaagagcgagtttcagatctataaaaagtccgggattcaggaggttgacaggacattggctaaagaaggaatcaagcgcggcgagacggatcatcacgccgtgtctcgggggtcagccaagctgagatggttcgtcgaacgtaacatggtgacccccgagggaaaagtcgtggacctcggctgcggtagagggggatggagctactattgtggcggtctgaagaatgttcgggaagtgaaaggcttaactaaagggggaccaggccatgaggagcctattcccatgtccacatacgggtggaaccttgtacgcctgcaaagtggagtggatgtctttttcacccctccagaaaaatgcgacactctcctatgtgatatcggcgagtctagccccaatcctacaatagaagcgggtcgaaccctgagagttttgaacctggtggagaattggctcaacaataacacgcagttctgcattaaggtccttaatccatatatgccctcagtgatcgaaaagatggaggctctgcagaggaaatacgggggagcattggtacggaacccgctgtcccgcaatagtacccacgagatgtactgggtgagcaacgccacaggcaatatcgtttcttccgtgaacatgatttcaagaatgctcataaataggtttactatgaagcacaaaaaggctacctatgaacctgacgtcgatttaggcagcgggacacgaaacatcggaattgagtcggaaatcccaaacctggacattatcggtaaacggatagagaagatcaagcaggaacatgagacttcttggcactacgaccaagatcatccctataaaacctgggcctaccacggcagttatgagacaaagcagaccgggtccgcaagctcaatggtgaatggagtcgtgcgtcttctgactaaaccttgggacgttgtaccaatggtgacgcagatggccatgacagataccactcccttcggccagcaaagagtctttaaggaaaaagtggacacccgcacacaggagccgaaggaaggtacgaagaaactaatgaagattaccgctgagtggctctggaaagagctggggaagaaaaagactcctaggatgtgtacacgggaagagttcaccagaaaagttcgctccaacgcggccttgggagcaatctttactgatgaaaataagtggaagtctgctagggaggccgtggaagacggccgattctgggagctggtcgatcgggagagaaacctccaccttgaaggcaaatgcgagacatgtgtgtacaatatgatggggaagagggagaagaagctgggagagtttggtaaagcaaagggcagccgcgccatttggtatatgtggttaggggctcgtttcctggaatttgaggccttgggattcctcaacgaggaccattggtttagtcggggcaattccctgagcggtgtagaaggggagggactacacagacttggctacatcctgagggatgtgggcaagaaagaagggggagcgatgtacgcagacgataccgccggttgggacacacgcattactctcgaggacctgaagaacgaagagatggttaccaatcatatgaaaggcgagcacaagaaattggctgaagccatattcaagctgacgtatcagaacaaggtcgtgcgagtgcagcggcccaccccaagagggacagtcatggatatcatttctaggcgcgaccaaagaggatcaggccaggttggtacttacgggctcaatacctttacaaacatggaggcacagcttatccggcaaatggaaggagagggcatcttcaaaagtattcagcatctgactgctaccgaggaaatagccgtgcagaattggttagctagggtaggccgtgagcgactgtcccgcatggccatcagcggggatgactgcgtggtcaagcctattgatgacagattcgcatctgcgttgacggccctcaacgatatgggaaaaatccggaaggacattcagcaatgggaaccctcgaggggttggaatgattggacacaggtgccattttgctcacaccacttccatgagctggttatgaaagacggccgcgtgctagtcgtgccctgtagaaaccaggatgaacttatcgggcgggctaggataagccagggagccggctggtccctgaaggagaccgcatgcctcggtaagagttatgctcaaatgtggactctgatgtactttcaccgacgtgacttgagattagccgcaaacgccatctgttctgcggtacctagccattgggttccaacatcccgcaccacttggtcaattcacgctaaacacgagtggatgaccacagaagatatgctggccgtgtggaatcgggtctggatccaggagaacccgtggatggaagacaagacgcccgtggagagttgggaagaggtgccttatctcgggaaaagggaggaccagtggtgcggatctcttattggcctgaccagcagagcaacttgggccaagaatatccagacagctataaaccaagtccgctccctaattggcaatgaagagtacaccgattatatgccatcaatgaaacggttcaggcgagaagaggaagaggccggggttctgtggtga

SEQ ID NO: 14559 - RNA, 9876 nt, synthetic construct
  misc_feature 1..9876: note = derived and/or modified CDS sequence (opt3) from DENV-2__EU482598__SS-prME
  source 1..9876: mol_type = other RNA
accgccggagtgatcgtaatgctgattcccacagctatggcattccacctcactacgagaaatggggagcctcatatgatagttggaaggcaggaaaagggtaaaagccttctgtttaagaccgaggacggcgtgaatatgtgcaccttgatggccatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtggacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtcaaagaaattgctgagactcagcacggcaccatcgtgattagagtacagtatgagggtgacgggtctccatgcaagatacccttcgaaatcacggatttggagaaaaggcatgttctcggccggctgattaccgtgaacccgatcgtcacagaaaaggactcccctgtgaacatcgaggccgaacccccatttggagatagctacattataatcggcgtcgagcctgggcagttaaaactgaattggttcaagaagggatcgtctattggtcaaatgtttgagactaccatgcgaggcgctaaacgcatggccatcctaggggacacagcatgggatttcggatccctcggcggtgtgtttacttcaattgggaaggccctgcaccaggttttcggcgctatctacggagcggcatttagtggcgtgagctggaccatgaaaatacttatcggggtaattatcacgtggattggaatgaactccagatctactagcttgtcagtcagtctggtgctcgttggcgtggtcaccctgtatcttggtgccatggtgcaggctgactccgggtgtgtagtgagctggaagaataaagaactgaagtgcggatctggcatcttcataactgataacgttcacacatggaccgagcagtacaagtttcaacccgaatcaccaagtaaattggccagcgcaattcagaaggcccatgaggaaggtatctgtggcattaggtccgtcactcggctcgagaatctgatgtggaaacagatcacccccgagttaaaccacatactgtctgaaaatgaggtgaagctaacaatcatgacgggggacattcgcggaatcatgcaggctggcaaaagatcgctcaggcctcaaccaaccgaactgaagtatagctggaaaacttgggggaaggccaagatgctttccacagagtcacataaccagaccttcttgattgatggaccggaaacagcagagtgccccaatactaaccgtgcgtggaatagtctggaggtggaagactacggctttggtgtcttcaccacgaacatctggctcaaactgcgggagaagcaggacgtattttgtgattctaaattaatgagcgctgccataaaggacaatcgagcagtgcacgccgatatggggtattggattgaatccgctctgaacgacacatggaaaatggagaaggcctcattcatcgaggtaaagagctgccactggcctaaatctcataccctttggtccaatggagtattggaaagtgagatgatcattccaaagaacttcgcaggccccgtcagccagcacaactacagacctggttatcatactcaaaccgctggcccatggcacctcgggaaactggaaatggattttgacctatgtgagggaacaactgtggttgtgaccgaagattgcggcaatagggggccctctctgcgcacaacgaccgcctccggaaagctcatcactgagtggtgctgtcggtcatgcacactgccgcctcttagatacaggggcgaggacggttgttggtacgggatggaaattcgcccattgaaagagaaggaagagaacctggtcaatagtttagtgaccgcgggacatggccagatagataacttcagcctcggtgttctgggcatggccctttttctggaagagatgttgcgaactcggatcgggacaaagcacgctattctcctggtggcagtatcgttcgtcaccctaatcacgggaaatatgtcctttcgtgacctgggcagagtgatggtgatggtcggggccactatgaccgatgacattggaatgggcgttacatatctcgctctgcttgccgcattcaaagtgaggcccacctttgcggccggtttgctgttacgcaagctcacttctaaagagctgatgatggctacaatcgggatagcccttctgagccagtcaaccatccctgaaacaattctagagctcactgatgcactggctttgggaatgatggtactgaagatcgtgcggaacatggaaaaataccaattagccgtcaccattatggcaatcagttgcgtgcccaatgccgttatactccagaacgcttggaaggtgtcctgtacgattctggcggccgtctctgtgagcccacttctgttgacatcctcacagcagaaggcagactggatccctctcgctctgaccatcaaaggcctaaatcccactgccattttcctgaccacacttagcagaacaagtaagaaaaggtcttggccactcaacgaggccataatggctgttggcatggtgtccatcctggcaagctcgttgctgaagaatgacattccgatgaccgggcctttagtcgccggaggtctcctgacggtatgctatgtgcttacaggccgatcagcggatctggaattggagcgcgctgccgacgttaaatgggaggatcaagcagaaatctctgggagttcccccattctcagcatcaccatatctgaggacggaagcatgtccatcaagaacgaagaggaggaacagactctgacaattctaatccggaccggcctgcttgtgatttcaggtgtctttccagtgagtatccccataactgccgctgcatggtacctctgggaggtcaagaagcagagagccggggtgctgtgggatgtccctagcccaccccctgttgaaaaggcggagttggaagacggagcttataggattaaacagcgtggcatcttaggctactctcaaatcggggccggagtgtataaggagggtacattccacaccatgtggcatgtgacgcgcggcgcagtcctgatgcaccgggggaaaagaattgagccgtcctgggccgatgtgaagaaagacctcatctcatacggaggcggttggaagctggaaggggagtggaaggaaggagaggaagttcaggtacttgctctggagccaggcaaaaatcccagggccgtgcagactaagcctggcatatttaaaaccaacacagggaccattggagcagtcagtttggatttcagcccaggtacatccggctctcccatcgtggaccgaaaggggaaagttgtgggactatacggcaatggtgtcgtgactcggtcgggggcttatgtaagcgccattgcgcagaccgagaagtcaatcgaagataaccctgagatagaagacgatatttttcgcaagaaaagactgacgatcatggacctccatccgggagccggcaagacaaaaaggtacctgcccgcaatcgtccgggaggctattaagcgaggccttagaactttaatcctggccccaacccgcgtggttgctgcagaaatggaggaggccctcagggggttgcctattcgttatcaaacaaccgccataaaaactgaacacaccggacgggagatcgtggacctgatgtgtcatgctacattcacgatgagactcctgtcccccgtcagggtgccaaactacaatcttattatcatggatgaagcgcacttcactgaccctgcaagtatcgccgctcgcggttatatttctacccgagttgagatgggcgaggccgcagggatatttatgacagccacacccccaggaagcagagatccgttccctcagtccaacgctcccatcatggacgaagaacgggaaattccagagaggtcatggaactctggccacgaatgggtgactgattttaagggtaagacagtctggttcgtgcccagcatcaaagcggggaacgacattgccgcatgcctgcgcaagaatggcaagaaggtaatccagttgagtcgtaaaacctttgattccgagtacgtgaagacgagagctaacgactgggatttcgttgtcactacagacataagcgagatgggcgccaattttaaggcagaacgggtgatcgatcctaggcgctgtatgaaaccagtgattctaaccgacggcgaggaacgagtcatcctggccgggcccatgcctgtaacccattcttcagctgcccaaagacggggaaggattggtcgcaacccgaagaatgagaacgaccagtatatctacatgggcgaaccactcgagaatgatgaggactgcgcgcactggaaagaagcaaagatgttactggataacataaatactcccgaggggattatcccttccatgttcgaacccgagagagaaaaagtggacgccattgatggagagtacaggcttcggggcgaggctcgtaagacatttgttgacctgatgcgccgaggtgatctcccagtgtggttggcctataaagtcgctgcagaagggatcaactacgccgacagaaagtggtgtttcgatggcataaagaataaccagatcctggaggaaaacatggaggtggagatttggaccaaagaaggagagaggaagaaactcaagcctcggtggctggacgctcgcatctatagtgatccccttgccctaaaagaatttaaggagttcgcagcgggcagaaagagcctgacattgaatttaattactgaaatggggaggctgccaacgttcatgacccagaaagcccggaacgctctcgacaatctggccgttcttcatacagcagaggctggaggtcgagcctacaaccacgcactgtcggagctccctgaaactttggagaccctgctactgctcacacttctggccaccgtgactggcgggatctttttattcttgatgtctggaaagggcataggtaaaatgacgctggggatgtgctgcattatcaccgcttccatcctcctgtggtatgcgcaaattcagccgcactggatcgccgcaagcataattcttgaatttttcctgatcgtcctcttgattcccgagccagaaaagcagagaacacctcaggataatcaactgacttacgtggtaatcgctatattaaccgtggttgccgccacaatggcaaacgagatgggctttctagagaaaaccaagaaggacctgggactcggctcaatcactacacaggaaagtgagtctaatattcttgacatcgatctgcgccccgcttccgcctggacgttgtatgcggtcgctaccactttcgtgacaccaatgctgaggcatagcattgaaaactcaagtgtgaatgtcagcctcaccgccatcgcaaaccaggccaccgttctgatggggcttggaaaaggttggcctctctccaagatggacattggcgtgcccctgttggctatcgggtgttactctcaggtaaatccgataacactgactgcagccttactactgctcgtggcgcactacgctattatcggaccaggccttcaagccaaagcaacgcgggaggcccagaagcgtgctgccgcaggtatcatgaaaaaccctaccgtcgatgggattacagtgatagacctggaacccatcccatatgatcccaagtttgagaagcagttgggccaggttatgctgctcattctgtgcgtgactcaagtccttatgatgagaaccacatgggctttatgtgaggccctgaccctcgcgactggacctatcagcacgttgtgggaaggcaatccggggaggttctggaacacaaccattgccgtatccatggcaaatatctttcgcggatcatacctggctggcgccggtctactgttctctataatgaaaaacactaccaatacacggcgagggactggaaacatcggcgagaccctcggtgaaaagtggaaaagtagacttaacgcactgggcaagtcggagtttcagatttataaaaagagcgggatccaggaggtggacaggacattggctaaagaaggaattaagcgcggcgagacggatcatcacgccgtttcccgggggtctgccaagctgagatggttcgtggaacgtaatatggtcacccccgagggaaaagtggtcgacctcggctgcggtagagggggatggtcatactattgtggcggtctgaagaacgtgcgggaagttaaaggcttaactaaagggggaccaggccatgaggagcctatccccatgagcacatacgggtggaatcttgtgcgcctgcaatccggagtagatgtgtttttcacccctccagaaaaatgcgacactctcctatgtgatataggcgagagttctcccaaccctacaattgaagcgggtcgaaccctgagagtcttgaatctggttgagaactggctcaataacaatacgcagttctgcatcaaggtgcttaacccatatatgcccagcgtcatcgaaaagatggaggctctgcagaggaaatacgggggagcattggtgcggaatccgctgtcacgcaactccacccacgagatgtactgggtaagtaatgccacaggcaacattgtgagctctgttaatatgatatccagaatgctcatcaacaggtttactatgaagcacaaaaaggctacctatgaacctgacgtggatttaggctcagggacacgaaacattggaatcgagagcgaaattccaaatctggacatcataggtaaacggatcgagaagattaagcaggaacatgagacttcgtggcactacgaccaagatcatccctataaaacctgggcctaccacggctcttatgagacaaagcagaccgggagtgcatccagcatggtcaacggagtggtccgtcttctgactaaaccttgggacgtggttccaatggtaacgcagatggccatgacagataccactcccttcggccagcaaagagtgtttaaggaaaaagtcgacacccgcacacaggagccgaaggaaggtacgaagaaactaatgaagatcaccgctgagtggctctggaaagagctggggaagaaaaagactcctaggatgtgtacacgggaagagttcaccagaaaagtgcgctcaaatgcggccttgggagcaatttttactgatgaaaacaagtggaagtccgctagggaggccgttgaagacggccgattctgggagctggtggatcgggagagaaatctccaccttgaaggcaaatgcgagacatgtgtctacaacatgatggggaagagggagaaaaagctgggagagtttggtaaagcaaagggctctcgcgccatctggtatatgtggttaggggctcgtttcctggaatttgaggccttgggattcctcaatgaggaccattggtttagccggggcaacagtctgtccggtgtggaaggggagggactacacagacttggctacattctgagggatgtaggcaagaaagaagggggagcgatgtacgcagacgataccgccggttgggacacacgcataactctcgaggacctgaagaatgaagagatggtgaccaaccatatgaaaggcgagcacaagaaattggctgaagccatcttcaagctgacgtatcagaataaggttgtccgagtgcagcggcccaccccaagagggacagtgatggatattatcagcaggcgcgaccaaagaggatctggccaggtcggtacttacgggctcaacacctttacaaatatggaggcacagcttatccggcaaatggaaggagagggcattttcaaatcaatacagcatctgactgctaccgaggaaatcgccgttcagaactggttagctagggtgggccgtgagcgactgagtcgcatggccatttccggggatgactgcgtagtgaagcctatcgatgacagattcgcaagcgcgttgacggccctcaatgatatgggaaaagtccggaaggacattcagcaatgggaaccctctaggggttggaacgattggacacaggtgccattttgctcgcaccacttccatgagctggttatgaaagacggccgcgtgctagtcgtgccctgtagaaaccaggatgaacttatcgggcgggctaggatatcacagggagccggctggagcctgaaggagaccgcatgcctcggtaagtcctatgctcaaatgtggactctgatgtactttcaccgacgtgacttgagattagccgcaaatgccatctgtagtgcggtaccttctcattgggttccaacaagccgcaccacttggtccattcacgctaaacacgagtggatgaccacagaagatatgctggccgtgtggaaccgggtctggatccaggagaatccgtggatggaagacaagacgcccgtggagtcatgggaagaggtgccttatctcgggaaaagggaggaccagtggtgcggaagtcttattggcctgacctctagagcaacttgggccaagaacatccagacagctataaatcaagtccgcagcctaattggcaacgaagagtacaccgattatatgccatccatgaaacggttcaggcgagaagaggaagaggccggggttctgtggtga

SEQ ID NO: 14560 - RNA, 9876 nt, synthetic construct
  misc_feature 1..9876: note = derived and/or modified CDS sequence (opt3) from DENV-2__EU482603__SS-prME
  source 1..9876: mol_type = other RNA
accgcaggcgtgatagtcatgctgattcccactgctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgctgagggtatttgtggcatcaggtccgtgactcggctcgaaaatctgatgtggaaacagattacccccgagttaaaccacatcctgtctgagaatgaagtgaagctaacaataatgacgggggacatcaaaggaattatgcaggccggcaagcgctcgctcagacctcaaccaaccgagctgaaatatagctggaagacttgggggaaggcaaaaatgctttccacagaatcacataaccagaccttcttgatcgatggaccggagacagcggaatgccccaatactaacagggcttggaatagtctggaggtcgaggactacggctttggtgttttcaccacgaacatttggctcaagctgcgtgaaaaacaggacgtgttttgtgattctaagttaatgagcgccgcaatcaaagacaatcgggccgtgcacgctgatatggggtattggatagagtccgccctgaacgacacatggaagatggaaaaggcatcattcattgaggtaaaaagctgccactggcctaagtctcataccctttggtccaatggagtcttggagagtgaaatgatcatccccaagaacttcgctggccccgtgagccagcacaactaccgacctggttatcatactcaaaccgccggcccatggcacctcgggaagctggagatggattttgacctatgtgaaggaacaactgttgtggtcaccgaggattgcggcaatagagggccctctctgaggacaacgaccgcgtccggaaaactcattactgaatggtgctgtcgctcatgcacactgccgcctcttcggtacagaggcgaggacggttgttggtacgggatggagatcaggccattgaaggaaaaggaggaaaacctggtgaatagtttagttaccgccggacatggccagattgataacttcagcctcggtgtgctgggcatggctctttttctggaggaaatgttgcgcactcgaatagggacaaaacacgcaatcctcctggtagccgtctcgttcgtgaccctaattacgggaaatatgtcctttcgggacctgggccgtgtgatggtcatggttggggctactatgaccgatgacatcggaatgggcgtgacatatctcgccctgcttgcagcgttcaaggtaagacccacctttgccgctggtttgctgttaaggaaactcacttctaaggagctgatgatggccacaattgggatcgcacttctgagccagtcaaccatacctgagacaatcctagaactcactgatgctctggccttgggaatgatggtgctgaaaattgtccgcgacatggagaagtaccaattagcagtgaccatcatggccattagttgcgttcccaacgctgtgatcctccagaatgcgtggaaggtctcctgtacgatactggccgcagtgtctgttagcccacttctgttgacatcctcacagcagaaagctgactggattcctctcgccctgaccatcaagggcctaaaccccactgccatcttcctgaccacacttagccggacaagtaaaaagagatcttggccactcaatgaagctattatggcagtgggcatggtctccatactggccagctcgttgctgaaaaacgatatcccgatgaccgggcctttagtagcgggaggtctcctgacggtgtgctatgttcttacaggcaggtcagctgacctggagttggaacgagccgcagatgtgaagtgggaggaccaagccgagatttctgggagttcccccatcctcagcattaccatctctgaagatggaagcatgtccatcaaaaatgaggaagaggagcagactctgacaatcctaattcgcaccggcctgcttgtcatctcaggtgtgtttccagtaagtattcccatcactgctgcagcctggtacctctgggaagtgaagaagcagcgggcgggggtcctgtgggacgttcctagcccaccccctgtggagaaagctgaattggaggatggagcctatagaataaagcagaggggcattttaggctactctcaaatcggggcaggagtgtataaagaaggtacattccacaccatgtggcatgtcacgcgtggcgccgtgctgatgcaccgcgggaagcggatcgagccgtcctgggctgacgttaaaaaggatctcatttcatacggaggcggttggaagctggagggggaatggaaagagggagaagaggtacaggtgcttgccctggaaccaggcaagaaccccagagcagtccagactaaacctggcatctttaagaccaatacagggaccataggagctgtgagtttggacttcagcccaggtacatccggctctcccattgttgataggaaagggaaggtggtcggactatacggcaacggtgtggtaactcgatcgggggcctatgtcagcgcgatcgcccagaccgagaagtcaattgaggacaatcctgaaatcgaggatgacatatttcggaaaaagcgcctgacgattatggacctccatccgggagcaggcaaaacaaagagatacctgcccgctatcgtgagggaagccatcaaacggggccttcgaactttaattctggctccaaccagagttgtggcagccgagatggaagaggccctccgcgggttgcctatcaggtatcaaacacccgctattaagaccgagcacactggacgtgaaatagtcgatctgatgtgtcatgcgaccttcacaatgcggctcctgtccccagtgagagttcctaactacaaccttatcattatggacgaggcacacttcacggatcccgccagtatcgctgccaggggttatatctctactcgcgtggaaatgggcgaggcagccgggatttttatgaccgctacaccaccgggaagccgagaccctttcccccagtccaatgcgccaataatggatgaggaaagagagatccccgaacggtcatggaactctggccacgagtgggtcaccgactttaagggtaaaactgtgtggttcgtacctagcattaaggccgggaatgatatcgcagcttgcctgaggaaaaacggaaagaaagtgattcagttgagtcgcaagacatttgactccgaatacgttaagacccgtgccaatgattgggacttcgtcgtgacgactgatatcagcgagatgggcgcaaactttaaagccgagagagtgatagacccacggaggtgtatgaagcccgtcatcctaacagacggcgaagaacgcgtaattctggctgggcctatgccggtgacccattcttcagccgcgcaacgaagaggacggatcggtaggaatcccaaaaacgaaaatgatcagtatatttacatgggcgagcccctcgaaaacgacgaggattgcgcacactggaaggaggccaaaatgttactggacaatatcaacacccctgaagggataattccctccatgttcgagccagaacgcgagaaggttgatgctatcgacggagaatacagacttaggggcgaggcccggaaaacttttgtggatctgatgcgtcgcggtgacctccctgtctggttggcttataaggtggcagccgaggggattaattacgctgatcgaaagtggtgtttcgacggcatcaaaaacaatcagatactggaagagaacatggaagttgagatctggacaaaggagggagaaaggaaaaagctcaaacccagatggctggatgcccggatttatagtgacccacttgcactaaaggagtttaaggagttcgcggccggccgcaaaagcctgaccttgaacttaatcacagagatggggagactgcctactttcatgacgcagaaggctaggaatgccctcgataacctggcagtgcttcataccgctgaagccggaggtcgggcatacaatcacgccctgtcggagctcccggagacattggaaactctgctactgctcacccttctggctacagtcaccggcgggatatttttattcttgatgtctggaaaaggcatcggtaagatgactctggggatgtgctgcataattacggcgtccatcctcctgtggtatgcccaaatccagccccactggattgcagctagcatcatacttgagtttttcctgattgtgctcttgatcccagaacctgagaaacagcgaaccccacaggacaaccaactgacatacgtagtgattgccatcttaactgttgtcgccgcaaccatggctaatgaaatgggctttctagagaagacaaagaaagacctgggactcggctcaataaccactcaggagagtgaatctaacatccttgatattgacctgagaccagcctccgcgtggacattgtatgctgtggccacgaccttcgtgactcctatgctgcgccatagcatcgaaaattcaagtgtcaacgttagcctcacagcaattgccaatcaggctaccgtgctgatggggcttggaaagggttggcccctctccaaaatggatatcggcgtaccgctgttggcaattgggtgttactctcaggtgaacccaatcaccctgacagccgcgttactactgctcgtcgctcactacgccataattggacctggccttcaagcaaaggccactagggaagctcagaaacgggccgcagctggtatcatgaagaatcccacggtggacgggatcaccgttattgatctggagccaataccctatgaccctaagtttgaaaaacagttgggccaggtgatgctgctcatcctgtgcgtcacacaagtacttatgatgcgtactacctgggccttatgtgaggcgctgacactcgccaccggaccgattagcactttgtgggagggcaaccccgggagattctggaatacgacaatcgcagtgtccatggctaacatttttaggggatcatacctggccggcgcaggtctactgttctctatcatgaagaataccacaagtacccgccgggggacaggaaacataggcgaaactctcggtgagaaatggaagtcgcgacttaatgctctgggcaaaagcgaatttcagatctataagaaatccgggattcaggaggttgatagaaccttggccaaggagggaatcaagaggggcgaaacagaccatcacgccgtgtctcgcgggtcagcgaaactgcggtggttcgtcgagagaaacatggtgacgccagaaggaaaggtcgtggatctcggctgcggtcgtgggggatggagctactattgtggcggtctgaaaaacgttagggaggtgaagggcttaaccaaagggggacctggccatgaggaaccaattcctatgtccacttacgggtggaatcttgtacggctgcaaagtggagtggacgtctttttcacaccacccgagaagtgcgataccctcctatgtgacatcggcgaatctagccctaacccaactatagaggctggtcgcacactgcgagttttgaatctggtggaaaactggctcaataacaatacccagttctgcattaaggtccttaacccctatatgccgtcagtgatcgagaaaatggaagcactgcagagaaagtacgggggagccttggtaaggaatcctctgtcccggaacagtacgcacgagatgtactgggtgagcaatgctaccggcaacatcgtttcttccgtgaatatgatttcacgcatgctcataaacagatttacaatgaaacacaagaaaactacctatgagccagatgtcgacttaggcagcgggacaaggaatatcggaattgaatcggagatccccaacctggacattatcggtaagcgaatagaaaagatcaaacaggagcatgaaacttcttggcactacgatcaagaccatccttataagacctgggcctaccacggcagttatgagacaaaacagaccgggtccgcaagctcaatggtgaacggagtcgtgcggcttctgactaagccatgggatgttgtacccatggtgacgcagatggccatgacagacaccactccgttcggccagcaacgtgtctttaaagagaaggtggataccagaacacaggaacctaaggagggtacgaaaaagctaatgaaaattaccgctgaatggctctggaaggagctggggaaaaagaaaactccccgcatgtgtacaagggaggagttcacccggaaggttagatccaatgcggccttgggagcaatctttactgacgagaacaagtggaaatctgctcgcgaagccgtggaggatggcaggttctgggaactggtcgaccgagagcggaatctccaccttgagggcaagtgcgaaacatgtgtgtacaacatgatggggaaaagagagaagaaactgggagaatttggtaaggcaaagggcagcagggccatttggtatatgtggttaggggctcgcttcctggagtttgaagccttgggattcctcaatgaggatcattggtttagtcgtggcaactccctgagcggtgtagagggggaaggactacaccggcttggctacatcctgagagacgtgtctaaaaaggagggcggggcgatgtacgcagatgacaccgccggatgggacacaaggattactctcgaagatctgaaaaatgaggaaatggttaccaaccatatgaagggtgagcacaaaaagttggctgaggccatattcaagctgacgtatcagaataaagtcgtgcgcgtgcagcgaccaacccctcggggcacagtcatggacatcatttcaagaagggatcaacgcgggagtggacaggttggcacttacggtctcaacacctttacaaatatggaagcacagcttatcagacaaatggagggggaaggaatcttcaagtccattcagcatctgactgctaccgaggagatagtggtacagaactggttagcccgggtgggcagggaacgtctgagccgaatggctatctctggcgacgattgcgtcgtgaaacccattgacgatcgcttcgcctcggcattgacggcgctcaatgacatggggaaggttagaaaagatatccagcaatgggagccatcacggggatggaacgactggacacaggtgcccttttgcagccaccacttccatgaactggtcatgaaggatggtagggtgctagtagttccttgtcgcaatcaggacgagcttattggcagagcccggatctcccagggggctggatggagtctgaaggaaaccgcctgcctcggcaaatcttatgcacaaatgtggactctgatgtactttcacaggcgagatttgcgtttagctgccaacgcaatatgtagcgccgtgccatcccattgggtcccgacatcaagaaccacttggagtatccacgcgaagcacgagtggatgaccacagaggacatgctggctgtgtggaaccgcgtgtggattcaggaaaatccctggatggaggacaaaacgcctgtcgaatcttgggaggaagttccatatctcggtaagcgggaggatcagtggtgcgggagccttatcggactgacctccagggccacttgggccaaaaacattcagacagccatcaatcaagtgagatcactaataggcaacgaggaatacaccgactatatgcccagcatgaagcgcttccggagggaggaagaggaagctggcgtactgtggtga

SEQ ID NO: 14561 - RNA, 9876 nt, synthetic construct
  misc_feature 1..9876: note = derived and/or modified CDS sequence (opt3) from DENV-2__EU482599__SS-prME
  source 1..9876: mol_type = other RNA
accgccggagtgatcgtcatgctgattcccacagctatggcattccacctcactacgagaaatggggagcctcatatgatagttggaaggcaggaaaagggtaaaagccttctgtttaagaccgaggacggcgtgaatatgtgcaccttgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggttgacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatccgcggaattatgcaggctggcaaaagatcgctcaggcctcaaccaaccgaactgaagtatagctggaaaacttgggggaaggccaagatgctttccacagagtcacataaccagaccttcttgatcgatggaccggaaacagcagagtgccccaatactaaccgtgcgtggaatagtctggaggtcgaagactacggctttggtgttttcaccacgaacatttggctcaaactgcgggagaagcaggacgtgttttgtgattctaaattaatgagcgctgccatcaaggacaatcgagcagtgcacgccgatatggggtattggatagaatccgctctgaacgacacatggaaaatggagaaggcctcattcattgaggtaaagagctgccactggcctaaatctcataccctttggtccaatggagtcttggaaagtgagatgatcatcccaaagaacttcgcaggccccgtgagccagcacaactacagacctggttatcatactcaaaccgctggcccatggcacctcgggaaactggaaatggattttgacctatgtgagggaacaactgttgtggtcaccgaagattgcggcaatagggggccctctctgcgcacaacgaccgcctccggaaagctcattactgagtggtgctgtcggtcatgcacactgccgcctcttagatacaggggcgaggacggttgttggtacgggatggaaatccgcccattgaaagagaaggaagagaacctggtgaatagtttagttaccgcgggacatggccagattgataacttcagcctcggtgtgctgggcatggccctttttctggaagagatgttgcgaactcggatagggacaaagcacgctatcctcctggtagcagtctcgttcgtgaccctaattacgggaaatatgtcctttcgtgacctgggcagagtgatggtcatggttggggccactatgaccgatgacatcggaatgggcgtgacatatctcgctctgcttgccgcattcaaagtaaggcccacctttgcggccggtttgctgttacgcaagctcacttctaaagagctgatgatggctacaattgggatcgcccttctgagccagtcaaccatacctgaaacaatcctagagctcactgatgcactggctttgggaatgatggtgctgaagattgtccggaacatggaaaaataccaattagccgtgaccatcatggttattagttgcgtgcccaatgcagtcatcctccagaacgcctggaaggtgtcctgtacgatactggctgcggtttctgtgagcccacttctgttgacatcctcacagcagaaggccgactggattcctctcgcactgaccatcaaaggcctaaatcccactgctatcttcctgaccacacttagcagaacaagtaagaaaaggtcttggccactcaacgaggccattatggccgtcggcatggtatccatactggctagctcgttgctgaagaatgacatcccgatgaccgggcctttagtggcaggaggtctcctgacggtttgctatgtgcttacaggccgatcagccgatctggaattggagcgcgcggctgacgtcaaatgggaggatcaagccgaaatttctgggagttcccccatcctcagcattaccatctctgaggacggaagcatgtccataaagaacgaagaggaggaacagactctgacaatcctaattcggaccggcctgcttgtgatctcaggtgtatttccagtgagtattcccatcactgcagccgcttggtacctctgggaggtcaaaaagcagagagcaggggttctgtgggatgtgcctagcccaccccctgtggaaaaggccgagttggaagacggagcgtataggataaaacagcgtggcattttaggctactctcaaatcggggctggagtctataaggagggtacattccacaccatgtggcatgtgacgcgcggcgccgttctgatgcaccgggggaaaagaatcgagccgtcctgggcagatgtaaagaaagacctcatttcatacggaggcggttggaagctggaaggggagtggaaggaaggagaggaagtgcaggtccttgccctggagccaggcaaaaatcccagggctgtgcagactaagcctggcatctttaaaaccaacacagggaccataggagccgttagtttggatttcagcccaggtacatccggctctcccattgtggaccgaaaggggaaagtcgtgggactatacggcaatggtgtagtcactcggtcgggggcatatgtgagcgctatcgcccagaccgagaagtcaattgaagataaccctgagatcgaagacgatatatttcgcaagaaaagactgacgattatggacctccatccgggagcgggcaagacaaaaaggtacctgcccgccatcgttcgggaggcaatcaagcgaggccttagaactttaattctggctccaacccgcgtggtcgccgctgaaatggaggaggcactcagggggttgcctatccgttatcaaacaaccgccattaaaactgaacacaccggacgggagatagtggacctgatgtgtcatgccacattcacgatgagactcctgtcccccgttagggtgccaaactacaatcttatcattatggatgaagctcacttcactgaccctgcgagtatcgcagcccgcggttatatctctacccgagtcgagatgggcgaggctgccgggatttttatgacagcaacacccccaggaagcagagatccgttccctcagtccaacgcccccataatggacgaagaacgggaaatcccagagaggtcatggaactctggccacgaatgggtgactgattttaagggtaagacagtatggttcgtgcccagcattaaagctgggaacgacatcgcggcctgcctgcgcaagaatggcaagaaggttattcagttgagtcgtaaaacctttgattccgagtacgtcaagacgagagcaaacgactgggatttcgtggtgactacagacatcagcgagatgggcgctaattttaaggccgaacgggtcatagatcctaggcgctgtatgaaaccagtaatcctaaccgacggcgaggaacgagtgattctggcagggcccatgcctgttacccattcttcagccgctcaaagacggggaaggatcggtcgcaacccgaagaatgagaacgaccagtatatttacatgggcgaaccactcgagaatgatgaggactgcgcccactggaaagaagcgaagatgttactggataacatcaatactcccgaggggataattccttccatgttcgaacccgagagagaaaaagtggacgcaatcgatggagagtacaggcttcggggcgaggcccgtaagacatttgtcgacctgatgcgccgaggtgatctcccagtgtggttggcttataaagttgccgctgaagggattaactacgcagacagaaagtggtgtttcgatggcatcaagaataaccagatactggaggaaaacatggaggtggagatctggaccaaagaaggagagaggaagaaactcaagcctcggtggctggacgcccgcatttatagtgatccccttgctctaaaagaatttaaggagttcgccgcaggcagaaagagcctgacattgaatttaatcactgaaatggggaggctgccaacgttcatgacccagaaagcgcggaacgccctcgacaatctggctgtccttcatacagccgaggcaggaggtcgagcttacaaccacgccctgtcggagctccctgaaactttggagaccctgctactgctcacacttctggcaaccgtgactggcgggatatttttattcttgatgtctggaaagggcatcggtaaaatgacgctggggatgtgctgcataattaccgcctccatcctcctgtggtatgctcaaatccagccgcactggattgcggccagcatcatacttgaatttttcctgattgtactcttgatccccgagccagaaaagcagagaacacctcaggataatcaactgacttacgtggttattgcaatcttaaccgtcgtggctgccacaatggccaacgagatgggctttctagagaaaaccaagaaggacctgggactcggctcaataactacacaggaaagtgagtctaatatccttgacattgatctgcgccccgcatccgcttggacgttgtatgccgtggcgaccactttcgtcacaccaatgctgaggcatagcatcgaaaactcaagtgttaatgtgagcctcaccgctattgccaaccaggcaaccgtactgatggggcttggaaaaggttggcctctctccaagatggacatcggcgtgcccctgttggccattgggtgttactctcaggtcaatccgatcacactgactgctgcattactactgctcgtggcccactacgcgataattggaccaggccttcaagctaaagccacgcgggaggcacagaagcgtgccgctgccggtatcatgaaaaaccctaccgttgatgggatcacagtgattgacctggaacccataccatatgatcccaagtttgagaagcagttgggccaggtcatgctgctcatcctgtgcgtaactcaagtgcttatgatgagaaccacatgggcattatgtgaggctctgaccctcgccactggacctattagcacgttgtgggaaggcaatccggggaggttctggaacacaaccatcgcggtttccatggccaatatttttcgcggatcatacctggcaggcgctggtctactgttctctatcatgaaaaacactaccaatacacggcgagggactggaaacataggcgagaccctcggtgaaaagtggaaaagtagacttaacgccctgggcaagtcggagtttcagatctataaaaagagcgggattcaggaggtggacaggacattggcaaaagaaggaatcaagcgcggcgagacggatcatcacgctgtctcccgggggtctgccaagctgagatggttcgtggaacgtaatatggtcacccccgagggaaaagtggttgacctcggctgcggtagagggggatggtcatactattgtggcggtctgaagaacgtgcgggaagtaaaaggcttaactaaagggggaccaggccatgaggagcctattcccatgagcacatacgggtggaatcttgtgcgcctgcaatccggagtcgatgtatttttcacccctccagaaaaatgcgacactctcctatgtgatatcggcgagagttctcccaaccctacaatagaagccggtcgaaccctgagagtgttgaatctggtcgagaactggctcaataacaatacgcagttctgcattaaggtgcttaacccatatatgcccagcgtaatcgaaaagatggaggcgctgcagaggaaatacgggggagctttggtgcggaatccgctgtcacgcaactccacccacgagatgtactgggttagtaatgcaacaggcaacatcgtgagctctgtcaatatgatttccagaatgctcataaacaggtttactatgaagcacaaaaaggccacctatgaacctgacgtggatttaggctcagggacacgaaacatcggaattgagagcgaaatcccaaatctggacattatcggtaaacggatagagaagatcaagcaggaacatgagacttcgtggcactacgaccaagatcatccctataaaacctgggcttaccacggctcttatgagacaaagcagaccgggagtgcctccagcatggtcaacggagtggttcgtcttctgactaaaccttgggacgtagtgccaatggtcacgcagatggcaatgacagataccactcccttcggccagcaaagagtgtttaaggaaaaagttgacacccgcacacaggagccgaaggaaggtacgaagaaactaatgaagattaccgccgagtggctctggaaagagctggggaagaaaaagactcctaggatgtgtacacgggaagagttcaccagaaaagtgcgctcaaatgctgcgttgggagccatctttactgatgaaaacaagtggaagtccgcaagggaggctgtcgaagacggccgattctgggagctggtggatcgggagagaaatctccaccttgaaggcaaatgcgagacatgtgtatacaacatgatggggaagagggagaagaagctgggagagtttggtaaagccaagggctctcgcgcaatttggtatatgtggttaggggcccgtttcctggaatttgaggctttgggattcctcaatgaggaccattggtttagccggggcaacagtctgtccggtgtggaaggggagggactacacagacttggctacatcctgagggatgttggcaagaaagaagggggagccatgtacgcggacgataccgcaggttgggacacacgcattactctcgaggacctgaagaatgaagagatggtcaccaaccatatgaaaggcgagcacaagaaattggccgaagctatattcaagctgacgtatcagaataaggtggtgcgagtccagcggcccaccccaagagggacagttatggatatcattagcaggcgcgaccaaagaggatctggccaggtgggtacttacgggctcaacacctttacaaatatggaggcccagcttatccggcaaatggaaggagagggcatcttcaaatcaattcagcatctgactgcaaccgaggaaatagctgtacagaactggttagccagggtgggccgtgagcgactgagtcgcatggctatctccggggatgactgcgtcgtgaagcctattgatgacagattcgccagcgcattgacggcgctcaatgatatgggaaaagttcggaaggacatccagcaatgggaaccctctaggggttggaacgattggacacaggtgccattttgctcgcaccacttccatgagctggtcatgaaagacggccgcgtgctagtagttccctgtagaaaccaggatgaacttattgggcgggccaggatctcacagggagctggctggagcctgaaggagaccgcctgcctcggtaagtcctatgcacaaatgtggactctgatgtactttcaccgacgtgacttgagattagctgccaatgcaatatgtagtgccgtgccttctcattgggtcccaacaagccgcaccacttggtccatccacgcgaaacacgagtggatgaccacagaagatatgctggctgtgtggaaccgggtgtggattcaggagaatccgtggatggaagacaagacgcccgtcgagtcatgggaagaggttccttatctcgggaaaagggaggaccagtggtgcggaagtcttatcggcctgacctctagagccacttgggcaaagaacattcagacagccatcaatcaagtgcgcagcctaataggcaacgaagagtacaccgattatatgccatccatgaaacggttcaggcgagaagaggaagaggctggggtactgtggtga

SEQ ID NO: 14562 - RNA, 9876 nt, synthetic construct
  misc_feature 1..9876: note = derived and/or modified CDS sequence (opt3) from DENV-2__FJ898436__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctacaagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatccgcggaattatgcaggctggcaaaagatcgctcaggcctcaaccaaccgaactgaagtatagctggaaaacttgggggaaggccaagatgctttccacagagtcacataaccagaccttcttgatcgatggaccggaaacagcagagtgccccaatactaaccgtgcgtggaatagtctggaggtcgaagactacggctttggtgttttcaccacgaacatttggctcaaactgcgggagaagcaggacgtgttttgtgattctaaattaatgagcgctgccatcaaggacaatcgagcagtgcacgccgatatggggtattggatagaatccgctctgaacgacacatggaaaatggagaaggcctcattcattgaggtaaagagctgccactggcctaaatctcataccctttggtccaatggagtcttggaaagtgagatgatcatcccaaagaacttcgcaggccccgtgagccagcacaactacagacctggttatcatactcaaaccgctggcccatggcacctcgggaaactggaaatggattttgacctatgtgagggaacaactgttgtggtcaccgaagattgcggcaatagggggccctctctgcgcacaacgaccgcctccggaaagctcattactgagtggtgctgtcggtcatgcacactgccgcctcttagatacaggggcgaggacggttgttggtacgggatggaaatccgcccattgaaagagaaggaagagaacctggtgaatagtttagttaccgcgggacatggccagattgataacttcagcctcggtgtgctgggcatggccctttttctggaagagatgttgcgaactcggatagggacaaagcacgctatcctcctggtagcagtctcgttcgtgaccctaattacgggaaatatgtcctttcgtgacctgggcagagtgatggtcatggttggggccactatgaccgatgacatcggaatgggcgtgacatatctcgctctgcttgccgcattcaaagtaaggcccacctttgcggccggtttgctgttacgcaagctcacttctaaagagctgatgatggctacaattgggatcgcccttctgagccagtcaaccatacctgaaacaatcctagagctcactgatgcactggctttgggaatgatggtgctgaagattgtccggaacatggaaaaataccaattagccgtgaccatcatggcaattagttgcgttcccaatgccgtgatcctccagaacgcttggaaggtctcctgtacgatactggcggccgtgtctgttagcccacttctgttgacatcctcacagcagaaggcagactggattcctctcgctctgaccatcaaaggcctaaatcccactgccatcttcctgaccacacttagcagaactagtaagaaaaggtcttggccactcaacgaggccattatggctgtgggcatggtctccatactggcaagctcgttgctgaagaatgacatcccgatgaccgggcctttagtagccggaggtctcctgacggtgtgctatgttcttacaggccgatcagcggatctggaattggagcgcgctgccgacgtgaaatgggaggatcaagcagaaatttctgggagttcccccatcctcagcattaccatctctgaggacggaagcatgtccataaagaacgaagaggaggaacagactctgacaatcctaattcggaccggcctgcttgtcatctcaggtgtgtttccagtaagtattcccatcactgccgctgcatggtacctctgggaggtgaaaaagcagagagccggggtcctgtgggatgttcctagcccaccccctgtggaaaaggcggagttggaagacggagcttataggataaaacagcgtggcattttaggctactctcaaatcggggccggagtgtataaggagggtacattccacaccatgtggcatgtcacgcgcggcgcagtgctgatgcaccgggggaaaagaatcgagccgtcctgggccgatgttaagaaagacctcatttcatacggaggcggttggaagctggaaggggagtggaaggaaggagaggaagtacaggtgcttgctctggagccaggcaaaaatcccagggccgtccagactaagcctggcatctttaaaaccaacacagggaccataggagcagtgagtttggatttcagcccaggtacatccggctctcccattgttgaccgaaaggggaaagtggtcggactatacggcaatggtgtggtaactcggtcgggggcttatgtcagcgccatcgcgcagaccgagaagtcaattgaagataaccctgagatcgaagacgatatatttcgcaagaaaagactgacgattatggacctccatccgggagccggcaagacaaaaaggtacctgcccgcaatcgtgcgggaggctatcaagcgaggccttagaactttaattctggccccaacccgcgttgtggctgcagaaatggaggaggccctcagggggttgcctatccgttatcaaacaaccgccattaaaactgaacacaccggacgggagatagtcgacctgatgtgtcatgctacattcacgatgagactcctgtcccccgtgagggttccaaactacaatcttatcattatggatgaagcgcacttcactgaccctgcaagtatcgccgctcgcggttatatctctacccgagtggagatgggcgaggccgcagggatttttatgacagccacccccccaggaagcagagatccgttccctcagtccaacgctcccataatggacgaagagcgggaaatcccagagaggtcatggaattctggccacgaatgggtcactgattttaagggtaagacagtgtggttcgtacccagcattaaagcggggaacgacatcgccgcatgcctgcgcaagaatggaaaaaaggtgattcagttgagtcgtaaaacctttgattccgagtacgttaagacgagagctaacgactgggatttcgtcgtgactacagacatcagcgagatgggcgccaattttaaggcagaacgggtgatagatcctaggcgctgtatgaaaccagtcatcctaaccgacggcgaggaacgagtaattctggccgggcccatgcctgtgacccattcttcagctgcccaaagacggggaaggatcggtcgcaacccgaagaatgagaacgaccagtatatttacatgggcgaaccactcgagaatgatgaggactgcgcgcactggaaagaagcaaagatgttactggataacatcaatactcccgaggggataattccttccatgttcgaacccgagagagaaaaagttgacgccatcgatggagagtacaggcttcggggcgaggctcgtaagacatttgtggacctgatgcgccgaggtgatctcccagtctggttggcctataaagtggctgcagaagggattaactacgccgacagaaagtggtgtttcgatggcatcaagaataaccagatactggaggaaaacatggaggttgagatctggaccaaagaaggagagaggaagaaactcaagcctcggtggctggacgctcgcatttatagtgatccccttgccctaaaagaatttaaggagttcgcagcgggcagaaagagcctgacattgaatttaatcactgaaatggggaggctgccaacgttcatgacccagaaagcccggaacgctctcgacaatctggccgtgcttcatacagcagaggctggaggtcgagcctacaaccacgcactgtcggagctccctgaaactttggagaccctgctactgctcacacttctggccaccgtcactggcgggatttttttattcttgatgtctggaaagggcatcggtaaaatgacgctggggatgtgctgcataattaccgcttccatcctcctgtggtatgcgcaaatccagccgcactggattgccgcaagcatcatacttgaatttttcctgattgtgctcttgatccccgagccagaaaagcagagaacacctcaggataatcaactgacttacgtagtgattgctatcttaaccgttgtcgccgccacaatggcaaacgagatgggctttctagagaaaaccaagaaggacctgggactcggctcaataactacacaggaaagtgagtctaatatccttgacattgatctgcgccccgcttccgcctggacgttgtatgcggtggctaccactttcgtgacaccaatgctgaggcatagcatcgaaaactcaagtgtcaatgttagcctcaccgccattgcaaaccaggccaccgtgctgatggggcttggaaaaggttggcctctctccaagatggacatcggcgtacccctgttggctattgggtgttactctcaggtgaatccgatcacactgactgcagccttactactgctcgtcgcgcactacgctataattggaccaggccttcaagccaaagcaacgcgggaggcccagaagcgtgctgccgcaggtatcatgaaaaaccctaccgtggatgggatcacagttattgacctggaacccataccatatgatcccaagtttgagaagcagttgggccaggtgatgctgctcatcctgtgcgtcactcaagtacttatgatgagaaccacatgggctttatgtgaggccctgaccctcgcgactggacctattagcacgttgtgggaaggcaatccggggaggttctggaacacaaccatcgccgtgtccatggcaaatatttttcgcggatcatacctggctggcgccggtctactgttctctatcatgaaaaacactaccaatacacggcgagggactggaaacataggcgagaccctcggtgaaaagtggaaaagtagacttaacgcactgggcaagtcggagtttcagatctataaaaagagcgggattcaggaggttgacaggacattggctaaagaaggaatcaagcgcggcgagacggatcatcacgccgtgtcccgggggtctgccaagctgagatggttcgtcgaacgtaatatggtgacccccgagggaaaagtcgtggacctcggctgcggtagggggggatggtcatactattgtggcggtctgaagaacgttcgggaagtgaaaggcttaactaaggggggaccaggccatgaggagcctattcccatgagcacatacgggtggaatcttgtacgcctgcaatccggagtggatgtctttttcacccctccagaaaaatgcgacactctcctatgtgatatcggcgagagttctcccaaccctacaatagaagcgggtcgaaccctgagagttttgaatctggtggagaactggctcaataacaatacgcagttctgcattaaggtccttaacccatatatgcccagcgtgatcgaaaagatggaggctctgcagaggaaatacgggggagcattggtacggaatccgctgtcacgcaactccacccacgagatgtactgggtgagtaatgccacaggcaacatcgttagctctgtgaatatgatttccagaatgctcataaacaggtttactatgaagcacaaaaaggctacctatgaacctgacgtcgatttaggctcagggacacgaaacatcggaattgagagcgaaatcccaaatctggacattatcggtaaacggatagagaagatcaagcaggaacatgagacttcgtggcactacgaccaagatcatccctataaaacctgggcctaccacggctcttatgagacaaagcagaccgggagtgcatccagcatggtgaacggagtcgtgcgtcttctgactaaaccttgggacgttgtaccaatggtgacgcagatggccatgacagataccactcccttcggccagcaaagagtctttaaggaaaaagtggacacccgcacacaggagccgaaggaaggtacgaagaaactaatgaagattaccgctgcgtggctctggaaagagctggggaagaaaaagactcctaggatgtgtacacgggaggaattcaccagaaaagttcgctcaaatgccgcattgggagctatctttactgatgagaacaagtggaagtccgccagggaagcagtggaggacggccgattctgggaactggtcgatcgggagagaaatctccaccttgagggcaaatgcgaaacatgtgtgtacaacatgatggggaagagggagaaaaagctgggagaatttggtaaagccaagggctctcgcgctatttggtatatgtggttaggggcccgtttcctggagtttgaagcgttgggattcctcaatgaggaccattggtttagccggggcaacagtctgtccggtgtagagggggaaggactacacagacttggctacatcctgagggatgtgggcaagaaagaggggggagcaatgtacgccgacgataccgctggttgggacacacgcattactctcgaagacctgaagaatgaggaaatggttaccaaccatatgaaaggcgagcacaagaaattggccgaggcaatattcaagctgacgtatcagaataaggtcgtgcgagtgcagcggcccaccccaagagggacagtcatggatatcattagcaggcgcgaccaaagaggatctggccaggttggtacttacgggctcaacacctttacaaatatggaagctcagcttatccggcaaatggagggagaaggcatcttcaaatcaattcagcatctgactgccaccgaggagatagctgtgcagaactggttagccagggtaggccgtgaacgactgagtcgcatggcaatctccggggatgactgcgtggtcaagcctattgatgacagattcgcgagcgccttgacggctctcaatgatatgggaaaagtgcggaaggacatccagcaatgggagccctctaggggttggaacgattggacacaggttccattttgctcgcaccacttccatgaactggtgatgaaagacggccgcgtcctagtggtaccctgtagaaaccaggatgagcttattgggcgggccaggatctcacagggagcaggctggagcctgaaggaaaccgcttgcctcggtaagtcctatgcccaaatgtggactctgatgtactttcaccgacgtgacttgagattagcagccaatgcgatatgtagtgctgttccttctcattgggtgccaacaagccgcaccacttggtccatccacgccaaacacgagtggatgaccacagaggatatgctggcagtctggaaccgggtgtggattcaggaaaatccgtggatggaggacaagacgcccgtggaatcatgggaggaagtcccttatctcgggaaaagggaggaccagtggtgcggaagtcttatcggcctgacctctagagccacttgggctaagaacattcagacagccatcaatcaagttcgcagcctaataggcaacgaggaatacaccgattatatgccatccatgaaacggttcaggcgagaggaagaggaagcaggggtgctgtggtga

SEQ ID NO: 14563 - RNA, 9876 nt, synthetic construct
  misc_feature 1..9876: note = derived and/or modified CDS sequence (opt3) from DENV-2__EU482634__SS-prME
  source 1..9876: mol_type = other RNA
accgccggcgtgatagtcatgctgattcccacagctatggcattccacctcactacgagaaacggggaacctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtgacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctaccagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctggctgaaaatgaggtgaagctaacaataatgacgggggacatcaaaggaattatgcaggccggcaagcgctctctcagacctcaaccaaccgaactgaaatattcgtggaagacttgggggaaggcaaaaatgcttagcacagagtcccataaccagaccttcttgatcgatggaccggaaacagcggagtgccccaatactaacagggcttggaactcactggaggtcgaagactacggctttggtgttttcaccacgaacatttggctcaagctgcgtgagaaacaggacgtgttttgtgatagtaagttaatgtctgccgcaatcaaagacaatcgggccgtgcacgctgatatggggtattggatagaaagcgccctgaacgacacatggaagatggagaaggcatccttcattgaggtaaaatcatgccactggcctaagagccataccctttggtctaatggagtcttggaatccgagatgatcatccccaagaatttcgctggccccgtgagtcagcacaactaccgacctggttatcatactcaaaccgccggcccatggcacctcgggaagctggaaatggattttgacctatgtgagggaacaactgttgtggtcaccgaagattgcggcaatagagggcccagcctgaggacaacgaccgcgtctggaaaactcattactgagtggtgctgtcgctcctgcacactgccgcctcttcggtacagaggcgaggacggttgttggtacgggatggaaatcaggccattgaaggagaaggaagagaacctggtaaattcattagttaccgccggacatggccagattgataacttcagtctcggtgtgctgggcatggctctttttctggaagagatgttgcgcactcgaatagggacaaaacacgcaatcctcctggtagccgtcagcttcgtgaccctaattacgggaaatatgtcgtttcgggacctgggccgtgtgatggtcatggttggggctactatgaccgatgacatcggaatgggcgtgacatatctcgccctgcttgcagcgttcaaggtaagacccacctttgccgctggtttgctgttaaggaaactcacttccaaggagctgatgatggccacaattgggatcgcacttctgtctcagagcaccatacctgaaacaatcctagagctcactgatgctctggccttgggaatgatggtgctgaaaattgtccgcaacatggaaaagtaccaattagcagtgaccatcatggccatttcatgcgttcccaatgctgtgatcctccagaacgcgtggaaggtcagttgtacgatactggccgcagtgtccgtttctccacttctgttgacaagctcccagcagaaagctgactggattcctctcgccctgaccatcaagggcctaaatcccactgccatcttcctgaccacactttcacggactaacaaaaagagaagctggccactcaatgaggctattatggcagtgggcatggtcagtatactggcctcttccttgctgaaaaacgacatcccgatgaccgggcctttagtagcgggaggtctcctgacggtgtgctatgttcttacaggcaggagcgctgatctggaattggagcgagccgcagacgtgaagtgggaggatcaagccgaaatttcggggtcatctcccatcctcagtattaccatctccgaggacggaagcatgtctatcaaaaatgaagaggaggaacagactctgacaatcctaattcgcaccggcctgcttgtcatcagcggtgtgtttccagtatccattcccatcactgctgcagcctggtacctctgggaggtgaagaagcagcgggcgggggtcctgtgggatgttccttcaccaccccctgtggaaaaagctgagttggaagacggagcctatagaataaagcagaggggcattttaggctacagtcaaatcggggcaggagtgtataaagagggtacattccacaccatgtggcatgtcacgcgtggcgccgtgctgatgcaccgcgggaagcggatcgagccgagctgggctgatgttaaaaaggacctcatttcttacggaggcggttggaagctggaaggggagtggaaagaaggagaggaagtacaggtgcttgccctggagccaggcaagaaccccagagcagtccagactaaacctggcatctttaagaccaatacagggaccataggagctgtgtccttggatttctcaccaggtacaagtggcagccccattgttgacaggaaagggaaggtggtcggactatacggcaacggtgtggtaactcgatccggggcctatgtctctgcgatcgcccagaccgagaagtcgattgaagataaccctgagatcgaagacgatatatttcggaaaaagcgcctgacgattatggacctccatccgggagcaggcaaaacaaagagatacctgcccgctatcgtgagggaggccatcaaacggggccttcgaactttaattctggctccaaccagagttgtggcagccgaaatggaggaggccctccgcgggttgcctatcaggtatcaaacacccgctattaagaccgaacacactggacgtgagatagtcgacctgatgtgtcatgcgaccttcacaatgcggctcctgagcccagtgagagttcctaattacaaccttatcattatggatgaagcacacttcacggaccccgcctcaatcgctgccaggggttatatctccactcgcgtggagatgggcgaggcagccgggatttttatgaccgctacaccaccgggaagtcgagatcctttcccccagtctaatgcgccaataatggacgaagagagagaaatccccgagcggagctggaactccggccacgaatgggtcaccgattttaagggtaaaactgtgtggttcgtaccttcaattaaggccgggaatgacatcgcagcttgcctgaggaaaaacggaaagaaagtgattcagttgtctcgcaagacatttgatagcgagtacgttaagacccgtgccaatgactgggatttcgtcgtgacgactgacatcagtgagatgggcgcaaactttaaagccgaaagagtgatagatccacggaggtgtatgaagcccgtcatcctaacagacggcgaggaacgcgtaattctggctgggcctatgccggtgacccattccagcgccgcgcaacgaagaggacggatcggtaggaatcccaaaaacgagaatgaccagtatatttacatgggcgaacccctcgagaacgatgaggactgcgcacactggaaggaagccaaaatgttactggataatatcaacacccctgaggggataattccctctatgttcgaaccagagcgcgaaaaggttgacgctatcgatggagagtacagacttaggggcgaggcccggaaaacttttgtggacctgatgcgtcgcggtgatctccctgtctggttggcttataaggtggcagccgaagggattaattacgctgaccgaaagtggtgtttcgatggcatcaaaaacaaccagatactggaggaaaatatggaggttgagatctggacaaaggaaggagagaggaaaaagctcaaacccagatggctggacgcccggatttattcagatccacttgcactaaaggaatttaaggagttcgcggccggccgcaaatccctgaccttgaacttaatcacagaaatggggagactgcctactttcatgacgcagaaggctaggaatgccctcgacaacctggcagtgcttcataccgctgaggccggaggtcgggcatacaatcacgccctgagtgagctcccggaaacattggagactctgctactgctcacccttctggctacagtcaccggcgggatatttttattcttgatgagcggaaaaggcatcggtaagatgactctggggatgtgctgcataattacggcgtcgatcctcctgtggtatgcccaaatccagccccactggattgcagcttctatcatacttgaatttttcctgattgtgctcttgatcccagagcctgaaaaacagcgaacaccacaggataaccaactgacatacgtagtgattgccatcttaactgttgtcgccgcaaccatggctaatgagatgggctttctagagaagacaaagaaagacctgggactcggctccataaccactcaggaaagcgagtcaaacatccttgacattgatctgagaccagccagtgcgtggacattgtatgctgtggccacgaccttcgtgactcctatgctgcgccattctatcgaaaattccagcgtcaacgtttcactcacagcaattgccaatcaggctaccgtgctgatggggcttggaaagggttggcccctcagtaaaatggacatcggcgtaccgctgttggcaattgggtgttacagccaggtgaacccaatcaccctgacagccgcgttactactgctcgtcgctcactacgccataattggacctggccttcaagcaaaggccactagggaggctcagaaacgggccgcagctggtatcatgaagaatcccacggtggatgggatcaccgttattgacctggaaccaataccctatgatcctaagtttgagaaacagttgggccaggtgatgctgctcatcctgtgcgtcacacaagtacttatgatgcgtactacctgggccttatgtgaggcgctgacactcgccaccggaccgatttccactttgtgggaaggcaaccccgggagattctggaatacgacaatcgcagtgtctatggctaacatttttaggggaagctacctggccggcgcaggtctactgttctccatcatgaagaataccacttcaacccgccgggggacaggaaacataggcgagactctcggtgaaaaatggaagtctcgacttaacgctctgggcaaaagtgagtttcagatctataagaaatcggggattcaggaggttgacagaaccttggccaaggaaggaatcaagaggggcgagacagatcatcacgccgtgagccgcgggtccgcgaaactgcggtggttcgtcgaaagaaatatggtgacgccagagggaaaggtcgtggacctcggctgcggtcgtgggggatggtcttactattgtggcggtctgaaaaacgttagggaagtgaagggcttaaccaaagggggacctggccatgaggagcccattcctatgtcaacttacgggtggaatcttgtacggctgcaaagcggagtggatgtctttttcacaccacccgaaaagtgcgacaccctcctatgtgatatcggcgagtccagtcctaacccaactatagaagctggtcgcacactgcgagttttgaatctggtggagaactggctcaataacaataccaagttctgcattaaagtccttaacccctatatgccgtctgtgatcgaaaagatggaggcactgcagagaaaatacgggggagccttggtaaggaatcctctgagccggaactcaacgcacgagatgtactgggtgtccaatgctaccggcaacatcgttagtagcgtgaatatgatttctcgcatgctcataaacagatttacaatgaagcacaaaaaggccacttatgaaccagacgtcgatttaggctccgggaccaggaacatcggaattgagtcagaaatccccaatctggacattatcggtaagcgaatagagaaaatcaagcaggaacatgagacaagctggcactacgaccaggatcatccttataaaacttgggcataccacggctcgtatgagaccaagcaaacagggtctgccagttccatggtgaacggagtcgtgcggcttctgaccaaaccatgggacgttgtacccatggtgactcagatggctatgacggatacaaccccgttcggccagcagcgtgtctttaaggaaaaggtggacactagaacccaagagcctaaagaaggtacaaagaaactaatgaagattacggcggagtggctctggaaagagctggggaagaaaaagaccccacgcatgtgtactagggaagagttcacacggaaggttagaagcaatgccgcattgggagctatctttaccgatgaaaacaaatggaagtcagcccgcgaggcagtggaagacggcaggttctgggagctggtcgatcgagagcggaatctccaccttgaaggcaaatgcgagacttgtgtgtacaacatgatggggaagagagagaaaaagctgggagagtttggtaaggccaaaggctccagggctatttggtatatgtggttaggggcccgcttcctggaatttgaggcgttgggattcctcaatgaggaccattggttttctcgtggcaacagcctgagtggtgtagaaggggagggactacaccggcttggctacatcctgagagatgtgtccaagaaagaaggcggggcaatgtacgccgacgatacagctggatgggacaccaggattacactcgaggacctgaagaatgaagagatggttactaaccatatgaaaggtgagcacaagaagttggccgaagcaatattcaaactgacctatcagaataaggtcgtgcgcgtgcagcgaccaacgcctcggggcaccgtcatggatatcattagcagaagggaccagcgcgggtctggacaagttggcacatacggtctcaacacttttaccaatatggaggctcagcttatcagacagatggaaggggagggaatcttcaaatcaattcaacatctgacagccactgaggaaatagtggtacagaactggttagctcgggtgggcagggagcgtctgagtcgaatggccatctccggcgatgactgcgtcgtgaagcccattgatgaccgcttcgcaagcgcgttgaccgccctcaatgatatggggaaagttagaaaggacatccagcagtgggaaccatctcggggatggaacgattggacgcaagtgcccttttgctcgcaccacttccatgagctggtcatgaaggacggtagggtgctagtagttccttgtcgcaaccaggatgaacttattggcagagctcggatctcacagggggccggatggagcctgaaagagacagcatgcctcggcaagtcctatgctcagatgtggaccctgatgtactttcacaggcgagacttgcgtttagccgcaaatgccatatgtagtgcggtgccatctcattgggtcccgactagcagaacaacctggtccatccacgctaaacacgagtggatgactaccgaagatatgctggccgtgtggaaccgcgtgtggattcaagagaatccctggatggaagacaagacacctgtcgagtcatgggaagaggttccatatctcggtaaacgggaggaccagtggtgcgggagtcttatcggactgacgtctagggcaacctgggccaagaacattcagactgctatcaatcaggtgagaagcctaataggcaacgaagagtacacagattatatgccctccatgaagcgcttccggagggaagaggaagaggccggcgtactgtggtga

SEQ ID NO: 14564 - RNA, 9876 nt, synthetic construct
  misc_feature 1..9876: note = derived and/or modified CDS sequence (opt3) from DENV-2__EU482635__SS-prME
  source 1..9876: mol_type = other RNA
accgccggagtgatcgtcatgctgattcccactgctatggcattccacctcactacgagaaatggggagcctcatatgatagttggaaggcaggaaaagggtaagagccttctgtttaagaccgaggacggcgtgaatatgtgcactttgatggccatcgatttaggggaactgtgtgaggacactattacctacaaatgcccactactccggcaaaacgaaccggaggatatcgactgttggtgcaattccacatctacctgggtaacttatggaacctgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgtctgaggaacaggacaaacgatttatctgcaagcatagcatggtcgatagaggctggggtaatgggtgtggactattcggcaagggcgggatcgtgacctgcgccatgtttacatgcaaaaagaacatggaaggaaaagtggtccagcctgagaatctcgaatacaccattgttataactccacactccggtgaggagcatgctgtgggcaacgacacggggaagcacggaaaagaaatcaagattacaccgcagtcaagtatcaccgaggccgaactgactggctatggtaccgtaacaatggagtgtagccccaggaccgggcttgatttcaatgaaatggtgctgttgcaaatggaggacaaagcatggctcgtccaccggcagtggtttctggatttacctctgccatggctccccggcgctgacactcagggatctaactggatacagaaggagacacttgtgacgttcaagaatcctcatgccaaaaagcaagacgttgtggtcctgggctcccaggaaggggcgatgcacaccgccttgactggagcaacagagattcagatgtcaagcggtaacctactgtttaccggccatctcaaatgccgtctgcgcatggataaacttcaactgaaagggatgagttactctatgtgtacaggaaagttcaagatcgtgaaagaaatcgctgagactcagcacggcaccattgtaatcagagttcagtatgagggtgacgggtccccatgcaagattcccttcgaaataacggatttggagaaaaggcatgtgctcggccggctgatcaccgtcaatccgattgtgacagaaaaggacagccctgtcaacatcgaggccgaacccccatttggagattcgtacatcattataggcgtggagcctgggcagttaaaactgaactggttcaagaagggatcttccatcggtcaaatgtttgagactaccatgcgaggcgctaaacgcatggccattctaggggacacagcatgggatttcggatcactcggcggtgtttttacaagtatcgggaaggccctgcaccaggtgttcggcgctatttacggagcggcatttagcggcgtatcctggaccatgaaaatccttataggggtcatcattacgtggatcggaatgaactctagaagcacatcattgagtgtgtccctggttctcgtgggcgtcgtgaccctgtatcttggtgccatggtacaggctgacagcgggtgtgtggtttcttggaagaacaaagaactgaagtgcggatcaggcattttcatcactgataatgtccacacatggaccgagcagtacaagtttcaacccgaaagtccaagcaaattggcctccgcaatacagaaggcccatgaggaaggtatttgtggcatcaggtctgtgactcggctcgagaacctgatgtggaaacagattacccccgagttaaatcacatcctgtcggaaaacgaggtgaagctaacaataatgacgggggacatccgcggaattatgcaggctggcaaaagaagcctcaggcctcaaccaaccgaactgaagtattcctggaaaacttgggggaaggccaagatgctttcaacagagagtcataatcagaccttcttgatcgatggaccggaaacagcagagtgccccaacactaatcgtgcgtggaactctctggaggtcgaagactacggctttggtgttttcaccacgaatatttggctcaaactgcgggagaagcaggacgtgttttgtgatagcaaattaatgtccgctgccatcaaggacaaccgagcagtgcacgccgatatggggtattggatagaatcagctctgaatgacacatggaaaatggagaaggccagcttcattgaggtaaagtcttgccactggcctaaatcccataccctttggagtaacggagtcttggaaagcgagatgatcatcccaaagaatttcgcaggccccgtgtctcagcacaactacagacctggttatcatactcaaaccgctggcccatggcacctcgggaaactggaaatggattttgacctatgtgagggaacaactgttgtggtcaccgaagattgcggcaacagggggccctccctgcgcacaacgaccgcctcaggaaagctcattactgagtggtgctgtcggagttgcacactgccgcctcttagatacaggggcgaggacggttgttggtacgggatggaaatccgcccattgaaagagaaggaagagaatctggtgaacagcttagttaccgcgggacatggccagattgataatttctcgctcggtgtgctgggcatggccctttttctggaagagatgttgcgaactcggatagggacaaagcacgctatcctcctggtagcagtctccttcgtgaccctaattacgggaaacatgtcttttcgtgacctgggcagagtgatggtcatggttggggccactatgaccgatgacatcggaatgggcgtgacatatctcgctctgcttgccgcattcaaagtaaggcccacctttgcggccggtttgctgttacgcaagctcactagcaaagagctgatgatggctacaattgggatcgcccttctgtcacagagtaccatacctgaaacaatcctagagctcactgatgcactggctttgggaatgatggtgctgaagattgtccggaatatggaaaaataccaattagccgtgaccatcatggcaatttcctgcgttcccaacgccgtgatcctccagaatgcttggaaggtctcttgtacgatactggcggccgtgagcgtttccccacttctgttgacatcaagccagcagaaggcagactggattcctctcgctctgaccatcaaaggcctaaaccccactgccatcttcctgaccacacttagtagaacttctaagaaaaggtcctggccactcaatgaggccattatggctgtgggcatggtcagcatactggcatcgtcattgctgaagaacgacatcccgatgaccgggcctttagtagccggaggtctcctgacggtgtgctatgttcttacaggccgatctgcggatctggaattggagcgcgctgccgacgtgaaatgggaggatcaagcagaaattagtgggtccagccccatcctctctattaccatcagcgaggacggatccatgtcaataaagaatgaagaggaggaacagactctgacaatcctaattcggaccggcctgcttgtcatcagtggtgtgtttccagtaagcattcccatcactgccgctgcatggtacctctgggaggtgaaaaagcagagagccggggtcctgtgggatgttccttctccaccccctgtggaaaaggcggagttggaagacggagcttataggataaaacagcgtggcattttaggctactcccaaatcggggccggagtgtataaggagggtacattccacaccatgtggcatgtcacgcgcggcgcagtgctgatgcaccgggggaaaagaatcgagccgtcatgggccgatgttaagaaagacctcattagttacggaggcggttggaagctggaaggggagtggaaggaaggagaggaagtacaggtgcttgctctggagccaggcaaaaaccccagggccgtccagactaagcctggcatctttaaaaccaatacagggaccataggagcagtgagcttggatttctccccaggtacatctggctcgcccattgttgaccgaaaggggaaagtggtcggactatacggcaacggtgtggtaactcggagcggggcttatgtctcagccatcgcgcagaccgagaagtccattgaagataatcctgagatcgaagacgatatatttcgcaagaaaagactgacgattatggacctccatccgggagccggcaagacaaaaaggtacctgcccgcaatcgtgcgggaggctatcaagcgaggccttagaactttaattctggccccaacccgcgttgtggctgcagaaatggaggaggccctcagggggttgcctatccgttatcaaacaaccgccattaaaactgaacacaccggacgggagatagtcgacctgatgtgtcatgctacattcacgatgagactcctgagtcccgtgagggttccaaactacaaccttatcattatggatgaagcgcacttcactgaccctgcatctatcgccgctcgcggttatatcagcacccgagtggagatgggcgaggccgcagggatttttatgacagccacacccccaggatccagagatccgttccctcagtcaaatgctcccataatggacgaagaacgggaaatcccagagaggtcttggaacagcggccacgaatgggtcactgattttaagggtaagacagtgtggttcgtacccagtattaaagcggggaatgacatcgccgcatgcctgcgcaagaacggcaagaaggtgattcagttgtcccgtaaaacctttgatagcgagtacgttaagacgagagctaatgactgggatttcgtcgtgactacagacatctctgagatgggcgccaactttaaggcagaacgggtgatagatcctaggcgctgtatgaaaccagtcatcctaaccgacggcgaggaacgagtaattctggccgggcccatgcctgtgacccattcatccgctgcccaaagacggggaaggatcggtcgcaatccgaagaacgagaatgaccagtatatttacatgggcgaaccactcgagaacgatgaggactgcgcgcactggaaagaagcaaagatgttactggataatatcaacactcccgaggggataattcctagtatgttcgaacccgagagagaaaaagttgacgccatcgatggagagtacaggcttcggggcgaggctcgtaagacatttgtggacctgatgcgccgaggtgatctcccagtctggttggcctataaagtggctgcagaagggattaattacgccgacagaaagtggtgtttcgatggcatcaagaacaatcagatactggaggaaaacatggaggttgagatctggaccaaagaaggagagaggaagaaactcaagcctcggtggctggacgctcgcatttatagcgatccccttgccctaaaagaatttaaggagttcgcagcgggcagaaagtcgctgacattgaacttaatcactgaaatggggaggctgccaacgttcatgacccagaaagcccggaatgctctcgacaacctggccgtgcttcatacagcagaggctggaggtcgagcctacaatcacgcactgtctgagctccctgaaactttggagaccctgctactgctcacacttctggccaccgtcactggcgggatatttttattcttgatgtccggaaagggcatcggtaaaatgacgctggggatgtgctgcataattaccgctagcatcctcctgtggtatgcgcaaatccagccgcactggattgccgcatcaatcatacttgaatttttcctgattgtgctcttgatccccgagccagaaaagcagagaacacctcaggataaccaactgacttacgtagtgattgctatcttaaccgttgtcgccgccacaatggcaaatgagatgggctttctagagaaaaccaagaaggacctgggactcggcagtataactacacaggaatctgagtccaacatccttgacattgatctgcgccccgctagcgcctggacgttgtatgcggtggctaccactttcgtgacaccaatgctgaggcattcaatcgaaaatagtagcgtcaacgtttccctcaccgccattgcaaatcaggccaccgtgctgatggggcttggaaaaggttggcctctctctaagatggacatcggcgtacccctgttggctattgggtgttacagccaggtgaacccgatcacactgactgcagccttactactgctcgtcgcgcactacgctataattggaccaggccttcaagccaaagcaacgcgggaggcccagaagcgtgctgccgcaggtatcatgaaaaatcctaccgtggatgggatcacagttattgacctggaacccataccatatgatcccaagtttgagaagcagttgggccaggtgatgctgctcatcctgtgcgtcactcaagtacttatgatgagaaccacatgggctttatgtgaggccctgaccctcgcgactggacctatttccacgttgtgggaaggcaacccggggaggttctggaatacaaccatcgccgtgtcaatggcaaacatttttcgcggatcttacctggctggcgccggtctactgttcagtatcatgaaaaatactacctcgacacggcgagggactggaaacataggcgagaccctcggtgaaaagtggaaaagcagacttaatgcactgggcaagtccgagtttcagatctataaaaagtctgggattcaggaggttgacaggacattggctaaagaaggaatcaagcgcggcgagacggatcatcacgccgtgtcacgggggagcgccaagctgagatggttcgtcgaacgtaacatggtgacccccgagggaaaagtcgtggacctcggctgcggtagagggggatggtcctactattgtggcggtctgaagaacgttcgggaagtgaaaggcttaactaaagggggaccaggccatgaggagcctattcccatgagtacatacgggtggaatcttgtacgcctgcaatctggagtggatgtctttttcacccctccagaaaaatgcgacactctcctatgtgatatcggcgagagctcacccaaccctacaatagaagcgggtcgaaccctgagagttttgaatctggtggagaactggctcaataacaatacgcagttctgcattaaggtccttaacccatatatgccctccgtgatcgaaaagatggaggctctgcagaggaaatacgggggagcattggtacggaatccgctgagtcgcaacagcacccacgagatgtactgggtgtctaatgccacaggcaacatcgtttcctcagtgaatatgattagcagaatgctcataaacaggtttactatgaagcacaaaaaggctacctatgaacctgacgtcgatttaggctcggggacacgaaatatcggaattgagtctgaaatcccaaacctggacattatcggtaaacggatagagaagatcaagcaggaacatgagacaagttggcactacgaccaagatcatccctataaaacctgggcctaccacggctcctatgagacaaagcagaccgggagcgcatcatccatggtgaacggagtcgtgcgtcttctgactaaaccttgggacgttgtaccaatggtgacgcagatggccatgacagataccactcccttcggccagcaaagagtctttaaggaaaaagtggacacccgcacacaggagccgaaggaaggtacgaagaaactaatgaagattaccgctgagtggctctggaaagagctggggaagaaaaagactcctaggatgtgtacacgggaagagttcaccagaaaagttcgctctaatgcggccttgggagcaatctttactgatgaaaacaagtggaaaagcgctagggaggccgtggaagacggccgattctgggagctggtcgatcgggagagaaatctccaccttgaaggcaaatgcgagacatgtgtgtacaacatgatggggaagagggagaagaagctgggagagtttggtaaagcaaagggcagtcgcgccatttggtatatgtggttaggggctcgtttcctggaatttgaggccttgggattcctcaatgaggaccattggttttcccggggcaacagcctgtctggtgtagaaggggagggactacacagacttggctacatcctgagggatgtgtcaaagaaagaaggcggggcgatgtacgcagacgataccgccggatgggacacacgcattactctcgaggacctgaagaatgaagagatggttaccaaccatatgaaaggtgagcacaagaaattggctgaagccatattcaagctgacgtatcagaataaggtcgtgcgagtgcagcggcccaccccaagaggcacagtcatggatatcattagtaggcgcgaccaaagagggtccggacaggttggcacttacggtctcaacacctttacaaatatggaggcacagcttatccggcaaatggaaggggagggaatcttcaaaagcattcagcatctgactgctaccgaggaaatagccgtgcagaactggttagctagggtaggccgtgagcgactgtctcgcatggccatctcgggcgatgactgcgtggtcaagcctattgatgacagattcgcatcagcgttgacggccctcaatgatatggggaaagtgcggaaggacatccagcaatgggaacccagcaggggatggaacgattggacacaggttccattttgctcccaccacttccatgagctggtgatgaaagacggtcgcgtcctagtggtaccctgtagaaatcaggatgaacttattggccgggctaggatcagtcagggggccggatggtctctgaaggagaccgcatgcctcggcaagagctatgctcaaatgtggactctgatgtactttcaccgacgtgacttgagattagccgcaaacgccatatgttccgcggttccttcacattgggtgccaacaagtcgcaccacttggtctatccacgctaaacacgagtggatgaccacagaagatatgctggccgtctggaaccgggtgtggattcaggagaatccgtggatggaagacaagacgcccgtggagagctgggaagaggtcccttatctcggtaaaagggaggaccagtggtgcgggtcccttatcggactgacctcaagagcaacttgggccaagaacattcagacagctatcaatcaagttcgcagcctaataggcaacgaagagtacaccgattatatgccatctatgaaacggttcaggcgagaagaggaagaggccggcgtgctgtggtga

SEQ ID NO: 14565 - RNA, 9876 nt, synthetic construct
  misc_feature 1..9876: note = derived and/or modified CDS sequence (opt3) from DENV-2__GQ199874__SS-prME
  source 1..9876: mol_type = other RNA
accgccggagtgatcgtcatgctgattcccacagctatggcattccacctcactacgagaaatggggagcctcatatgatagttggaaggcaggaaaagggtaaaagccttctgtttaagaccgaggacggcgtgaatatgtgcaccttgatggccatggatttaggggaactgtgtgaggacactatcacctacaaatgcccactactccggcaaaacgaaccggaggatattgactgttggtgcaattccacatctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggatcgagacctggattctgcggcatcctggcttcacaatcatggccgcaatattggcctacaccatcggcacgactcactttcagcgcgctctcattttcatcctgctgacagcagtggccccatccatgaccatgagatgcattgggatctctaacagggattttgtcgaaggagtgtcgggtggctcatgggtagacatagttctcgagcacgggagctgtgtgactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttatttgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccatcgttattactccacacagcggtgaggagcatgctgtgggcaatgacacggggaagcacggaaaagaaataaagatcacaccgcagtcctcaattaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatccagaaggagacacttgtgacgttcaagaaccctcatgccaaaaagcaagacgttgtggtcctgggctctcaggaaggggcgatgcacaccgccttgactggagcaacagagatacagatgtcctcaggtaatctactgtttaccggccatctcaaatgccgtctgcgcatggataaacttcaactgaaagggatgagctacagtatgtgtacaggaaagttcaagattgtgaaagaaatcgctgagactcagcacggcaccatcgtaattagagttcagtatgagggtgacgggtctccatgcaagatccccttcgaaattacggatttggagaaaaggcatgtgctcggccggctgataaccgtcaacccgatcgtgacagaaaaggactcccctgtcaacattgaggccgaacccccatttggagatagctacatcatcattggcgtggagcctgggcagttaaaactgaattggttcaagaagggatcgtctataggtcaaatgtttgagactaccatgcgaggcgctaaacgcatggccatcctaggggacacagcatgggatttcggatccctcggcggtgtttttacttcaattgggaaggccctgcaccaggtgttcggcgctatctacggagcggcatttagtggcgtaagctggaccatgaaaattcttatcggggtcataatcacgtggattggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcatcttcattactgataacgtccacacatggaccgagcagtacaagtttcaacccgaatcaccaagtaaattggccagcgcaatccagaaggcccatgaggaaggtatatgtggcattaggtccgtgactcggctcgagaatctgatgtggaaacagatcacccccgagttaaaccacattctgtctgaaaatgaggtgaagctaacaatcatgacgggggacatacgcggaatcatgcaggctggcaaaagatcgctcaggcctcaaccaaccgaactgaagtatagctggaaaacttgggggaaggccaagatgctttccacagagtcacataaccagaccttcttgattgatggaccggaaacagcagagtgccccaatactaaccgtgcgtggaatagtctggaggtcgaagactacggctttggtgttttcaccacgaacatctggctcaaactgcgggagaagcaggacgtgttttgtgattctaaattaatgagcgctgccattaaggacaatcgagcagtgcacgccgatatggggtattggatcgaatccgctctgaacgacacatggaaaatggagaaggcctcattcatagaggtaaagagctgccactggcctaaatctcataccctttggtccaatggagtcttggaaagtgagatgattatcccaaagaacttcgcaggccccgtgagccagcacaactacagacctggttatcatactcaaaccgctggcccatggcacctcgggaaactggaaatggattttgacctatgtgagggaacaactgttgtggtcaccgaagattgcggcaatagggggccctctctgcgcacaacgaccgcctccggaaagctcatcactgagtggtgctgtcggtcatgcacactgccgcctcttagatacaggggcgaggacggttgttggtacgggatggaaattcgcccattgaaagagaaggaagagaacctggtgaatagtttagttaccgcgggacatggccagatcgataacttcagcctcggtgtgctgggcatggccctttttctggaagagatgttgcgaactcggattgggacaaagcacgctatactcctggtagcagtctcgttcgtgaccctaatcacgggaaatatgtcctttcgtgacctgggcagagtgatggtcatggttggggccactatgaccgatgacattggaatgggcgtgacatatctcgctctgcttgccgcattcaaagtaaggcccacctttgcggccggtttgctgttacgcaagctcacttctaaagagctgatgatggctacaatcgggattgcccttctgagccagtcaaccatccctgaaacaatactagagctcactgatgcactggctttgggaatgatggtgctgaagatcgtccggaacatggaaaaataccaattagccgtgaccattatggcaatcagttgcgttcccaatgccgtgattctccagaacgcttggaaggtctcctgtacgatcctggcggccgtgtctgttagcccacttctgttgacatcctcacagcagaaggcagactggatacctctcgctctgaccattaaaggcctaaatcccactgccatcttcctgaccacacttagcagaacaagtaagaaaaggtcttggccactcaacgaggccatcatggctgtgggcatggtctccattctggcaagctcgttgctgaagaatgacataccgatgaccgggcctttagtagccggaggtctcctgacggtgtgctatgttcttacaggccgatcagcggatctggaattggagcgcgctgccgacgtgaaatgggaggatcaagcagaaatctctgggagttcccccattctcagcatcaccatttctgaggacggaagcatgtccatcaagaacgaagaggaggaacagactctgacaatactaatccggaccggcctgcttgtcatttcaggtgtgtttccagtaagtatccccattactgccgctgcatggtacctctgggaggtgaaaaagcagagagccggggtcctgtgggatgttcctagcccaccccctgtggaaaaggcggagttggaagacggagcttataggatcaaacagcgtggcatattaggctactctcaaattggggccggagtgtataaggagggtacattccacaccatgtggcatgtcacgcgcggcgcagtgctgatgcaccgggggaaaagaatcgagccgtcctgggccgatgttaagaaagacctcatctcatacggaggcggttggaagctggaaggggagtggaaggaaggagaggaagtacaggtgcttgctctggagccaggcaaaaatcccagggccgtccagactaagcctggcatttttaaaaccaacacagggaccatcggagcagtgagtttggatttcagcccaggtacatccggctctcccatagttgaccgaaaggggaaagtggtcggactatacggcaatggtgtggtaactcggtcgggggcttatgtcagcgccattgcgcagaccgagaagtcaatcgaagataaccctgagattgaagacgatatctttcgcaagaaaagactgacgataatggacctccatccgggagccggcaagacaaaaaggtacctgcccgcaattgtgcgggaggctatcaagcgaggccttagaactttaatcctggccccaacccgcgttgtggctgcagaaatggaggaggccctcagggggttgcctattcgttatcaaacaaccgccatcaaaactgaacacaccggacgggagattgtcgacctgatgtgtcatgctacattcacgatgagactcctgtcccccgtgagggttccaaactacaatcttataatcatggatgaagcgcacttcactgaccctgcaagtattgccgctcgcggttatatctctacccgagtggagatgggcgaggccgcagggatctttatgacagccacacccccaggaagcagagatccgttccctcagtccaacgctcccattatggacgaagaacgggaaataccagagaggtcatggaactctggccacgaatgggtcactgattttaagggtaagacagtgtggttcgtacccagcatcaaagcggggaacgacattgccgcatgcctgcgcaagaatggcaagaaggtgatccagttgagtcgtaaaacctttgattccgagtacgttaagacgagagctaacgactgggatttcgtcgtgactacagacattagcgagatgggcgccaattttaaggcagaacgggtgatcgatcctaggcgctgtatgaaaccagtcatactaaccgacggcgaggaacgagtaatcctggccgggcccatgcctgtgacccattcttcagctgcccaaagacggggaaggattggtcgcaacccgaagaatgagaacgaccagtatatctacatgggcgaaccactcgagaatgatgaggactgcgcgcactggaaagaagcaaagatgttactggataacattaatactcccgaggggatcataccttccatgttcgaacccgagagagaaaaagttgacgccattgatggagagtacaggcttcggggcgaggctcgtaagacatttgtggacctgatgcgccgaggtgatctcccagtctggttggcctataaagtggctgcagaagggatcaactacgccgacagaaagtggtgtttcgatggcattaagaataaccagatcctggaggaaaacatggaggttgagatatggaccaaagaaggagagaggaagaaactcaagcctcggtggctggacgctcgcatctatagtgatccccttgccctaaaagaatttaaggagttcgcagcgggcagaaagagcctgacattgaatttaattactgaaatggggaggctgccaacgttcatgacccagaaagcccggaacgctctcgacaatctggccgtgcttcatacagcagaggctggaggtcgagcctacaaccacgcactgtcggagctccctgaaactttggagaccctgctactgctcacacttctggccaccgtcactggcgggatctttttattcttgatgtctggaaagggcattggtaaaatgacgctggggatgtgctgcatcataaccgcttccattctcctgtggtatgcgcaaatccagccgcactggatcgccgcaagcattatccttgaatttttcctgatagtgctcttgattcccgagccagaaaagcagagaacacctcaggataatcaactgacttacgtagtgatcgctattttaaccgttgtcgccgccacaatggcaaacgagatgggctttctagagaaaaccaagaaggacctgggactcggctcaatcactacacaggaaagtgagtctaatatacttgacatcgatctgcgccccgcttccgcctggacgttgtatgcggtggctaccactttcgtgacaccaatgctgaggcatagcattgaaaactcaagtgtcaatgttagcctcaccgccatcgcaaaccaggccaccgtgctgatggggcttggaaaaggttggcctctctccaagatggacattggcgtacccctgttggctatcgggtgttactctcaggtgaatccgattacactgactgcagccttactactgctcgtcgcgcactacgctatcataggaccaggccttcaagccaaagcaacgcgggaggcccagaagcgtgctgccgcaggtattatgaaaaaccctaccgtggatgggatcacagttatcgacctggaacccattccatatgatcccaagtttgagaagcagttgggccaggtgatgctgctcatactgtgcgtcactcaagtacttatgatgagaaccacatgggctttatgtgaggccctgaccctcgcgactggacctatcagcacgttgtgggaaggcaatccggggaggttctggaacacaaccattgccgtgtccatggcaaatatctttcgcggatcatacctggctggcgccggtctactgttctctattatgaaaaacactaccaatacacggcgagggactggaaacatcggcgagaccctcggtgaaaagtggaaaagtagacttaacgcactgggcaagtcggagtttcagatatataaaaagagcgggatccaggaggttgacaggacattggctaaagaaggaattaagcgcggcgagacggatcatcacgccgtgtcccgggggtctgccaagctgagatggttcgtcgaacgtaatatggtgacccccgagggaaaagtcgtggacctcggctgcggtagagggggatggtcatactattgtggcggtctgaagaacgttcgggaagtgaaaggcttaactaaagggggaccaggccatgaggagcctatccccatgagcacatacgggtggaatcttgtacgcctgcaatccggagtggatgtctttttcacccctccagaaaaatgcgacactctcctatgtgatattggcgagagttctcccaaccctacaatcgaagcgggtcgaaccctgagagttttgaatctggtggagaactggctcaataacaatacgcagttctgcataaaggtccttaacccatatatgcccagcgtgattgaaaagatggaggctctgcagaggaaatacgggggagcattggtacggaatccgctgtcacgcaactccacccacgagatgtactgggtgagtaatgccacaggcaacatcgttagctctgtgaatatgatctccagaatgctcattaacaggtttactatgaagcacaaaaaggctacctatgaacctgacgtcgatttaggctcagggacacgaaacataggaatcgagagcgaaattccaaatctggacatcattggtaaacggatcgagaagataaagcaggaacatgagacttcgtggcactacgaccaagatcatccctataaaacctgggcctaccacggctcttatgagacaaagcagaccgggagtgcatccagcatggtgaacggagtcgtgcgtcttctgactaaaccttgggacgttgtaccaatggtgacgcagatggccatgacagataccactcccttcggccagcaaagagtctttaaggaaaaagtggacacccgcacacaggagccgaaggaaggtacgaagaaactaatgaagatcaccgctgagtggctctggaaagagctggggaagaaaaagactcctaggatgtgtacacgggaagagttcaccagaaaagttcgctcaaatgcggccttgggagcaatttttactgatgaaaacaagtggaagtccgctagggaggccgtggaagacggccgattctgggagctggtcgatcgggagagaaatctccaccttgaaggcaaatgcgagacatgtgtgtacaacatgatggggaagagggagaagaagctgggagagtttggtaaagcaaagggctctcgcgccatctggtatatgtggttaggggctcgtttcctggaatttgaggccttgggattcctcaatgaggaccattggtttagccggggcaacagtctgtccggtgtagaaggggagggactacacagacttggctacattctgagggatgtgggcaagaaagaagggggagcgatgtacgcagacgataccgccggttgggacacacgcatcactctcgaggacctgaagaatgaagagatggttaccaaccatatgaaaggcgagcacaagaaattggctgaagccattttcaagctgacgtatcagaataaggtcgtgcgagtgcagcggcccaccccaagagggacagtcatggatataatcagcaggcgcgaccaaagaggatctggccaggttggtacttacgggctcaacacctttacaaatatggaggcacagcttattcggcaaatggaaggagagggcatcttcaaatcaatccagcatctgactgctaccgaggaaattgccgtgcagaactggttagctagggtaggccgtgagcgactgagtcgcatggccatatccggggatgactgcgtggtcaagcctatcgatgacagattcgcaagcgcgttgacggccctcaatgatatgggaaaagtgcggaaggacattcagcaatgggaaccctctaggggttggaacgattggacacaggttccattttgctcgcaccacttccatgagctggtgatgaaagacggccgcgtcctagtggtaccctgtagaaaccaggatgaacttatcgggcgggctaggatttcacagggagccggctggagcctgaaggagaccgcatgcctcggtaagtcctatgctcaaatgtggactctgatgtactttcaccgacgtgacttgagattagccgcaaatgccatctgtagtgcggttccttctcattgggtgccaacaagccgcaccacttggtccatacacgctaaacacgagtggatgaccacagaagatatgctggccgtctggaaccgggtgtggatccaggagaatccgtggatggaagacaagacgcccgtggagtcatgggaagaggtcccttatctcgggaaaagggaggaccagtggtgcggaagtcttattggcctgacctctagagcaacttgggccaagaacatccagacagctattaatcaagttcgcagcctaatcggcaacgaagagtacaccgattatatgccatccatgaaacggttcaggcgagaagaggaagaggccggggtgctgtggtga

SEQ ID NO: 14566 - RNA, 9876 nt, synthetic construct
  misc_feature 1..9876: note = derived and/or modified CDS sequence (opt3) from DENV-2__EU482639__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctacaagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatccgcggaattatgcaggctggcaaaagatcgctcaggcctcaaccaaccgaactgaagtatagctggaaaacttgggggaaggccaagatgctttccacagagtcacataaccagaccttcttgatcgatggaccggaaacagcagagtgccccaatactaaccgtgcgtggaatagtctggaggtcgaagactacggctttggtgttttcaccacgaacatttggctcaaactgcgggagaagcaggacgtgttttgtgattctaaattaatgagcgctgccatcaaggacaatcgagcagtgcacgccgatatggggtattggatagaatccgctctgaacgacacatggaaaatggagaaggcctcattcattgaggtaaagagctgccactggcctaaatctcataccctttggtccaatggagtcttggaaagtgagatgatcatcccaaagaacttcgcaggccccgtgagccagcacaactacagacctggttatcatactcaaaccgctggcccatggcacctcgggaaactggaaatggattttgacctatgtgagggaacaactgttgtggtcaccgaagattgcggcaatagggggccctctctgcgcacaacgaccgcctccggaaagctcattactgagtggtgctgtcggtcatgcacactgccgcctcttagatacaggggcgaggacggttgttggtacgggatggaaatccgcccattgaaagagaaggaagagaacctggtgaatagtttagttaccgcgggacatggccagattgataacttcagcctcggtgtgctgggcatggccctttttctggaagagatgttgcgaactcggatagggacaaagcacgctatcctcctggtagcagtctcgttcgtgaccctaattacgggaaatatgtcctttcgtgacctgggcagagtgatggtcatggttggggccactatgaccgatgacatcggaatgggcgtgacatatctcgctctgcttgccgcattcaaagtaaggcccacctttgcggccggtttgctgttacgcaagctcacttctaaagagctgatgatggctacaattgggatcgcccttctgagccagtcaaccatacctgaaacaatcctagagctcactgatgcactggctttgggaatgatggtgctgaagattgtccggaacatggaaaaataccaattagccgtgaccatcatggcaattagttgcgttcccaatgccgtgatcctccagaacgcttggaaggtctcctgtacgatactggcggccgtgtctgttagcccacttctgttgacatcctcacagcagaaggcagactggattcctctcgctctgaccatcaaaggcctaaatcccactgccatcttcctgaccacacttagcagaactagtaagaaaaggtcttggccactcaacgaggccattatggctgtgggcatggtctccatactggcaagctcgttgctgaagaatgacatcccgatgaccgggcctttagtagccggaggtctcctgacggtgtgctatgttcttacaggccgatcagcggatctggaattggagcgcgctgccgacgtgaaatgggaggatcaagcagaaatttctgggagttcccccatcctcagcattaccatctctgaggacggaagcatgtccataaagaacgaagaggaggaacagactctgacaatcctaattcggaccggcctgcttgtcatctcaggtgtgtttccagtaagtattcccatcactgccgctgcatggtacctctgggaggtgaaaaagcagagagccggggtcctgtgggatgttcctagcccaccccctgtggaaaaggcggagttggaagacggagcttataggataaaacagcgtggcattttaggctactctcaaatcggggccggagtgtataaggagggtacattccacaccatgtggcatgtcacgcgcggcgcagtgctgatgcaccgggggaaaagaatcgagccgtcctgggccgatgttaagaaagacctcatttcatacggaggcggttggaagctggaaggggagtggaaggaaggagaggaagtacaggtgcttgctctggagccaggcaaaaatcccagggccgtccagactaagcctggcatctttaaaaccaacacagggaccataggagcagtgagtttggatttcagcccaggtacatccggctctcccattgttgaccgaaaggggaaagtggtcggactatacggcaatggtgtggtaactcggtcgggggcttatgtcagcgccatcgcgcagaccgagaagtcaattgaagataaccctgagatcgaagacgatatatttcgcaagaaaagactgacgattatggacctccatccgggagccggcaagacaaaaaggtacctgcccgcaatcgtgcgggaggctatcaagcgaggccttagaactttaattctggccccaacccgcgttgtggctgcagaaatggaggaggccctcagggggttgcctatccgttatcaaacaaccgccattaaaactgaacacaccggacgggagatagtcgacctgatgtgtcatgctacattcacgatgagactcctgtcccccgtgagggttccaaactacaatcttatcattatggatgaagcgcacttcactgaccctgcaagtatcgccgctcgcggttatatctctacccgagtggagatgggcgaggccgcagggatttttatgacagccacccccccaggaagcagagatccgttccctcagtccaacgctcccataatggacgaagagcgggaaatcccagagaggtcatggaattctggccacgaatgggtcactgattttaagggtaagacagtgtggttcgtacccagcattaaagcggggaacgacatcgccgcatgcctgcgcaagaatggaaaaaaggtgattcagttgagtcgtaaaacctttgattccgagtacgttaagacgagagctaacgactgggatttcgtcgtgactacagacatcagcgagatgggcgccaattttaaggcagaacgggtgatagatcctaggcgctgtatgaaaccagtcatcctaaccgacggcgaggaacgagtaattctggccgggcccatgcctgtgacccattcttcagctgcccaaagacggggaaggatcggtcgcaacccgaagaatgagaacgaccagtatatttacatgggcgaaccactcgagaatgatgaggactgcgcgcactggaaagaagcaaagatgttactggataacatcaatactcccgaggggataattccttccatgttcgaacccgagagagaaaaagttgacgccatcgatggagagtacaggcttcggggcgaggctcgtaagacatttgtggacctgatgcgccgaggtgatctcccagtctggttggcctataaagtggctgcagaagggattaactacgccgacagaaagtggtgtttcgatggcatcaagaataaccagatactggaggaaaacatggaggttgagatctggaccaaagaaggagagaggaagaaactcaagcctcggtggctggacgctcgcatttatagtgatccccttgccctaaaagaatttaaggagttcgcagcgggcagaaagagcctgacattgaatttaatcactgaaatggggaggctgccaacgttcatgacccagaaagcccggaacgctctcgacaatctggccgtgcttcatacagcagaggctggaggtcgagcctacaaccacgcactgtcggagctccctgaaactttggagaccctgctactgctcacacttctggccaccgtcactggcgggatttttttattcttgatgtctggaaagggcatcggtaaaatgacgctggggatgtgctgcataattaccgcttccatcctcctgtggtatgcgcaaatccagccgcactggattgccgcaagcatcatacttgaatttttcctgattgtgctcttgatccccgagccagaaaagcagagaacacctcaggataatcaactgacttacgtagtgattgctatcttaaccgttgtcgccgccacaatggcaaacgagatgggctttctagagaaaaccaagaaggacctgggactcggctcaataactacacaggaaagtgagtctaatatccttgacattgatctgcgccccgcttccgcctggacgttgtatgcggtggctaccactctggtgacaccaatgctcaggcatagcatcgaaaactcaagtgtcaatgttagcctgaccgccattgcaaaccaggccaccgtgcttatggggctcggaaaaggttggcctctgtccaagatggacatcggcgtacccttgctggctattgggtgttactctcaggtgaatccgatcacattaactgcagccctactgctccttgtcgcgcactacgctataattggaccaggcctgcaagccaaagcaacgcgggaggcccagaagcgtgctgccgcaggtatcatgaaaaaccctaccgtggatgggatcacagttattgacttggaacccataccatatgatcccaagttcgagaagcagctgggccaggtgatgctcctgatcctttgcgtcactcaagtattaatgatgagaaccacatgggctctgtgtgaggccctcaccttggcgactggacctattagcacgctgtgggaaggcaatccggggaggttttggaacacaaccatcgccgtgtccatggcaaatattttccgcggatcatacctagctggcgccggtctgctcttttctatcatgaaaaacactaccaatacacggcgagggactggaaacataggcgagacccttggtgaaaagtggaaaagtagactgaacgcattgggcaagtcggagttccagatctataaaaagagcgggattcaggaggttgacaggacactggctaaagaaggaatcaagcgcggcgagacggatcatcacgccgtgtcccgggggtctgccaagctcagatggtttgtcgaacgtaatatggtgacccccgagggaaaagtcgtggacctgggctgcggtagggggggatggtcatactattgtggcggtttaaagaacgttcgggaagtgaaaggccttactaaggggggaccaggccatgaggagcctattcccatgagcacatacgggtggaatctggtacgcctccaatccggagtggatgtcttctttacccctccagaaaaatgcgagactctactgtgtgacatcggcgaaagttctcccaaccctacaatagaggcgggtcgaaccttgagagttctgaatctcgtggaaaactggcttaataacaatacgcagttctgcattaaggtcctgaacccatatatgcccagcgtgatcgagaagatggaggctttgcagaggaaatacgggggagcactggtacggaatccgctctcacgcaactccacccacgaaatgtactgggtgagtaatgccacaggcaacatcgttagctctgtgaatatgatttccagaatgttaataaacaggttcactatgaagcacaaaaaggctacctatgagcctgatgtcgacctgggctcagggacacgaaacatcggaattgaaagcgagatcccaaatcttgatattatcggtaaacggatagaaaagatcaagcaggagcatgagacttcgtggcactacgaccaagaccatccctataaaacctgggcctaccacggctcttatgaaacaaagcagaccgggagtgcatccagcatggtgaacggagtcgtgcgtctgctaactaaaccttgggatgttgtaccaatggtgacgcagatggccatgacagacaccactccctttggccagcaaagagtcttcaaggagaaagtggatacccgcacacaggaaccgaaggagggtacgaagaaactcatgaagattaccgctgagtggctgtggaaagaattggggaagaaaaagactcctaggatgtgtacacgggaggaatttaccagaaaagttcgctcaaatgcggccctgggagcaatcttcactgacgagaacaagtggaagtccgctagggaagccgtggaggatggccgattttgggagctcgtcgaccgggaaagaaatcttcacctggagggcaaatgcgaaacatgtgtgtacaacatgatggggaagagggagaaaaagttaggagaattcggtaaagcaaagggctctcgcgccatttggtatatgtggctgggggctcgttttttggagttcgaggccctcggatttctgaatgaagatcattggttcagccggggcaacagtctatccggtgtagagggggaaggacttcacagactgggctacatcctcagggacgtgggcaagaaagaggggggagcgatgtacgcagatgacaccgccggttgggatacacgcattactctggaagacttgaagaatgaggagatggttaccaaccatatgaaaggcgaacacaagaaactggctgaggccatatttaagctcacgtatcagaataaggtcgtgcgagtgcagcggcccaccccaagagggacagtcatggacatcattagcaggcgcgatcaaagaggatctggccaggttggtacttacgggcttaacaccttcacaaatatggaagcacagctgatccggcaaatggagggagagggcatctttaaatcaattcagcatttaactgctaccgaagagatagccgtgcagaactggctggctagggtaggccgtgaacgattgagtcgcatggccatctccggggacgattgcgtggtcaagcctattgacgatagattcgcaagcgcgctcacggccctgaatgacatgggaaaaatccggaaggatattcagcaatgggagccctctaggggttggaacgactggacacaggtgccattctgctcgcaccactttcatgaactagttatgaaagatggccgcgtgcttgtcgtgccctgtagaaaccaggacgagctgatcgggcgggctaggatatcacagggagccggctggagcctcaaggagaccgcatgcctgggtaagtcctatgctcaaatgtggactttgatgtacttccaccgacgtgatttaagactggccgcaaatgccatctgtagtgcggtaccttctcattgggttccaacaagccgcaccacttggtccattcacgctaaacacgaatggatgaccacagaggacatgctcgccgtgtggaaccgggtctggatccaggaaaatccgtggatggaggataagacgcccgtggaatcatgggaggaggtgccttatcttgggaaaagggaagaccagtggtgcggaagtctgattggcctaacctctagagcaacttgggccaagaacatccagacagctataaatcaagtccgcagcctgattggcaacgaggaatacaccgactatatgccatccatgaaacggtttaggcgagaggaagaggaggccggggttctctggtga

SEQ ID NO: 14567 - RNA, 9876 nt, synthetic construct
  misc_feature 1..9876: note = derived and/or modified CDS sequence (opt3) from DENV-2__EU482766__SS-prME
  source 1..9876: mol_type = other RNA
accgccggcgtgatagtaatgctgattcccacagctatggctttccacctcactacgagaaacggggaacctcatatgatagttggaagacaggaaaagggtaaaagccttctgtttaagaccgaagacggcgtgaatatgtgcacattgatggccatcgatttaggggaactgtgtgaagacactattacctacaaatgcccactcctccggcaaaacgaaccggaagatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtagcaggaccgggcttgatttcaacgaaatggtgctgttgcaaatggaggacaaagcatggctcgtccaccggcagtggtttctggatttacccctgccttggctcccaggcgctgacactcagggatctaattggatacagaaggagacacttgtgacgttcaagaacccccatgccaaaaagcaagacgttgtggtcctgggctcccaggaaggggcgatgcacaccgccttgactggagcaacagagattcagatgtcaagcggtaatctactgtttaccggccatctcaaatgccgtctgcgcatggataaacttcaactgaaagggatgagttactctatgtgtacaggaaagttcaagatcgtgaaagaaatcgctgagactcagcacggcaccattgtaatcagagttcagtatgagggtgacgggtccccttgcaagattccattcgaaataacggatttggagaaaaggcatgtgctcggccggctgatcaccgtcaaccccattgtgacagaaaaggacagcccggtcaacatcgaggccgaacctccctttggagattcgtacatcattataggcgtggagccagggcagttaaaactgaattggttcaagaagggatcttccatcggtcaaatgtttgagactaccatgcgaggcgctaaacgcatggccattctaggggacacagcatgggatttcggatcactcggcggtgtttttacaagtatcgggaaggccctgcaccaggtgttcggcgctatttacggagcggcatttagcggcgtatcctggaccatgaaaatccttataggggtcatcattacgtggatcggaatgaactctagaagcacatcattgagtgtgtccctggttctcgtgggcgtcgtgaccctgtatcttggtgccgtagtgcaggctgacagcgggtgtgttgtctcttggaagaataaagaactgaagtgcggatcaggcattttcatcactgataacgtgcacacatggaccgagcagtacaagtttcaacctgaaagtcccagcaaattggcctccgcaatacagaaggcccatgaggaaggtatttgtggcatcaggtctgtgactcggctcgagaatctgatgtggaaacagattaccccagagttaaaccacatcctgtcggaaaatgaggtcaagctaacaataatgacgggggacatcaaaggaattatgcaggctggcaagcgcagcctcagaccccaacctaccgaactgaaatattcctggaagacttgggggaaggccaaaatgctttcaacagagagtcataaccagaccttcttgatcgatggaccagaaacagcagagtgcccgaatactaacagggcgtggaactctctggaggttgaagactacggctttggtgtgttcaccacgaacatttggctcaagctgcgtgagaaacaggacgtgttttgtgatagcaagttaatgtccgctgccatcaaagacaatcgggcagtacacgccgatatggggtattggatagaatcagctctgaacgacacatggaagatggagaaggccagcttcattgaggtcaaatcttgccactggcccaagtcccataccctttggagtaatggagtgttggaaagcgagatgatcatccctaaaaacttcgcaggcccagtttctcagcacaactaccgacccggttatcatactcaaaccgctggcccttggcacctcgggaagctggaaatggattttgacttctgtgagggaacaactgtggtcgtgaccgaagattgcggcaatagagggccatccctaaggacaacgaccgcctcaggaaaactgattactgagtggtgctgtcgcagttgcacactacccccgctgcggtacagaggcgaggacggttgttggtacgggatggaaatcaggcctcttaaggagaaggaagagaacttggttaatagcctggtgaccgcgggacatggccagattgataacttttcgttaggtgtactcggcatggccctgttccttgaagagatgctgcgcactcgaatagggacaaaacacgctatcttgctcgtcgcagtgtcctttgtgaccctgattacgggaaatatgtctttccgggacctaggccgtgtcatggttatggtgggggccactatgaccgatgacatcggaatgggcgtaacatatctggctctcctggccgcatttaaggtgagaccaaccttcgcggccggtcttttgctgaggaaattaactagcaaggagctcatgatggctacaattgggatcgccctgctttcacagagtaccatacccgaaacaatcctggagctaactgatgcactcgctctgggaatgatggtcttgaaaattgtgcgcaacatggaaaagtaccaactggccgttaccatcatggcaatttcctgcgtgcctaatgccgtcatcttacagaacgcttggaaggtgtcttgtacgatactcgcggccgttagcgtgagccccctgcttctgacatcaagccagcagaaagcagactggattccattggctctcaccatcaagggcctgaatcctactgccatctttctaaccacactgagtcggacttctaaaaagagatcctggccccttaacgaggccattatggctgtcggcatggtaagcatactcgcatcgtcactgttgaaaaatgacatcccaatgaccgggccgctggtggccggaggtttactcacggtttgctatgtgctgacaggcaggtctgcggatcttgaactggagcgagctgccgacgtcaagtgggaggatcaagcagaaattagtgggtccagccctatcttgtctattaccatcagcgaggacggatccatgtcaatcaagaatgaagaggaggaacagactctcacaatcctgattcgcaccggcctactggtgatcagtggtgtattccccgtgagcattccaatcactgccgctgcatggtacctttgggaggtcaagaagcagcgggccggggttctctgggatgtgccctctcctccacccgtggaaaaagcggagctggaagacggagcttatagaataaagcagaggggcattttgggctactcccaaatcggggccggagtctataaagagggtacatttcacaccatgtggcatgtgacgcgtggcgcagttttaatgcaccgcgggaagcggatcgagccttcatgggccgatgtcaagaaggacctgattagttacggaggcggttggaagctcgaaggggagtggaaagaaggagaggaagtgcaggtcctggctcttgagccgggcaagaatccaagagccgtgcagactaaacccggcatcttcaagaccaacacagggaccataggagcagttagcctggatttttcccctggtacatctggctcgccaattgtggacaggaaagggaaggtcgtgggattgtacggcaatggtgtagtcactcgaagcggggcttatgtgtcagccatcgcgcagaccgagaagtccattgaagataaccccgagatcgaagacgatatattccggaaaaagcgcctaacgattatggacctgcatcctggagccggcaaaacaaagagatacctcccggcaatcgttagggaggctatcaaacggggcctgcgaactcttattttagcccccaccagagtggtcgctgcagaaatggaggaggccctgcgcgggctcccaatcaggtatcaaactcctgccattaagaccgaacacactggacgtgagatagtggacttgatgtgtcatgctaccttcacaatgcggctgctcagtcccgttagagtgccaaactacaatctgatcattatggatgaagcgcactttacggaccctgcatctatcgccgctaggggttatatcagcactcgcgtcgagatgggcgaggccgcagggattttcatgaccgccacacccccaggatcccgagatccgtttcctcagtcaaacgctcccataatggacgaagagagagaaatcccagagcggtcttggaatagcggccacgaatgggtgaccgatttcaagggtaaaactgtatggtttgtgcccagtattaaggcggggaacgacatcgccgcatgccttaggaaaaatggaaagaaagttattcagctgtcccgcaagacattcgatagcgagtacgtcaagacccgtgctaacgactgggattttgtggtgacgactgacatctctgagatgggcgccaatttcaaagcagaaagagtcatagatcctcggaggtgtatgaagccagtaatcttgacagacggcgaggaacgcgtgattctagccgggcccatgcctgttacccattcatccgctgcccaacgaagaggacggatcggtaggaacccgaaaaatgagaacgaccagtatatttacatgggcgaaccactggagaatgatgaggactgcgcgcactggaaggaagcaaaaatgctcttagataacatcaatacccccgaggggataattcctagtatgtttgaacccgagcgcgaaaaggtggacgccatcgatggagagtacagactgaggggcgaggctcggaaaactttcgtcgaccttatgcgtcgcggtgatctgccagtgtggctcgcctataaggttgctgcagaagggattaactacgccgaccgaaagtggtgttttgatggcatcaaaaataaccagatattggaggaaaacatggaggtggagatctggacaaaggaaggagagaggaagaagctgaaacctaggtggctcgacgctcggatttatagcgatcccctggcccttaaggagttcaaggagttcgcagcgggccgcaaatcgctaaccctgaatttgatcacagaaatggggagattaccaacttttatgacgcagaaggccaggaacgctctggacaatctcgccgtcctgcataccgcagaggctggaggtcgggcctacaaccacgcactttctgagctgcctgaaacactcgagactttgctgctactgaccctccttgccacagtgaccggcgggattttcctgtttttaatgtccggaaaaggcatcggtaagatgactttggggatgtgctgcataattacggctagcatcctgctctggtatgcgcaaatccagccgcactggattgccgcatcaatcatactggagttctttcttattgtactgctcatccccgagccagaaaaacagcgaacccctcaggataatcaattgacatacgtggttattgctatcctgactgtcgtggccgccaccatggcaaacgagatgggcttcttagagaagacaaagaaagacctaggactgggcagtataaccactcaggaatctgagtccaatatcctcgacattgatcttagacccgctagcgcctggacactgtatgcggtggctacgacctttgtcactccaatgttgcgccattcaatcgaaaacagtagcgttaatgtgtccctgacagccattgcaaaccaggccaccgtactcatggggctgggaaagggttggcctctttctaaaatggacatcggcgtgcccctcctggctattgggtgttacagccaggtcaatccgatcaccttgacagcagccctgttactactggtggcgcactacgctataattggaccaggcctccaagccaaggcaactagggaggcccagaaacgggctgccgcaggtatcatgaagaaccctacggttgatgggatcaccgtgattgaccttgaacccataccatatgatcccaagttcgagaaacagctgggccaggtcatgttgctgatcctctgcgtaacacaagtgctgatgatgcgtactacctgggctctttgtgaggccttaacactggcgaccggacctatttccactctctgggaaggcaatccggggagattttggaacacgacaatcgccgtttcaatggcaaatattttcaggggatcttacttggctggcgccggtctgctatttagtatcatgaagaacaccacttcgacccgccgggggacaggaaatataggcgagactctgggtgaaaaatggaagtcccgactcaacgcacttggcaaatccgagttccagatctataagaaatctgggattcaggaggtggacagaaccctggctaaggaaggaatcaagaggggcgagacagatcatcacgccgtctcacgcgggagcgccaaattgcggtggtttgtggaaagaaacatggtcacgcccgagggaaaggtggttgacctgggctgcggtcgtgggggatggtcctactattgtggcggtctcaaaaatgtgagggaagtaaagggcctgaccaaagggggaccaggccatgaggagcctattcccatgagtacttacgggtggaacttagtgcggcttcaatctggagtcgatgttttcttcacacctccagaaaagtgcgacaccctgctctgtgatatcggcgagagctcacccaatcctactatagaagcgggtcgcacactacgagtgctgaacttggtcgagaattggctgaacaataacacccagttttgcattaaggtgctcaatccatatatgccctccgtaatcgagaaaatggaggcacttcagagacagtacgggggagcactggtgaggaacccgttgagtcggaatagcacgcacgagatgtactgggtttctaacgccaccggcaatatcgtgtcctcagtcaacatgattagccgcatgctgataaatagattcacaatgaagcacaaaaaggctacttatgaacctgacgtggatctcggctcggggaccaggaacatcggaattgagtctgaaatcccaaacttagacattatcggtaaacgaatagagaagatcaagcaagaacatgagattagttggcactacgaccaggatcatccctataaaacatgggcctaccacggctcctatgagactaagcagaccgggagcgcatcatccatggtcaatggagtggttcggctgcttacaaaaccttgggacgtagtgccaatggtcacccagatggccatgactgatacgacaccctttggccaacagcgtgtgttcaaggaaaaagttgacaccagaactcaggagccgaaggaaggtaccaagaaactgatgaagatcacagctgagtggctatggaaagagctcgggaagaaaaagacgcctcgcatgtgtaccagggaagagtttactcggaaagtgagatctaacgcggccctgggagcaattttcacagatgaaaataagtggaaaagcgctcgcgaggccgtcgaagacggcaggttttgggagttggtggatcgagagcggaacctgcacctcgaaggcaaatgcgagacctgtgtatacaatatgatggggaagagagagaagaaacttggagagttcggtaaagcaaaaggcagtagggccatctggtatatgtggctgggggctcgctttttagagttcgaggccctgggatttttgaacgaggaccattggttctcccgtggcaatagcctctctggtgtggaaggggagggactgcaccggctaggctacattcttagagatgttggcaagaaagaagggggagcgatgtacgcagacgatactgccggttgggacacaaggataaccctggaggacctcaagaacgaagagatggtcacaaatcatatgaaaggcgagcacaagaaactggctgaagccatctttaagttgacttatcagaacaaggtggtgcgcgtccaacgacccaccccacgggggacggttatggatattatctcaagaagggaccagcgcggaagtggccaggtgggtacctacgggctgaatacattcactaacatggaggcacaactcatcagacagatggaaggagagggcattttcaaatccatacagcatcttaccgctacagaggaaatcgccgtacagaattggctggctcgggtgggcagggagcgtttaagccgaatggccatttctggggatgactgcgtcgtgaagcctatcgatgaccgctttgcatcggcgctgactgccttgaacgatatgggaaaagttagaaaggacattcaacagtgggaaccctcacggggttggaatgattggacccaggtgccattctgcagccaccactttcatgagctcgtcatgaaagacggcagggtgctggtagttccctgtcgcaaccaggatgaactaatcgggagagctcggatatcccaaggagccggctggagtcttaaggagacggcatgcctgggtaagtcttatgctcagatgtggacactcatgtacttccacaggcgagacctgcgtttggccgcaaacgccatctgtagcgcggtgccttcccattgggtcccaacctcaagaactacatggagtattcacgctaaacacgagtggatgaccactgaagatatgttagccgtgtggaatcgcgtgtggatccaggagaacccgtggatggaagacaagacccccgtcgagtcttgggaagaggttccttatctggggaaacgggaggaccagtggtgcggaagcctcattggccttacatccagggcaacgtgggccaagaatatccaaaccgctataaaccaggtgagatcactgattggcaatgaagagtacactgattatatgccaagcatgaaacgctttcggagggaagaggaagaggccggggtactatggtga

SEQ ID NO: 14568 - RNA, 9876 nt, synthetic construct
  misc_feature 1..9876: note = derived and/or modified CDS sequence (opt3) from DENV-2__EU482695__SS-prME
  source 1..9876: mol_type = other RNA
accgccggagtgatcgtcatgctgattcccacagctatggcattccacctcactacgagaaatggggagcctcatatgatagttggaaggcaggaaaagggtaaaagccttctgtttaagaccgaggacggcgtgaatatgtgcaccttgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatccgcggaattatgcaggctggcaaaagatcgctcaggcctcaaccaaccgaactgaagtatagctggaaaacttgggggaaggccaagatgctttccacagagtcacataaccagaccttcttgatcgatggaccggaaacagcagagtgccccaatactaaccgtgcgtggaatagtctggaggtcgaagactacggctttggtgttttcaccacgaacatttggctcaaactgcgggagaagcaggacgtgttttgtgattctaaattaatgagcgctgccatcaaggacaatcgagcagtgcacgccgatatggggtattggatagaatccgctctgaacgacacatggaaaatggagaaggcctcattcattgaggtaaagagctgccactggcctaaatctcataccctttggtccaatggagtcttggaaagtgagatgatcatcccaaagaacttcgcaggccccgtgagccagcacaactacagacctggttatcatactcaaaccgctggcccatggcacctcgggaaactggaaatggattttgacctatgtgagggaacaactgttgtggtcaccgaagattgcggcaatagggggccctctctgcgcacaacgaccgcctccggaaagctcattactgagtggtgctgtcggtcatgcacactgccgcctcttagatacaggggcgaggacggttgttggtacgggatggaaatccgcccattgaaagagaaggaagagaacctggtgaatagtttagttaccgcgggacatggccagattgataacttcagcctcggtgtgctgggcatggccctttttctggaagagatgttgcgaactcggatagggacaaagcacgctatcctcctggtagcagtctcgttcgtgaccctaattacgggaaatatgtcctttcgtgacctgggcagagtgatggtcatggttggggccactatgaccgatgacatcggaatgggcgtgacatatctcgctctgcttgccgcattcaaagtaaggcccacctttgcggccggtttgctgttacgcaagctcacttctaaagagctgatgatggctacaattgggatcgcccttctgagccagtcaaccatacctgaaacaatcctagagctcactgatgcactggctttgggaatgatggtgctgaagattgtccggaacatggaaaaataccaattagccgtgaccatcatggcaattagttgcgttcccaatgccgtgatcctccagaacgcttggaaggtctcctgtacgatactggcggccgtgtctgttagcccacttctgttgacatcctcacagcagaaggcagactggattcctctcgctctgaccatcaaaggcctaaatcccactgccatcttcctgaccacacttagcagaacaagtaagaaaaggtcttggccactcaacgaggccattatggctgtgggcatggtctccatactggcaagctcgttgctgaagaatgacatcccgatgaccgggcctttagtagccggaggtctcctgacggtgtgctatgttcttacaggccgatcagcggatctggaattggagcgcgctgccgacgtgaaatgggaggatcaagcagaaatttctgggagttcccccatcctcagcattaccatctctgaggacggaagcatgtccataaagaacgaagaggaggaacagactctgacaatcctaattcggaccggcctgcttgtcatctcaggtgtgtttccagtaagtattcccatcactgccgctgcatggtacctctgggaggtgaaaaagcagagagccggggtcctgtgggatgttcctagcccaccccctgtggaaaaggcggagttggaagacggagcttataggataaaacagcgtggcattttaggctactctcaaatcggggccggagtgtataaggagggtacattccacaccatgtggcatgtcacgcgcggcgcagtgctgatgcaccgggggaaaagaatcgagccgtcctgggccgatgttaagaaagacctcatttcatacggaggcggttggaagctggaaggggagtggaaggaaggagaggaagtacaggtgcttgctctggagccaggcaaaaatcccagggccgtccagactaagcctggcatctttaaaaccaacacagggaccataggagcagtgagtttggatttcagcccaggtacatccggctctcccattgttgaccgaaaggggaaagtggtcggactatacggcaatggtgtggtaactcggtcgggggcttatgtcagcgccatcgcgcagaccgagaagtcaattgaagataaccctgagatcgaagacgatatatttcgcaagaaaagactgacgattatggacctccatccgggagccggcaagacaaaaaggtacctgcccgcaatcgtgcgggaggctatcaagcgaggccttagaactttaattctggccccaacccgcgttgtggctgcagaaatggaggaggccctcagggggttgcctatccgttatcaaacaaccgccattaaaactgaacacaccggacgggagatagtcgacctgatgtgtcatgctacattcacgatgagactcctgtcccccgtgagggttccaaactacaatcttatcattatggatgaagcgcacttcactgaccctgcaagtatcgccgctcgcggttatatctctacccgagtggagatgggcgaggccgcagggatttttatgacagccacacccccaggaagcagagatccgttccctcagtccaacgctcccataatggacgaagaacgggaaatcccagagaggtcatggaactctggccacgaatgggtcactgattttaagggtaagacagtgtggttcgtacccagcattaaagcggggaacgacatcgccgcatgcctgcgcaagaatggcaagaaggtgattcagttgagtcgtaaaacctttgattccgagtacgttaagacgagagctaacgactgggatttcgtcgtgactacagacatcagcgagatgggcgccaattttaaggcagaacgggtgatagatcctaggcgctgtatgaaaccagtcatcctaaccgacggcgaggaacgagtaattctggccgggcccatgcctgtgacccattcttcagctgcccaaagacggggaaggatcggtcgcaacccgaagaatgagaacgaccagtatatttacatgggcgaaccactcgagaatgatgaggactgcgcgcactggaaagaagcaaagatgttactggataacatcaatactcccgaggggataattccttccatgttcgaacccgagagagaaaaagttgacgccatcgatggagagtacaggcttcggggcgaggctcgtaagacatttgtggacctgatgcgccgaggtgatctcccagtctggttggcctataaagtggctgcagaagggattaactacgccgacagaaagtggtgtttcgatggcatcaagaataaccagatactggaggaaaacatggaggttgagatctggaccaaagaaggagagaggaagaaactcaagcctcggtggctggacgctcgcatttatagtgatccccttgccctaaaagaatttaaggagttcgcagcgggcagaaagagcctgacattgaatttaatcactgaaatggggaggctgccaacgttcatgacccagaaagcccggaacgctctcgacaatctggccgtgcttcatacagcagaggctggaggtcgagcctacaaccacgcactgtcggagctccctgaaactttggagaccctgctactgctcacacttctggccaccgtcactggcgggatatttttattcttgatgtctggaaagggcatcggtaaaatgacgctggggatgtgctgcataattaccgcttccatcctcctgtggtatgcgcaaatccagccgcactggattgccgcaagcatcatacttgaatttttcctgattgtgctcttgatccccgagccagaaaagcagagaacacctcaggataatcaactgacttacgtagtgattgctatcttaaccgttgtcgccgccacaatggcaaacgagatgggctttctagagaaaaccaagaaggacctgggactcggctcaataactacacaggaaagtgagtctaatatccttgacattgatctgcgccccgcttccgcctggacgttgtatgcggtggctaccactttcgtgacaccaatgctgaggcatagcatcgaaaactcaagtgtcaatgttagcctcaccgccattgcaaaccaggccaccgtgctgatggggcttggaaaaggttggcctctctccaagatggacatcggcgtacccctgttggctattgggtgttactctcaggtgaatccgatcacactgactgcagccttactactgctcgtcgcgcactacgctataattggaccaggccttcaagccaaagcaacgcgggaggcccagaagcgtgctgccgcaggtatcatgaaaaaccctaccgtggatgggatcacagttattgacctggaacccataccatatgatcccaagtttgagaagcagttgggccaggtgatgctgctcatcctgtgcgtcactcaagtacttatgatgagaaccacatgggctttatgtgaggccctgaccctcgcgactggacctattagcacgttgtgggaaggcaatccggggaggttctggaacacaaccatcgccgtgtccatggcaaatatttttcgcggatcatacctggctggcgccggtctactgttctctatcatgaaaaacactaccaatacacggcgagggactggaaacataggcgagaccctcggtgaaaagtggaaaagtagacttaacgcactgggcaagtcggagtttcagatctataaaaagagcgggattcaggaggttgacaggacattggctaaagaaggaatcaagcgcggcgagacggatcatcacgccgtgtcccgggggtctgccaagctgagatggttcgtcgaacgtaatatggtgacccccgagggaaaagtcgtggacctcggctgcggtagagggggatggtcatactattgtggcggtctgaagaacgttcgggaagtgaaaggcttaactaaagggggaccaggccatgaggagcctattcccatgagcacatacgggtggaatcttgtacgcctgcaatccggagtggatgtctttttcacccctccagaaaaatgcgacactctcctatgtgatatcggcgagagttctcccaaccctacaatagaagcgggtcgaaccctgagagttttgaatctggtggagaactggctcaataacaatacgcagttctgcattaaggtccttaacccatatatgcccagcgtgatcgaaaagatggaggctctgcagaggaaatacgggggagcattggtacggaatccgctgtcacgcaactccacccacgagatgtactgggtgagtaatgccacaggcaacatcgttagctctgtgaatatgatttccagaatgctcataaacaggtttactatgaagcacaaaaaggctacctatgaacctgacgtcgatttaggctcagggacacgaaacatcggaattgagagcgaaatcccaaatctggacattatcggtaaacggatagagaagatcaagcaggaacatgagacttcgtggcactacgaccaagatcatccctataaaacctgggcctaccacggctcttatgagacaaagcagaccgggagtgcatccagcatggtgaacggagtcgtgcgtcttctgactaaaccttgggacgttgtaccaatggtgacgcagatggccatgacagataccactcccttcggccagcaaagagtctttaaggaaaaagtggacacccgcacacaggagccgaaggaaggtacgaagaaactaatgaagattaccgctgagtggctctggaaagagctggggaagaaaaagactcctaggatgtgtacacgggaagagttcaccagaaaagttcgctcaaatgcggccttgggagcaatctttactgatgaaaacaagtggaagtccgctagggaggccgtggaagacggccgattctgggagctggtcgatcgggagagaaatctccaccttgaaggcaaatgcgagacatgtgtgtacaacatgatggggaagagggagaagaagctgggagagtttggtaaagcaaagggctctcgcgccatttggtatatgtggttaggggctcgtttcctggaatttgaggccttgggattcctcaatgaggaccattggtttagccggggcaacagtctgtccggtgtagaaggggagggactacacagacttggctacatcctgagggatgtgggcaagaaagaagggggagcgatgtacgcagacgataccgccggttgggacacacgcattactctcgaggacctgaagaatgaagagatggttaccaaccatatgaaaggcgagcacaagaaattggctgaagccatattcaagctgacgtatcagaataaggtcgtgcgagtgcagcggcccaccccaagagggacagtcatggatatcattagcaggcgcgaccaaagaggatctggccaggttggtacttacgggctcaacacctttacaaatatggaggcacagcttatccggcaaatggaaggagagggcatcttcaaatcaattcagcatctgactgctaccgaggaaatagccgtgcagaactggttagctagggtaggccgtgagcgactgagtcgcatggccatctccggggatgactgcgtggtcaagcctattgatgacagattcgcaagcgcgttgacggccctcaatgatatgggaaaagtgcggaaggacatccagcaatgggaaccctctaggggttggaacgattggacacaggttccattttgctcgcaccacttccatgagctggtgatgaaagacggccgcgtcctagtggtaccctgtagaaaccaggatgaacttattgggcgggctaggatctcacagggagccggctggagcctgaaggagaccgcatgcctcggtaagtcctatgctcaaatgtggactctgatgtactttcaccgacgtgacttgagattagccgcaaatgccatatgtagtgcggttccttctcattgggtgccaacaagccgcaccacttggtccatccacgctaaacacgagtggatgaccacagaagatatgctggccgtctggaaccgggtgtggattcaggagaatccgtggatggaagacaagacgcccgtggagtcatgggaagaggtcccttatctcgggaaaagggaggaccagtggtgcggaagtcttatcggcctgacctctagagcaacttgggccaagaacattcagacagctatcaatcaagttcgcagcctaataggcaacgaagagtacaccgattatatgccatccatgaaacggttcaggcgagaagaggaagaggccggggtgctgtggtga

SEQ ID NO: 14569 - RNA, 9876 nt, synthetic construct
  misc_feature 1..9876: note = derived and/or modified CDS sequence (opt3) from DENV-2__EU482769__SS-prME
  source 1..9876: mol_type = other RNA
accgccggagtgatcgtcatgctgattcccacagctatggcattccacctcactacgagaaatggggagcctcatatgatagttggaaggcaggaaaagggtaaaagccttctgtttaagaccgaggacggcgtgaatatgtgcaccttgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatccgcggaattatgcaggctggcaaaagatcgctcaggcctcaaccaaccgaactgaagtatagctggaaaacttgggggaaggccaagatgctttccacagagtcacataaccagaccttcttgatcgatggaccggaaacagcagagtgccccaatactaaccgtgcgtggaatagtctggaggtcgaagactacggctttggtgttttcaccacgaacatttggctcaaactgcgggagaagcaggacgtgttttgtgattctaaattaatgagcgctgccatcaaggacaatcgagcagtgcacgccgatatggggtattggatagaatccgctctgaacgacacatggaaaatggagaaggcctcattcattgaggtaaagagctgccactggcctaaatctcataccctttggtccaatggagtcttggaaagtgagatgatcatcccaaagaacttcgcaggccccgtgagccagcacaactacagacctggttatcatactcaaaccgctggcccatggcacctcgggaaactggaaatggattttgacctatgtgagggaacaactgttgtggtcaccgaagattgcggcaatagggggccctctctgcgcacaacgaccgcctccggaaagctcattactgagtggtgctgtcggtcatgcacactgccgcctcttagatacaggggcgaggacggttgttggtacgggatggaaatccgcccattgaaagagaaggaagagaacctggtgaatagtttagttaccgcgggacatggccagattgataacttcagcctcggtgtgctgggcatggccctttttctggaagagatgttgcgaactcggatagggacaaagcacgctatcctcctggtagcagtctcgttcgtgaccctaattacgggaaatatgtcctttcgtgacctgggcagagtgatggtcatggttggggccactatgaccgatgacatcggaatgggcgtgacatatctcgctctgcttgccgcattcaaagtaaggcccacctttgcggccggtttgctgttacgcaagctcacttctaaagagctgatgatggctacaattgggatcgcccttctgagccagtcaaccatacctgaaacaatcctagagctcactgatgcactggctttgggaatgatggtgctgaagattgtccggaacatggaaaaataccaattagccgtgaccatcatggcaattagttgcgttcccaatgccgtgatcctccagaacgcttggaaggtctcctgtacgatactggcggccgtgtctgttagcccacttctgttgacatcctcacagcagaaggcagactggattcctctcgctctgaccatcaaaggcctaaatcccactgccatcttcctgaccacacttagcagaacaagtaagaaaaggtcttggccactcaacgaggccattatggctgtgggcatggtctccatactggcaagctcgttgctgaagaatgacatcccgatgaccgggcctttagtagccggaggtctcctgacggtgtgctatgttcttacaggccgatcagcggatctggaattggagcgcgctgccgacgtgaaatgggaggatcaagcagaaatttctgggagttcccccatcctcagcattaccatctctgaggacggaagcatgtccataaagaacgaagaggaggaacagactctgacaatcctaattcggaccggcctgcttgtcatctcaggtgtgtttccagtaagtattcccatcactgccgctgcatggtacctctgggaggtgaaaaagcagagagccggggtcctgtgggatgttcctagcccaccccctgtggaaaaggcggagttggaagacggagcttataggataaaacagcgtggcattttaggctactctcaaatcggggccggagtgtataaggagggtacattccacaccatgtggcatgtcacgcgcggcgcagtgctgatgcaccgggggaaaagaatcgagccgtcctgggccgatgttaagaaagacctcatttcatacggaggcggttggaagctggaaggggagtggaaggaaggagaggaagtacaggtgcttgctctggagccaggcaaaaatcccagggccgtccagactaagcctggcatctttaaaaccaacacagggaccataggagcagtgagtttggatttcagcccaggtacatccggctctcccattgttgaccgaaaggggaaagtggtcggactatacggcaatggtgtggtaactcggtcgggggcttatgtcagcgccatcgcgcagaccgagaagtcaattgaagataaccctgagatcgaagacgatatatttcgcaagaaaagactgacgattatggacctccatccgggagccggcaagacaaaaaggtacctgcccgcaatcgtgcgggaggctatcaagcgaggccttagaactttaattctggccccaacccgcgttgtggctgcagaaatggaggaggccctcagggggttgcctatccgttatcaaacaaccgccattaaaactgaacacaccggacgggagatagtcgacctgatgtgtcatgctacattcacgatgagactcctgtcccccgtgagggttccaaactacaatcttatcattatggatgaagcgcacttcactgaccctgcaagtatcgccgctcgcggttatatctctacccgagtggagatgggcgaggccgcagggatttttatgacagccacacccccaggaagcagagatccgttccctcagtccaacgctcccataatggacgaagaacgggaaatcccagagaggtcatggaactctggccacgaatgggtcactgattttaagggtaagacagtgtggttcgtacccagcattaaagcggggaacgacatcgccgcatgcctgcgcaagaatggcaagaaggtgattcagttgagtcgtaaaacctttgattccgagtacgttaagacgagagctaacgactgggatttcgtcgtgactacagacatcagcgagatgggcgccaattttaaggcagaacgggtgatagatcctaggcgctgtatgaaaccagtcatcctaaccgacggcgaggaacgagtaattctggccgggcccatgcctgtgacccattcttcagctgcccaaagacggggaaggatcggtcgcaacccgaagaatgagaacgaccagtatatttacatgggcgaaccactcgagaatgatgaggactgcgcgcactggaaagaagcaaagatgttactggataacatcaatactcccgaggggataattccttccatgttcgaacccgagagagaaaaagttgacgccatcgatggagagtacaggcttcggggcgaggctcgtaagacatttgtggacctgatgcgccgaggtgatctcccagtctggttggcctataaagtggctgcagaagggattaactacgccgacagaaagtggtgtttcgatggcatcaagaataaccagatactggaggaaaacatggaggttgagatctggaccaaagaaggagagaggaagaaactcaagcctcggtggctggacgctcgcatttatagtgatccccttgccctaaaagaatttaaggagttcgcagcgggcagaaagagcctgacattgaatttaatcactgaaatggggaggctgccaacgttcatgacccagaaagcccggaacgctctcgacaatctggccgtgcttcatacagcagaggctggaggtcgagcctacaaccacgcactgtcggagctccctgaaactttggagaccctgctactgctcacacttctggccaccgtcactggcgggatatttttattcttgatgtctggaaagggcatcggtaaaatgacgctggggatgtgctgcataattaccgcttccatcctcctgtggtatgcgcaaatccagccgcactggattgccgcaagcatcatacttgaatttttcctgattgtgctcttgatccccgagccagaaaagcagagaacacctcaggataatcaactgacttacgtagtgattgctatcttaaccgttgtcgccgccacaatggcaaacgagatgggctttctagagaaaaccaagaaggacctgggactcggctcaataactacacaggaaagtgagtctaatatccttgacattgatctgcgccccgcttccgcctggacgttgtatgcggtggctaccactttcgtgacaccaatgctgaggcatagcatcgaaaactcaagtgtcaatgttagcctcaccgccattgcaaaccaggccaccgtgctgatggggcttggaaaaggttggcctctctccaagatggacatcggcgtacccctgttggctattgggtgttactctcaggtgaatccgatcacactgactgcagccttactactgctcgtcgcgcactacgctataattggaccaggccttcaagccaaagcaacgcgggaggcccagaagcgtgctgccgcaggtatcatgaaaaaccctaccgtggatgggatcacagttattgacctggaacccataccatatgatcccaagtttgagaagcagttgggccaggtgatgctgctcatcctgtgcgtcactcaagtacttatgatgagaaccacatgggctttatgtgaggccctgaccctcgcgactggacctattagcacgttgtgggaaggcaatccggggaggttctggaacacaaccatcgccgtgtccatggcaaatatttttcgcggatcatacctggctggcgccggtctactgttctctatcatgaaaaacactaccaatacacggcgagggactggaaacataggcgagaccctcggtgaaaagtggaaaagtagacttaacgcactgggcaagtcggagtttcagatctataaaaagagcgggattcaggaggttgacaggacattggctaaagaaggaatcaagcgcggcgagacggatcatcacgccgtgtcccgggggtctgccaagctgagatggttcgtcgaacgtaatatggtgacccccgagggaaaagtcgtggacctcggctgcggtagagggggatggtcatactattgtggcggtctgaagaacgttcgggaagtgaaaggcttaactaaagggggaccaggccatgaggagcctattcccatgagcacatacgggtggaatcttgtacgcctgcaatccggagtggatgtctttttcacccctccagaaaaatgcgacactctcctatgtgatatcggcgagagttctcccaaccctacaatagaagcgggtcgaaccctgagagttttgaatctggtggagaactggctcaataacaatacgcagttctgcattaaggtccttaacccatatatgcccagcgtgatcgaaaagatggaggctctgcagaggaaatacgggggagcattggtacggaatccgctgtcacgcaactccacccacgagatgtactgggtgagtaatgccacaggcaacatcgttagctctgtgaatatgatttccagaatgctcataaacaggtttactatgaagcacaaaaaggctacctatgaacctgacgtcgatttaggctcagggacacgaaacatcggaattgagagcgaaatcccaaatctggacattatcggtaaacggatagagaagatcaagcaggaacatgagacttcgtggcactacgaccaagatcatccctataaaacctgggcctaccacggctcttatgagacaaagcagaccgggagtgcatccagcatggtgaacggagtcgtgcgtcttctgactaaaccttgggacgttgtaccaatggtgacgcagatggccatgacagataccactcccttcggccagcaaagagtctttaaggaaaaagtggacacccgcacacaggagccgaaggaaggtacgaagaaactaatgaagattaccgctgagtggctctggaaagagctggggaagaaaaagactcctaggatgtgtacacgggaagagttcaccagaaaagttcgctcaaatgcggccttgggagcaatctttactgatgaaaacaagtggaagtccgctagggaggccgtggaagacggccgattctgggagctggtcgatcgggagagaaatctccaccttgaaggcaaatgcgagacatgtgtgtacaacatgatggggaagagggagaagaagctgggagagtttggtaaagcaaagggctctcgcgccatttggtatatgtggttaggggctcgtttcctggaatttgaggccttgggattcctcaatgaggaccattggtttagccggggcaacagtctgtccggtgtagaaggggagggactacacagacttggctacatcctgagggatgtgggcaagaaagaagggggagcgatgtacgcagacgataccgccggttgggacacacgcattactctcgaggacctgaagaatgaagagatggttaccaaccatatgaaaggcgagcacaagaaattggctgaagccatattcaagctgacgtatcagaataaggtcgtgcgagtgcagcggcccaccccaagagggacagtcatggatatcattagcaggcgcgaccaaagaggatctggccaggttggtacttacgggctcaacacctttacaaatatggaggcacagcttatccggcaaatggaaggagagggcatcttcaaatcaattcagcatctgactgctaccgaggaaatagccgtgcagaactggttagctagggtaggccgtgagcgactgagtcgcatggccatctccggggatgactgcgtggtcaagcctattgatgacagattcgcaagcgcgttgacggccctcaatgatatgggaaaagtgcggaaggacatccagcaatgggaaccctctaggggttggaacgattggacacaggttccattttgctcgcaccacttccatgagctggtgatgaaagacggccgcgtcctagtggtaccctgtagaaaccaggatgaacttattgggcgggctaggatctcacagggagccggctggagcctgaaggagaccgcatgcctcggtaagtcctatgctcaaatgtggactctgatgtactttcaccgacgtgacttgagattagccgcaaatgccatatgtagtgcggttccttctcattgggtgccaacaagccgcaccacttggtccatccacgctaaacacgagtggatgaccacagaagatatgctggccgtctggaaccgggtgtggattcaggagaatccgtggatggaagacaagacgcccgtggagtcatgggaagaggtcccttatctcgggaaaagggaggaccagtggtgcggaagtatgatcggccttacctctagagcaacttgggccaagaacattcagacagctatcaatcaagttcgcagcctgataggcaacgaagagtacattgattatatgccatccatgaaacggttcaggcgagaagaggaagaggccggggtgctatggtga

SEQ ID NO: 14570 - RNA, 9876 nt, synthetic construct
  misc_feature 1..9876: note = derived and/or modified CDS sequence (opt3) from DENV-2__EU482696__SS-prME
  source 1..9876: mol_type = other RNA
acagccggcgtgatcgtcatgctgattccaacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccacatgtgggtatggggcttgagaccagaacagaaacttggatgagtagcgagggagcttggaaacacgttcagaggattgagacctggatcctgcggcatcctggcttcacaattatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctaccagcttgtcagtgagtctggttctcgtgggcgtcgtgaccctgtatcttggtgccatggtacaggctgactccgggtgtgtggccagctggaagaataaagaactgaagtgcggatctggcattttcatcactgataacgttcacacatggaccgagcagtacaagtttcaacccgaatcaccaagtaaattggcaagcgccatacagaaggctcatgaggaaggtatttgtggcatcaggtccgtcactcggctcgagaatctgatgtggaaacagattacccccgagttaaaccacatcctgtctgaaaatgaggtgaagctaacaataatgacgggggacatcaaaggaattatgcaggccggcaagcgctcgctcagacctcaaccaaccgaactgaaatatagctggaagacttgggggaaggcaaaaatgctttccacagagtcacataaccagaccttcttgatcgatggaccggaaacagcggagtgccccaatactaacagggcttggaatagtctggaggtggaagactacggctttggtgtcttcaccacgaacatttggctcaagctgcgtgagaaacaggacgtattttgtgattctaagttaatgagcgccgcaatcaaagacaatcgggccgtgcacgctgatatggggtattggatagaatccgccctgaacgacacatggaagatggagaaggcatcattcattgaggtgaaaagctgccactggcctaagtctcataccctttggtccaatggagtattggaaagtgagatgatcatccccaagaatttcgctggccccgtcagccagcacaactaccgacctggttatcatactcaaaccgccggcccatggcacctcgggaagctggaaatggattttgacctatgtgagggaacaactgtggttgtgaccgaagattgcggcaatagagggccctctctgaggacaacgaccgcgtccggaaaactcattactgagtggtgctgtcgctcatgcacactgccgcctcttcggtacagaggcgaggacggttgttggtacgggatggaaatcaggccattgaaggagaaggaagagaacctggtcaatagtttagtgaccgccggacatggccagattgataacttcagcctcggtgttctgggcatggctctttttctggaagagatgttgcgcactcgaatagggacaaaacacgcaaccctcctggtggccgtatcgttcgtcacgctaatcactggaaatatgtcctttcgggacctgggccgtgtgatggtgatggtcggggctaccatgacagatgacattggaatgggcgttacctatctcgccctgcttgcagcgttcaaggtgagacccacttttgccgctggtttgctgttaaggaaactcacatctaaggagctgatgatggccaccatcgggattgcacttctgagccagtcaacaatccctgaaactatactagagctcaccgatgctctggccttgggaatgatggtactgaaaatcgtgcgcaacatggaaaagtaccaattagcagtcacgattatggccatcagttgcgtgcccaatgctgttattctccagaacgcgtggaaggtgtcctgtacaatcctggccgcagtctctgtgagcccacttctgttgacctcctcacagcagaaagctgactggatacctctcgccctgactattaagggcctaaatcccaccgccatcttcctgacaactcttagccggaccagtaaaaagagatcttggccactcaacgaggctatcatggcagttggcatggtgtccattctggccagctcgttgctgaaaaatgacataccgatgacggggcctttagtcgcgggaggtctcctgacagtatgctatgtgcttaccggcaggtcagctgatctggaattggagcgagccgcagacgttaagtgggaggatcaagccgaaatctctgggagttcccccattctcagcatcactatttctgaggacggaagcatgtccatcaaaaacgaagaggaggaacagacactgaccatactaatccgcactggcctgcttgtgatttcaggtgtctttccagtgagtatccccattacagctgcagcctggtacctctgggaggtaaagaagcagcgggcgggggtgctgtgggatgtccctagcccaccccctgttgaaaaagctgagttggaagacggagcctatagaatcaagcagaggggcatattaggctactctcaaattggggcaggagtgtataaagagggtaccttccacacgatgtggcatgtgactcgtggcgccgtcctgatgcaccgcgggaagcggatcgagccgtcctgggctgatgtgaaaaaggacctcatctcatacggaggcggttggaagctggaaggggagtggaaagaaggagaggaagttcaggtacttgccctggagccaggcaagaatcccagagcagtgcagaccaaacctggcacatttaagaccaacacagggactattggagctgtcagtttggatttcagcccaggtacctccggctctcccatcgtggacaggaaagggaaggttgtgggactatacggcaatggtgtcgtgacgcgatcgggggcctatgtaagcgcgatagcccagacagagaagtcaattgaagataaccctgagatcgaagacgatatttttcggaaaaagcgcctgactatcatggacctccatccgggagcaggcaaaaccaagagatacctgcccgctatagtcagggaggccattaaacggggccttcgaacattaatcctggctccaaccagagtggttgcagccgaaatggaggaggccctccgcgggttgcctatcaggtatcaaactcccgctattaagaccgaacacacaggacgtgagatcgtggacctgatgtgtcatgcgacgttcactatgcggctcctgtccccagtcagagtgcctaactacaatcttattataatggatgaagcacacttcaccgaccccgccagtatcgctgccaggggttatatttctacacgcgttgagatgggcgaggcagccgggatctttatgaccgctactccaccgggaagccgagatcctttcccccagtccaacgcgccaatcatggacgaagagagagaaattcccgagcggtcatggaactctggccacgaatgggtgacagattttaagggtaaaaccgtctggttcgtgcctagcataaaggccgggaacgacatcgcagcttgcctgaggaaaaatggaaagaaagtaattcagttgagtcgcaagacgtttgattccgagtacgtgaagactcgtgccaacgactgggatttcgttgtcacaaccgacatcagcgagatgggcgcaaattttaaagccgaaagagtgattgatccacggaggtgtatgaagcccgtgatcctaaccgacggcgaggaacgcgtcatactggctgggcctatgccggtaactcattcttcagccgcgcaacgaagaggacggatcggtaggaaccccaaaaatgagaacgaccagtatatttacatgggcgaacccctcgagaatgatgaggactgcgcacactggaaggaagccaaaatgttactggataacatcaatacacctgaggggattatcccctccatgttcgaaccagagcgcgaaaaggtggacgctatagatggagagtacagacttaggggcgaggcccggaaaacctttgttgacctgatgcgtcgcggtgatctccctgtgtggttggcttataaggtcgcagccgaagggattaactacgctgaccgaaagtggtgtttcgatggcatcaaaaataaccagattctggaggaaaacatggaggtggagatctggacaaaggaaggagagaggaaaaagctcaaacccagatggctggacgcccggatatatagtgatccacttgcactaaaggaatttaaggagttcgcggccggccgcaaaagcctgactttgaatttaatcacggaaatggggagactgcctaccttcatgacacagaaggctaggaacgccctcgacaatctggcagttcttcatactgctgaggccggaggtcgggcatacaaccacgccctgtcggagctcccggaaaccttggagacactgctactgctcacccttctggctactgtgacgggcgggatatttttattcttgatgtctggaaaaggcatcggtaagatgaccctggggatgtgctgcattatcacagcgtccatactcctgtggtatgcccaaattcagccccactggatcgcagctagcatcattcttgaatttttcctgatcgtcctcttgataccagagcctgaaaaacagcgaactccccaggataatcaactgacctacgtggtaattgccatcttaacagtggttgccgcaaccatggctaacgagatgggctttctagagaagactaagaaagacctgggactcggctcaattacaacgcaggaaagtgagtctaatatccttgacatagatctgagaccagcctccgcgtggaccttgtatgctgtcgccactacattcgtgacccctatgctgcgccatagcatcgaaaactcaagtgtgaatgtcagcctcaccgcaattgccaaccaggctacagttctgatggggcttggaaagggttggcccctctccaaaatggacatcggcgtgccgctgttggcaattgggtgttactctcaggtaaatccaatcactctgacggccgcgttactactgctcgtggctcactacgccattatcggacctggccttcaagcaaaggccaccagggaggctcagaaacgggccgcagctggtataatgaagaaccccacagtcgatgggattactgtgatcgacctggaaccaatcccctatgatcctaagtttgagaaacagttgggccaggttatgctgctcattctgtgcgtgacccaagtccttatgatgcgtacaacctgggccttatgtgaggcgctgactctcgccacgggaccgataagcacattgtgggaaggcaatcccgggagattctggaacaccactatcgcagtatccatggctaatatttttaggggatcatacctggccggcgcaggtctactgttctctatcatgaagaacaccacaagtactcgccgggggaccggaaatattggcgagacactcggtgaaaaatggaagtcgcgacttaacgctctgggcaaaagcgagtttcagatctataagaaatccgggatacaggaggtggacagaacgttggccaaggaaggaatcaagaggggcgagaccgatcatcacgccgtttctcgcgggtcagcgaaactgcggtggttcgtggaaagaaacatggtcactccagagggaaaggtggtcgacctcggctgcggtcgtgggggatggagctactattgtggcggtctgaaaaatgtgagggaagttaagggcttaacaaaagggggacctggccatgaggagcccattcctatgtccacctacgggtggaaccttgtgcggctgcaaagtggagtagatgtgtttttcactccacccgaaaagtgcgacacactcctatgtgatatcggcgagtctagccctaatccaaccattgaagctggtcgcacgctgcgagtcttgaacctggttgagaattggctcaacaataacacccagttctgcatcaaggtgcttaatccctatatgccgtcagtcatagagaaaatggaggcactgcagagaaagtacgggggagccttggtgaggaaccctctgtcccggaatagtacacacgagatgtactgggtaagcaacgctactggcaatattgtgtcttccgttaacatgatctcacgcatgctcatcaatagatttaccatgaaacacaagaaagccacatatgaaccagacgtggatttaggcagcgggactaggaacattggaatagagtcggaaatccccaacctggacattatcggtaagcgaattgagaagatcaaacaggaacatgagacctcttggcactacgaccaagatcatccttataagacatgggcataccacggcagttatgagaccaaacagactgggtccgccagctcaatggtcaatggagtggtccggcttctgacgaagccatgggacgtggttcccatggtaacacagatggctatgaccgatactaccccgttcggccagcaacgtgtgtttaaagaaaaggtcgacacaagaacgcaggagcctaaggaaggtaccaaaaagctaatgaaaataactgcggagtggctctggaaggagctggggaaaaagaaaacaccccgcatgtgtaccagggaagagttcactcggaaggtgagatccaacgccgcattgggagctatctttacagatgaaaataagtggaaatctgcccgcgaggcagttgaagacggcaggttctgggagctggtggatcgagagcggaacctccaccttgaaggcaagtgcgagacctgtgtctacaatatgatggggaaaagagaaaagaaactgggagagtttggtaaggccaagggcagcagggctatttggtatatgtggttaggggcccgcttcctggaatttgaggcgttgggattcctcaacgaggaccattggtttagtcgtggcaattccctgagcggtgtggaaggggagggactacaccggcttggctacatcctgagagatgtatctaaaaaggaaggcggggcaatgtacgccgacgatacagctggatgggacactaggattaccctcgaggacctgaaaaacgaagagatggtgacgaatcatatgaagggtgagcacaaaaagttggccgaagcaatcttcaagctgacctatcagaacaaagttgtccgcgtgcagcgaccaacacctcggggcattgtgatggatataatctcaagaagggaccaacgcgggagtggacaggtcggcacttacggtctcaatacctttacaaacatggaggctcagcttattagacaaatggaaggggagggaatcttcaagtccatccagcatctgactgccgctgaggaaattgttgtgcagaattggttagcccgggtaggcagggagcgtctgagccgaatggcaatatctggcgatgactgcgtggtcaaacccatcgatgaccgcttcgcgtcggccttgaccgctctcaacgatatggggaaggtgagaaaagacattcagcaatgggaaccatcacggggatggaatgattggacgcaggttcccttttgcagccaccacttccatgagctggtgatgaaggacggtagggtcctagtggtaccttgtcgcaaccaggatgaacttatcggcagagcccggatttcccagggggcaggatggagtctgaaggagacagcttgcctcggcaaatcttatgcccaaatgtggaccctgatgtactttcacaggcgagacttgcgtttagcagccaacgcgatctgtagcgctgttccatcccattgggtgccgacttcaagaacaacctggagtatacacgccaagcacgagtggatgactaccgaagatatgctggcagtctggaatcgcgtgtggatccaggagaacccctggatggaagacaaaacacctgtggagtcttgggaagaggtcccatatctcggtaagcgggaggaccagtggtgcgggagccttattggactgacgtccagggccacctgggctaaaaatatccagactgccattaaccaagttagatcactaatcggcaatgaagagtacacagattatatgcccagcatgaagcgcttccggagggaagaggaagaggcaggcgtgctgtggtga

SEQ ID NO: 14571 - RNA, 9876 nt, synthetic construct
  misc_feature 1..9876: note = derived and/or modified CDS sequence (opt3) from DENV-2__KC294207__SS-prME
  source 1..9876: mol_type = other RNA
accgccggcgtgatcgtcatgctgattcccacagctatggcattccacctcactacgcggaatggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagacccggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctactgtatgtgcactggaaagttcaagatcgtcaaagaaatcgctgagacccagcacggcacgattgtgatcagagtacagtatgagggtgacgggagtccatgtaagattcccttcgaaataaccgatttggagaaaaggcatgttctcggccggctgatcacagtgaacccgattgtcactgaaaaggactctcctgtgaacatcgaggccgaacccccatttggagattcctacatcattgtcggcgtggagcctgggcagttaaaactgaattggttcaagaagggaagctcgataggtcaaatgtttgagaccacaatgcgaggcgctaaacgcatggccatcctaggggacactgcatgggatttcggatctctcggcggtgtttttacctccattgggaaggccctgcaccaggtgttcggcgctatctacggagcggcattttcaggcgtaagttggacgatgaaaattcttatcggggtcataatcacatggattggaatgaacagcagatccacctctttgagcgtgtcactggttctcgtgggcgtcgtgactctgtatcttggtgccatggtacaggctgacagtgggtgcatcgtgtcctggaagaataaagaactgaagtgtggaagcggcattttcatcacagataacgttcacacctggactgagcagtacaagtttcaacccgaatctccatcaaaattggccagtgcaatacagaaggcccatgaggaaggtatttgcggcatcaggagcgtcacccggctcgagaatctgatgtggaaacagattacacccgagttaaaccacatcctgtccgaaaatgaggtgaagctaacgataatgaccggggacatcaaaggaattatgcaggctggcaagcgctctctcagacctcaaccaactgaactgaaatattcgtggaagacatgggggaaggccaaaatgcttagcaccgagtcccataaccagacattcttgatcgatggaccggaaactgcagagtgtcccaataccaacagggcgtggaactcactggaggtggaagactacggctttggtgtcttcacgacaaacatttggctcaagctgcgtgagaaacaggacgtattttgcgatagtaagttaatgtctgctgccatcaaagacaatcgggcagtgcacgccgatatggggtattggatagaaagcgctctgaacgacacctggaagatggagaaggcctccttcattgaggtgaaatcatgtcactggcctaagagccatactctttggtctaatggagtattggaatccgagatgatcatccccaagaatttcgcaggccccgtcagtcagcacaactaccgacctggttatcatacccaaacagctggcccagggcacctcggaaagctggaaatggattttgacctatgcgagggcactaccgtggttgtgacagaagattgcgggaatagaggacccagcctgaggacgaccactgcctctggcaaactcattacagagtggtgttgccgctcctgtaccctgccgcctcttcggtacagaggtgaggacgggtgctggtacggaatggaaatcaggccattgaaggagaaggaagagaacctggtcaattcattagtgactgcgggccatggtcagattgataacttcagtctcggcgttctggggatggccctttttctggaagagatgttgcgcacacgagtgggaaccaaacacgctatactcctggtagcactgagcttcgtcacgttaatcactggcaatatgtcgtttcgggacctcgggcgtgtgatggtgatggtcggagccaccatgacagatgacattggcatgggtgttacctatctggctcttttggccgcattcaaggtgagacccacttttgcggccgggctgttactcaggaaactgacatccaaggagcttatgatggctaccatcggaattgccctgctatctcagagcacactccctgaaactatcctggagttgaccgatgcactggctttaggcatgatggccctcaaaatagtacgcaacatggaaaagtaccaactggcagtgacgatcatggccatttcatgtgtccccaatgctgtgatccttcagaacgcgtggaaggttagttgcacaattctggccgcagtgtccgtctctccattgctcctgaccagctcccagcagaaagctgactggatccctctagccctgactataaagggccttaatcccaccgccattttcctcacaactctgtcacggaccagcaaaaagagaagttggccattgaacgaggctatcatggcagtggggatggtttctatcctggcctccagcttactcaaaaatgacattccgatgacgggacctctggtggcgggtggccttctgacagtctgttatgtattgaccgggaggtcggctgatctcgaactggagcgagccgcagacgtgaagtgggaggatcaagccgaaatatcaggatctagtcccatcctatccattactatcagcgaggacggctctatgagcattaaaaacgaagaggaggaacagacactgaccatccttatacgcactggtctcctggttatctccggggtgtttccagtctcaattcccatcacagctgcagcctggtacttgtgggaggtgaagaagcagcgggcgggagtattatgggatgtgcctagtccaccccctgtcggcaaagctgaactggaggacggcgcctatagaattaagcagagggggatcctcggatacagccaaataggtgcaggcgtttataaagaagggaccttccacacgatgtggcatgtgactcgtggagccgtgctgatgcaccgcggcaagcggattgagccgtcttgggctgatgtcaaaaaggaccttatctcctacggtgggggatggaagctggagggcgaatggaaagagggcgaagaggtgcaggttttggccctagaaccagggaagaatcccagagcagtacagaccaaacctggaatctttaagacaaacaccggtacaattggcgctgtgtcactggatttcagtccagggactagcggatcccccatcgtcgacaggaaaggcaaggtggttggtctctacgggaatggagtggtcacccgatctggcgcctatgtgtcggcgatagcccagacggaaaagagcattgaggataaccctgaaatcgaggacgatatttttcggaaaaagcgcctgacaatcatggaccttcatccgggcgcagggaaaactaagagatacttacccgctatagtaagggaagccattaaacggggactgcgaaccctcatcttggctccaacaagagtcgtggcagccgagatggaagaggccctgcgcggtctccctatcaggtatcaaacccccgctattcgtgcggagcacactggccgggaaatcgttgacctgatgtgccatgcaaccttcacaatgagacttctgtcaccagtgagggtccctaactacaatttgattataatggatgaggcccacttcacggaccccgcttccatcgccgcacgcgggtatattagtactcgagtggaaatgggagaggccgctggcatctttatgaccgcgacaccaccgggttctagagatcctttcccccagagcaacgccccaatcatggacgaggaacgggagattcccgaaaggtcctggaactcagggcacgagtgggttaccgattttaagggaaagactgtgtggttcgtcccttctataaaagcaggcaacgacatcgctgcctgtctacgcaagaatggcaaaaaggtgattcagctgagccgtaaaacatttgatagtgaatacgtaaagaccagagcaaacgactgggatttcgtggttacgactgacatctccgagatgggggccaattttaaggctgagcgggtcattgatccaaggcgctgcatgaaacccgtgatcctcacagacggagaagaacgagtgatattagccggtcctatgccggtcacccatagctctgcggcacaaagacggggcaggatcgggcgcaacccaaagaatgaaaacgaccagtatatttacatgggagagcccctggaaaatgatgaggactgtgcccactggaaagaggctaagatgcttctggataacatcaatacccctgaaggcattatcccctcaatgttcgagccagaaagagagaaagtagacgccatagatggtgaatacaggctcagaggggaagctcgtaagacttttgtggacttgatgcgccgaggcgatctgcctgtttggctcgcatataaagtggccgctgagggaattaactacgccgacagaaagtggtgcttcgatggcatcaagaataaccagattctggaagagaacgtcgaagtggagatctggacaaaagagggggaaaggaagaaacttaagccccggtggctagacgcacgcatatattccgatccactggcgttgaaagagtttaaggagttcgccgctggaagaaagagtttaaccctgaatctcatcacagagatgggtaggctgcctactttcatgacgcagaaagcccggaacgcacttgacaatctggctgttctccataccgccgaagtgggcgggaaggcatacacacacgccttgagcgagctgccggagactctagaaaccctgctccttctgacattattggctgcggtcaccggaggcatttttctgttcctcatgtcgggtaaaggggtgggcaagatgactctgggaatgtgctgtatcattacggcctctatccttctgtggtatgcacaaatacagccccactggattgctgcctccatcatcctcgagtttttcttgattgtactgttaatcccagaacctgagaaacagcgaaccccacaggataaccaactaacatacgtggttatagccattctgactgtcgtggcagctaccatggccaatgaaatgggctttctcgagaagacaaagaaagaccttgggttcggaagcatcaccactcaggagtcagaaagtaacattctggacatcgatttgagaccagcgtctgcttggacactgtatgccgtggcaacgacctttgtcactcctatgctccgccattccatagagaatagctcagttaacgtgagtctgacagccatcgctaatcaggcaaccgtacttatgggtctcggcaaggggtggcccctgagcaaaatggacattggagtgccgttgctggccatcggctgctactcccaggtcaacccaattaccttaacagcggctctactgctccttgtggcccactacgcaatcattggtcctgggctgcaagccaaggctactagggaagcccagaaacgggcagctgccggcatcatgaagaatcccacggttgatggaataaccgtgattgacttggagccaatcccctatgatcctaagttcgaaaaacagctgggccaggtcatgctcctgatcctttgtgtaacacaagtgttaatgatgcgtactacctgggcgctgtgcgaggccctcacattggcaaccgggccgatttctactctgtgggagggaaaccccggcagattttggaatacgacaatagctgttagcatggccaacatcttcaggggttcctacctagcaggggctggactgctcttttcaattatgaagaataccactaacacccgccggggcacaggtaatgtgggcgaaactcttggggagaaatggaagtctcgactgaacgccttgggaaaaagtgagttccagatctataagaaatcgggcattcaggaggtcgacagaaccctggccaaggaggggatcaagaggggagaaacagatcatcacgcggtgagccgcggctccgctaaactccggtggtttgtcgagagaaacatggtgacgccagaaggtaaggttgtggacctggggtgtggacgtggcggttggtcttactattgcggcgggctaaagaatgtaagggaggtgaaaggacttaccaaaggcgggcctggacatgaagaacccatacctatgtcaacttacggctggaacctggtccggctccaaagcggtgttgatgtgttcttcacaccacccgagaagtgtgacaccctactgtgcgatatcggggaatccagtcctaatccaactattgaggcaggacgcacattgcgagtcctgaacctcgtggaaaattggcttaacaataacacccagttttgtatcaaggtactgaatccctatatgccgtctgtgattgagaaaatggaaacgttgcagagaaagtacggcggcgccctggttaggaaccctctcagcagaaattcaacccacgagatgtactgggtgtccaacgctacagggaatatcgtcagtagcgtgaacatgatatctcgcatgttaattaatagattcactatgaaacacaagaaagccacctatgagccagacgtcgatctgggatccggtacaaggaacatcggcatcgaatcagagattcccaaccttgacatagtggggaagcgaatcgaaaagattaaacaggagcatgaaactagctggcactacgaccaagatcatccttataagacctgggcataccacggatcgtatgagacaaaacagaccggctctgccagttccatggttaatggtgtagtgcggctgctaactaagccatgggacgtcgtgcccatggttacgcagatggctatgacagataccactccgtttgggcagcaacgtgtgttcaaagagaaggtcgacaccagaacacaggaacctaaggagggaacgaaaaagctcatgaaaatcaccgcggaatggctgtggaaggagttgggcaaagagaagactccccgcatgtgcacaagggaagagtttacccggaaagtgagaagcaacgccgcactgggcgctgtattcactgatgaaaataagtggaagtcagcccgcgaggcagtggaagacgggaggttttgggagctcgttgatcgagagcggaaccttcacctggaaggaaaatgtgagacatgcgtctacaatatgatgggtaagagagagaaaaagttaggcgagttcgggaaagccaagggatccagggctatttggtatatgtggctgggcgcccgctttttggagttcgaggcgctcggttttctgaacgaggaccattggttctctcgtgggaatagcctaagtggagtggaaggcgagggccttcaccggctggggtacatcctcagagaagtgggaaagaaagagggtggcgcaatgtacgccgatgacaccgctgggtgggatacaaggataactctggaagacttgaagaacgaggagatggtcaccaatcatatgaaaggagaacacaagaaactggccgaggcaatctttaagctcacgtatcagaacaaggttgtgcgcgtacagcgaccaacccctcggggcacagtgatggacattatctccagaaaagatcaaaggggtagcgggcaggtcggaacttacggccttaataccttcacaaacatggaagctcagctgattcgccaaatggagggcgaggggatcttcaagtctattcagcatttaactgccaccgaagagatagctgtgcagaattggctggccagagttggacgggaaaggttgtcacgtatggcaatcagtggtgacgattgcgtggtcaaacccattgacgatcgatttgcgtccgccctcacggctctgaacgacatgggcaaggtgcgcaaagatatccagcaatgggagccaagcagagggtggaatgactggacacaggtacccttctgttctcaccactttcatgagctagttatgaaggatggacgggtgcttgtcgtgccttgcaggaaccaggacgagctgatcggccgcgccagaatttcgcagggtgcagggtggtcactcaaggagaccgcttgtctgggaaaaagctatgcccaaatgtggactttgatgtacttccaccggagggatttacgactggcagccaacgcgatatgctccgctgtgccaagtcattgggtcccgacatctcgtaccacttggagcatccacgccaagcacgaatggatgaccacagaggacatgctcgttgtgtggaatagagtatggattcaggaaaacccctggatggaggataaaacgcctgtggaatcctgggaggaggtcccatatcttggcaagcgcgaagaccagtggtgtggctcactgatcgggctaaccagtcgggcaacttgggccaaaaatattcagacagctatcaaccaagtgaggtctctgataggaaatgagggttacaccgactatatgcccagcatgaagagatttcgccgggaagaggaagaggccggcgttctctggtga

SEQ ID NO: 14572 - RNA, 9876 nt, synthetic construct
  misc_feature 1..9876: note = derived and/or modified CDS sequence (opt3) from DENV-2__KC294208__SS-prME
  source 1..9876: mol_type = other RNA
accgcaggcgtgatcgtcatgctgattcccacagctatggcattccacctcactacgaggaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccattactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgtattttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatgatcatccccaagaatttcgcaggccccgtcagccagcacaactaccgacctggttatcatacccaaacagctggcccatggcacctcgggaagctggaaatggattttgacttctgtgagggaactaccgtggttgtgacagaagattgcggcaatagagggccctctctaaggacgaccactgcctccggaaaactgattacagagtggtgctgtcgctcatgcaccctcccgcctctgcggtacagaggcgaggacggttgttggtacgggatggaaatcaggccacttaaggagaaggaagagaacttggtcaatagtctggtgactgcgggacatggccagattgataactttagcttaggtgttctcggcatggccctgttccttgaagagatgctgcgcacacgagtggggaccaaacacgctatattgctcgtagcactgtcgtttgtcacgctaatcactggaaatatgtccttccgggacctgggccgtgtgatggtgatggtcggggccaccatgacagatgacattggaatgggcgttacctatctcgctctgcttgccgcatttaaggtgagacccactttcgcggccggtttgctgttaaggaaactcacatctaaggagctgatgatggctaccatcgggattgcccttctgagccagtcaacactacctgaaactatcctcgagctgaccgatgcattggctctgggaatgatggccttaaaaatagtacgcaacatggaaaagtaccaactcgcagtgacgatcatggccattagttgcgtccccaatgctgtgatcctgcagaacgcgtggaaggtttcctgtacaattcttgccgcagtgtctgtcagcccactgttgctcacctcctcacagcagaaagctgactggatccctctggccctaactataaagggcctgaatcccaccgccatttttcttacaactctcagccggaccagtaaaaagagatcttggccactgaacgaggctatcatggcagtgggcatggtttccatcttggccagctcgctgctaaagaatgacattccgatgacggggcctctcgtggcgggaggtctgcttacagtctgctatgtactgaccggcaggtcagctgatttggaactcgagcgagccgcagacgtgaagtgggaggatcaagccgaaatatctgggagttcccccatcctgagcattactatctctgaggacggaagcatgtccattaaaaacgaagaggaggaacagacactaaccatcctgatacgcactggccttctcgttatctcaggtgtgttcccagtcagtattcccatcacagctgcagcctggtacctgtgggaggtgaagaagcagcgggcgggggtattgtgggatgtgcctagcccaccccctgtcggaaaagctgaattagaggacggcgcctatagaattaagcagaggggcatcctggggtactctcaaataggagccggtgtttataaagaaggcacctttcacacgatgtggcatgtgactcgtggggcagtgctcatgcaccgcggaaagcggattgagccgtcctgggctgatgtcaaaaaggacctgatctcatacggcggtgggtggaaacttgagggagaatggaaagagggcgaagaggtgcaggttctggccttggaaccaggcaagaatcccagagcagtacagaccaaacctgggatcttcaagacaaacaccggaacaattggtgctgtgagtctagattttagcccaggcacttccgggtctcccatcgtcgacaggaaaggaaaggtggttggcctgtacggtaatggggtggtcacccgatcgggagcctatgtgagcgcgatagcccagacggagaagtcaattgaggataaccctgaaatcgaggacgatattttccggaaaaagcgcctcacaatcatggacctgcatccgggcgcaggcaaaactaagagataccttcccgctatagtaagggaagccattaaacgggggttacgaaccctgatcctcgctccaacaagagtcgtggcagccgagatggaagaggccttgcgcggactgcctatcaggtatcaaacccccgctattcgtgcggagcacactggtcgggaaatcgttgacctcatgtgtcatgcaaccttcacaatgagactgctttccccagtgagggtccctaactacaatctgattataatggatgaggcccactttacggaccccgctagtatcgccgcacgcggctatatttctactcgagtggaaatgggggaggccgctggaatcttcatgaccgcgacaccaccgggcagcagagatccttttccccagtccaacgccccaatcatggacgaggaacgggagattcccgaaaggtcatggaactctggtcacgagtgggttaccgatttcaaggggaagactgtgtggtttgtccctagcataaaagcaggaaacgacatcgctgcctgcttgcgcaagaatggcaaaaaggtgattcagctaagtcgtaaaacattcgattccgaatacgtaaagaccagagcaaacgactgggattttgtggttacgactgacatcagcgagatgggcgccaatttcaaggctgagcgggtcattgatccaaggcgctgtatgaaacccgtgatcctgacagacggggaagaacgagtgatactcgccggacctatgccggtcacccattcttcagcggcacaaagacggggtaggatcggccgcaacccaaagaatgaaaacgaccagtatatttacatgggggagcccttagaaaatgatgaggactgcgcccactggaaagaggctaagatgctgcttgataacatcaatacccctgaaggaattatcccctccatgtttgagccagaaagagagaaagtagacgccatagatggcgaatacaggctgcggggtgaggctcgtaagactttcgtggacctcatgcgccgaggggatttgcctgtttggctggcatataaagtggccgctgagggcattaactacgccgacagaaagtggtgttttgatggaatcaagaataaccagattctcgaagagaacgtcgaagtggagatctggacaaaagagggcgaaaggaagaaactgaagccccggtggcttgacgcacgcatatatagtgatccactagcgctgaaagagttcaaggagttcgccgctgggagaaagagcttgaccttaaatctgatcacagagatgggaaggctccctacttttatgacgcagaaagcccggaacgcactggacaatcttgctgttctgcataccgccgaagtgggtggcaaggcatacacacacgccctctcggagttgccggagactctggaaaccctactgctccttacactgttagctgcggtcaccgggggaattttcttgtttctgatgtctggcaaaggtatcgggaagatgactctcggcatgtgctgcattatcacggcctccatactgctttggtatgcacaaattcagccccactggatcgctgccagcatcattctggagttctttctcatcgtgttgctgataccagaacctgagaaacagcgaaccccacaggataaccaattaacatacgtagtgattgccatcctaactgttgtcgcagctaccatggccaatgaaatgggattcctggagaagacaaagaaagacctcggctttgggtcaattaccactcaggagagtgaatctaacatccttgacatagatctgagaccagcgtccgcttggacattgtatgccgtggcaacgaccttcgtgactcctatgctgcgccatagcatcgaaaattcaagtgtcaacgttagcctcacagccattgctaatcaggcaaccgtgctgatgggacttggtaagggctggcccctctccaaaatggacatcggggtaccgctgttggccattggatgttactctcaggtgaacccaatcaccctgacagcggctttactactgctcgtcgcccactacgcaattatcggccctggtcttcaagccaaggctactagggaagcccagaaacgggcagctgccgggataatgaagaatcccacggtggatggcattaccgttatcgacctggagccaatcccctatgatcctaagtttgaaaaacagttgggacaggtgatgctgctcattctgtgcgtcacacaagtacttatgatgcgtactacctgggcgttatgtgaggccctgacactcgcaaccggcccgataagcactttgtgggagggggaccccggaagattctggaacacgacaatcgctgtgtccatggccaatatttttaggggctcatacctggccggtgctgggctactgttctctatcatgaagaacaccactaatacccgccggggaacaggcaacgttggtgaaactctcggcgagaaatggaagagtcgacttaatgccctggggaaatcggaatttcagatttataagaaaagcggaatccaggaggtggatagaaccttggccaaggagggcataaagagaggggaaacagaccatcacgcggtctcccgcggatctgctaaactgcggtggttcgtggagagaaacatggtcacgccagaaggcaaggtggttgatctcggttgcgggcgtggaggctggtcatactattgtggtggcctgaaaaacgtgagggaggtaaaggggttaaccaaaggaggccctgggcatgaggaacccatccctatgagcacttacggatggaatcttgtgcggctgcaatccggcgtcgacgttttctttacaccacccgagaagtgcgataccctcctatgtgacattggtgaaagttctcctaacccaactatcgaggcagggcgcacactgcgagtgttgaatctggtcgaaaactggctcaataacaatacccagttctgcattaaggtgcttaacccctatatgccgagcgtaatcgagaaaatggaaacgctgcagagaaagtacggaggcgccttggtgaggaatcctctgtcacggaactccacccacgagatgtactgggttagtaatgctacaggcaacatagtgagctctgtcaatatgatttcccgcatgctcatcaacagatttactatgaaacacaagaaagccacctatgagccagatgtggacttagggtcaggaacaaggaatatcggtattgaaagcgagatacccaacctggacatcgtcggcaagcgaattgaaaagatcaaacaggagcatgaaacttcgtggcactacgatcaagaccatccttataagacctgggcataccacgggtcttatgagacaaaacagaccggaagtgcctccagcatggtgaacggcgttgtacggcttctgactaagccatgggatgtggtccccatggtgacgcagatggctatgacagacaccactccgttcggtcagcaacgtgtttttaaagagaaggtggataccagaacacaggaacctaaggaggggacgaaaaagctaatgaaaattaccgcggaatggctctggaaggagctgggaaaagagaagactccccgcatgtgtacaagggaagagttcacccggaaagtcagatcaaatgccgcattgggcgctgtgtttactgacgaaaacaagtggaagtccgcccgcgaggcagtagaagatggcaggttctgggagctggtggaccgagagcggaatctccaccttgaagggaaatgcgagacatgtgtttacaacatgatgggaaagagagagaaaaagctgggtgagtttggcaaagccaaggggtctagggctatctggtatatgtggttaggagcccgcttcctggaatttgaggcgttgggcttcctcaatgaggatcattggtttagccgtggtaacagtctgtccggggtcgaaggagagggcctacaccggcttggctacatactgagagaagtggggaagaaagagggaggtgcaatgtacgccgacgataccgctggctgggacacaaggatcactctcgaagacctgaagaatgaggagatggtgaccaaccatatgaaaggggaacacaagaaattggccgaggcaattttcaagctgacgtatcagaataaggtcgttcgcgtgcagcgaccaacccctcggggaacagtaatggatatcattagcagaaaagaccaaaggggctctggtcaggtggggacttacggactcaacaccttcacaaatatggaagctcagcttatccgccaaatggagggcgagggcatttttaagtcaatacagcatctgactgccaccgaagagatcgctgtccagaactggttagccagagtggggcgggaaaggctgagtcgtatggcaatttccggagatgactgcgttgtgaaacccatcgatgaccgattcgcgagcgccttgacggctctcaatgatatgggtaaggtccgcaaagacatccagcaatgggagccatctagaggctggaacgattggacacaggtgcccttttgctcgcaccacttccatgaactggtaatgaaggacgggcgggttctagtggtcccttgtaggaatcaggatgagcttattggacgcgccagaatatcacagggcgcaggttggagcctgaaggagaccgcttgcctcgggaaatcctatgcccaaatgtggactctgatgtactttcaccggagggacttgcgattagcagccaacgcgatctgtagtgctgtgccatctcattgggtgccgacaagccgtaccacttggtccattcacgccaagcacgaatggatgaccacagaggatatgctggtcgtttggaacagagtgtggatccaggaaaatccctggatggaggacaaaacgcctgtagaatcatgggaggaggtgccatatctcggaaagcgcgaagaccagtggtgcggcagtcttattggcctgacctctcgggcaacttgggccaaaaacatccagacagctataaatcaagtcaggagcctaatcgggaacgagggatacaccgattatatgccctccatgaagagattccgccgggaagaggaagaggccggtgtgctgtggtga

SEQ ID NO: 14573 - RNA, 9876 nt, synthetic construct
  misc_feature 1..9876: note = derived and/or modified CDS sequence (opt3) from DENV-2__KC294209__SS-prME
  source 1..9876: mol_type = other RNA
accgcaggagtgatcgtcatgctgattcccacagctatggcattccacctcactacgaggaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccattactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagacccggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgtattttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatgatcatccccaagaatttcgcaggccccgtcagccagcacaactaccgacctggttatcatacccaaacagctggcccatggcacctcgggaagctggaaatggattttgacttctgtgagggaactaccgtggttgtgacagaagattgcggcaatagagggccctctctaaggacgaccactgcctccggaaaactgattacagagtggtgctgtcgctcatgcaccctcccgcctctgcggtacagaggcgaggacggttgttggtacgggatggaaatcaggccacttaaggagaaggaagagaacttggtcaatagtctggtgactgcgggacatggccagattgataactttagcttaggtgttctcggcatggccctgttccttgaagagatgctgcgcacacgagtggggaccaaacacgctatattgctcgtagcactgtcgtttgtcacgctaatcactggaaatatgtccttccgggacctgggccgtgtgatggtgatggtcggggccaccatgacagatgacattggaatgggcgttacctatctcgctctgcttgccgcatttaaggtgagacccactttcgcggccggtttgctgttaaggaaactcacatctaaggagctgatgatggctaccatcgggattgcccttctgagccagtcaacactacctgaaactatcctcgagctgaccgatgcattggctctgggaatgatggccttaaaaatagtacgcaacatggaaaagtaccaactcgcagtgacgatcatggccattagttgcgtccccaatgctgtgatcctgcagaacgcgtggaaggtttcctgtacaattcttgccgcagtgtctgtcagcccactgttgctcacctcctcacagcagaaagctgactggatccctctggccctaactataaagggcctgaatcccaccgccatttttcttacaactctcagccggaccagtaaaaagagatcttggccactgaacgaggctatcatggcagtgggcatggtttccatcttggccagctcgctgctaaagaatgacattccgatgacggggcctctcgtggcgggaggtctgcttacagtctgctatgtactgaccggcaggtcagctgatttggaactcgagcgagccgcagacgtgaagtgggaggatcaagccgaaatatctgggagttcccccatcctgagcattactatctctgaggacggaagcatgtccattaaaaacgaagaggaggaacagacactaaccatcctgatacgcactggccttctcgttatctcaggtgtgttcccagtcagtattcccatcacagctgcagcctggtacctgtgggaggtgaagaagcagcgggcgggggtattgtgggatgtgcctagcccaccccctgtcggaaaagctgaattagaggacggcgcctatagaattaagcagaggggcatcctggggtactctcaaataggagccggtgtttataaagaaggcacctttcacacgatgtggcatgtgactcgtggggcagtgctcatgcaccgcggaaagcggattgagccgtcctgggctgatgtcaaaaaggacctgatctcatacggcggtgggtggaaacttgagggagaatggaaagagggcgaagaggtgcaggttctggccttggaaccaggcaagaatcccagagcagtacagaccaaacctgggatcttcaagacaaacaccggaacaattggtgctgtgagtctagattttagcccaggcacttccgggtctcccatcgtcgacaggaaaggaaaggtggttggcctgtacggtaatggggtggtcacccgatcgggagcctatgtgagcgcgatagcccagacggagaagtcaattgaggataaccctgaaatcgaggacgatattttccggaaaaagcgcctcacaatcatggacctgcatccgggcgcaggcaaaactaagagataccttcccgctatagtaagggaagccattaaacgggggttacgaaccctgatcctcgctccaacaagagtcgtggcagccgagatggaagaggccttgcgcggactgcctatcaggtatcaaacccccgctattcgtgcggagcacactggtcgggaaatcgttgacctcatgtgtcatgcaaccttcacaatgagactgctttccccagtgagggtccctaactacaatctgattataatggatgaggcccactttacggaccccgctagtatcgccgcacgcggctatatttctactcgagtggaaatgggggaggccgctggaatcttcatgaccgcgacaccaccgggcagcagagatccttttccccagtccaacgccccaatcatggacgaggaacgggagattcccgaaaggtcatggaactctggtcacgagtgggttaccgatttcaaggggaagactgtgtggtttgtccctagcataaaagcaggaaacgacatcgctgcctgcttgcgcaagaatggcaaaaaggtgattcagctaagtcgtaaaacattcgattccgaatacgtaaagaccagagcaaacgactgggattttgtggttacgactgacatcagcgagatgggcgccaatttcaaggctgagcgggtcattgatccaaggcgctgtatgaaacccgtgatcctgacagacggggaagaacgagtgatactcgccggacctatgccggtcacccattcttcagcggcacaaagacggggtaggatcggccgcaacccaaagaatgaaaacgaccagtatatttacatgggggagcccttagaaaatgatgaggactgcgcccactggaaagaggctaagatgctgcttgataacatcaatacccctgaaggaattatcccctccatgtttgagccagaaagagagaaagtagacgccatagatggcgaatacaggctgcggggtgaggctcgtaagactttcgtggacctcatgcgccgaggggatttgcctgtttggctggcatataaagtggccgctgagggcattaactacgccgacagaaagtggtgttttgatggaatcaagaataaccagattctcgaagagaacgtcgaagtggagatctggacaaaagagggcgaaaggaagaaactgaagccccggtggcttgacgcacgcatatatagtgatccactagcgctgaaagagttcaaggagttcgccgctgggagaaagagcttgaccttaaatctgatcacagagatgggaaggctccctacttttatgacgcagaaagcccggaacgcactggacaatcttgctgttctgcataccgccgaagtgggtggcaaggcatacacacacgccctctcggagttgccggagactctggaaaccctactgctccttacactgttagctgcggtcaccgggggaattttcttgtttctgatgtctggcaaaggtgtggggaagatgactctcggcatgtgctgcatcattacggcctccatcctgctttggtatgcacaaatacagccccactggattgctgccagcatcatcctggagttctttctcattgtattgctgatcccagaacctgagaaacagcgaaccccacaggataaccaattaacatacgtggttatagccattctaactgtcgtggcagctaccatggccaatgaaatgggattcctggagaagacaaagaaagacctcggctttgggtcaatcaccactcaggagagtgaatctaacattcttgacatcgatctgagaccagcgtccgcttggacattgtatgccgtggcaacgaccttcgtcactcctatgctgcgccatagcatagaaaattcaagtgttaacgtgagcctcacagccatcgctaatcaggcaaccgtactgatgggacttggtaagggctggcccctctccaaaatggacattggggtgccgctgttggccatcggatgttactctcaggtcaacccaattaccctgacagcggctttactactgctcgtggcccactacgcaatcattggccctggtcttcaagccaaggctactagggaagcccagaaacgggcagctgccgggatcatgaagaatcccacggttgatggcataaccgtgattgacctggagccaatcccctatgatcctaagtttgaaaaacagttgggacaggtcatgctgctcatcctgtgcgtaacacaagtgcttatgatgcgtactacctgggcgttatgtgaggccctgacactcgcaaccggcccgattagcactttgtgggaggggaaccccggaagattctggaatacgacaatagctgtttccatggccaacatctttaggggctcatacctggccggtgctgggctactgttctctattatgaagaataccactaacacccgccggggaacaggcaatgtgggtgaaactctcggcgagaaatggaagagtcgacttaacgccctggggaaatcggaatttcagatctataagaaaagcggcattcaggaggtcgacagaaccttggccaaggagggcatcaagagaggggaaacagatcatcacgcggtgtcccgcggatctgctaaactgcggtggttcgtcgagagaaacatggtgacgccagaaggcaaggttgtggacctcggttgcgggcgtggaggctggtcatactattgtggtggcctgaaaaatgtaagggaggtgaaggggttaaccaaaggaggccctgggcatgaggaacccatacctatgagcacttacggatggaaccttgtccggctgcaatccggcgttgatgtgttctttacaccacccgagaagtgcgacaccctcctatgtgatatcggtgaaagttctcctaatccaactattgaggcagggcgcacactgcgagtcttgaacctggtggaaaattggctcaacaataacacccagttctgcatcaaggtacttaatccctatatgccgagcgtgattgagaaaatggaaacgctgcagagaaagtacggaggcgccttggttaggaaccctctgtcaagaaattccacccacgagatgtactgggtgagtaacgctacaggcaatatcgtcagctctgtgaacatgatatcccgcatgctcattaatagatttactatgaaacacaagaaagccacctatgagccagacgtcgatttagggtcaggaacaaggaacatcggtatcgaaagcgagattcccaacctggacatagtgggcaagcgaatcgaaaagattaaacaggagcatgaaacttcgtggcactacgaccaagatcatccttataagacctgggcataccacgggtcttatgagacaaaacagaccggaagtgcctccagcatggttaatggcgtagtgcggcttctgactaagccatgggacgtcgtgcccatggttacgcagatggctatgacagataccactccgttcggtcagcaacgtgtgtttaaagagaaggtcgacaccagaacacaggaacctaaggaggggacgaaaaagctaatgaaaatcaccgcggaatggctctggaaggagctgggaaaagagaagactccccgcatgtgtacaagggaagagttcacccggaaagtgagatcaaacgccgcattgggcgctgtatttactgatgaaaataagtggaagtccgcccgcgaggcagtggaagacggcaggttctgggagctggttgatcgagagcggaacctccaccttgaagggaaatgcgagacatgtgtctacaatatgatgggaaagagagagaaaaagctgggtgagtttggcaaagccaaggggtctagggctatttggtatatgtggttaggagcccgcttcctggaatttgaggcgttgggcttcctcaacgaggaccattggtttagccgtggtaatagtctgtccggggtggaaggagagggcctacaccggcttggctacatcctgagagaagtggggaagaaagagggaggtgcaatgtacgccgatgacaccgctggctgggatacaaggataactctcgaagacctgaagaacgaggagatggtcaccaatcatatgaaaggggaacacaagaaattggccgaggcaatcttcaagctgacgtatcagaacaaggttgtgcgcgtacagcgaccaacccctcggggaacagtgatggacattatcagcagaaaagatcaaaggggctctggtcaggtcgggacttacggactcaataccttcacaaacatggaagctcagcttattcgccaaatggagggcgagggcatctttaagtcaattcagcatctgactgccaccgaagagatagctgtgcagaattggttagccagagttgggcgggaaaggctgagtcgtatggcaatctccggagacgattgcgtggtcaaacccattgacgatcgattcgcgagcgccttgacggctctcaacgacatgggtaaggtgcgcaaagatatccagcaatgggagccatctagaggctggaatgactggacacaggtacccttttgctcgcaccacttccatgaactggttatgaaggatgggcgggtgctagtcgtgccttgtaggaaccaggacgagcttatcggacgcgccagaatttcacagggcgcaggttggagcctgaaggagaccgcttgcctcgggaaatcctatgcccaaatgtggactctgatgtactttcaccggagggatttgcgattagcagccaacgcgatatgtagtgctgtgccatctcattgggtcccgacaagccgtaccacttggtccatccacgccaagcacgaatggatgaccacagaggacatgctggttgtgtggaatagagtatggattcaggaaaacccctggatggaggataaaacgcctgtggaatcatgggaggaggtcccatatctcggaaagcgcgaagaccagtggtgcggcagtcttatcggcctgacctctcgggcaacttgggccaaaaatattcagacagctatcaaccaagtgaggagcctaatagggaatgagggatacaccgactatatgccctccatgaagagattccgccgggaagaggaagaggccggtgttctgtggtga

SEQ ID NO: 14574 - RNA, 9876 nt, synthetic construct
  misc_feature 1..9876: note = derived and/or modified CDS sequence (opt3) from DENV-2__KC294214__SS-prME
  source 1..9876: mol_type = other RNA
accgcaggcgtgatcgtcatgctgattcccacagctatggcattccacctcactacgagaaatggggagcctcatatgatagttggaaggcaggaaaagggtaagagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtggacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaggaataaggaactgaaatgcggatctggcattttcatcacagataacgttcacacctggactgagcagtacaagtttcaacccgaatcaccaagtaagttggccagcgcaatacagaaagcccatgaggaaggtatttgtggcatccggtccgtcacccgcctcgagaatctgatgtggaagcagattacacccgagttaaaccacatcctgtctgaaaatgaggtgaaactaacgataatgaccggggacatcaagggaattatgcaggctggcaaaagatcgctcaggcctcaaccaactgaactgaagtatagctggaaaacatgggggaaggccaagatgctttccaccgagtcacataaccagacattcttgatcgatggaccggaaactgcagagtgccccaataccaaccgtgcgtggaatagtctggaggtggaagactacggctttggtgtcttcacgacaaacatttggctcaaactgcgggagaagcaggacgtattttgtgattctaaattaatgagcgctgccatcaaggacaatcgagcagtgcacgccgatatggggtattggatagaatccgctctgaacgacacctggaaaatggagaaggcctcattcattgaggtaaagagctgccactggcctaaatctcatactctttggtccaatggagtattggaaagtgagatgatcatcccaaagaacttcgcaggccccgtcagccagcacaactacagacctggttatcatacccaaacagctggcccatggcacctcgggaaactggaaatggattttgacttctgtgagggaactaccgtggttgtgacagaagattgcggcaatagggggccctctctacgcacgaccactgcctccggaaagctgattacagagtggtgctgtcggtcatgcaccctcccgcctctgagatacaggggcgaggacggttgttggtacgggatggaaatccgcccacttaaagagaaggaagagaacttggtcaatagtctggtgactgcgggacatggccagattgataactttagcttaggtgttctcggcatggccctgttccttgaagagatgctgcgaacacgggtggggaccaagcacgctatattgctcgtagcactgtcgtttgtcacgctaatcactggaaatatgtccttccgtgacctgggcagagtgatggtgatggtcggggccaccatgacagatgacattggaatgggcgttacctatctcgctctgcttgccgcatttaaagtgaggcccactttcgcggccggtttgctgttacgcaagctcacatctaaagagctgatgatggctaccatcgggattgcccttctgagccagtcaacactacctgaaactatcctcgagctgaccgatgcattggctctgggaatgatggccttaaagatagtacggaacatggaaaaataccaactcgcagtgacgatcatggccattagttgcgtccccaatgctgtgatcctgcagaacgcgtggaaggtttcctgtacaattcttgccgcagtgtctgtcagcccactgttgctcacctcctcacagcagaaggctgactggatccctctggccctaactataaaaggcctgaatcccaccgccatttttcttacaactctcagcagaaccagtaagaaaaggtcttggccactgaacgaggctatcatggcagtgggcatggtttccatcttggccagctcgctgttaaagaatgacattccgatgacggggcctctcgtggcgggaggtctgcttacagtctgctatgtactgaccggccgatcagctgatttggaactcgagcgcgccgcagacgtgaaatgggaggatcaagccgaaatatctgggagttcccccatcctgagcattactatctctgaggacggaagcatgtccattaagaacgaagaggaggaacagacactaaccatcctgatacggactggccttctcgttatctcaggtgtgttcccagtcagtattcccatcacagctgcagcctggtacctgtgggaggtgaaaaagcagagagcgggggtattgtgggatgtgcctagcccaccccctgtcggaaaggctgaattagaggacggcgcctataggattaaacagcgtggcatcctggggtactctcaaataggagccggtgtttataaggaaggcacctttcacacgatgtggcatgtgactcgcggggcagtgctcatgcaccggggaaaaagaattgagccgtcctgggctgatgtcaagaaagacctgatctcatacggcggtgggtggaaacttgagggagaatggaaggagggcgaagaggtgcaggttctggccttggaaccaggcaaaaatcccagggcagtacagaccaagcctgggatcttcaaaacaaacaccggaacaattggtgctgtgagtctagattttagcccaggcacttccgggtctcccatcgtcgaccgaaagggaaaagtggttggcctgtacggtaatggggtggtcacccggtcgggagcctatgtgagcgcgatagcccagacggagaagtcaattgaggataaccctgaaatcgaggacgatattttccgcaagaaaagactcacaatcatggacctgcatccgggcgcaggcaagactaaaaggtaccttcccgctatagtacgggaagccattaagcgagggttaagaaccctgatcctcgctccaacacgcgtcgtggcagccgagatggaagaggccttgaggggactgcctatccgttatcaaacccccgctattcgggcggagcacactggtagagaaatcgttgacctcatgtgtcatgcaaccttcacaatgaggctgctttccccagtgcgcgtccctaactacaatctgattataatggatgaggcccactttacggaccccgctagtatcgccgcacgaggctatatttctactagagtggaaatgggggaggccgctggaatcttcatgaccgcgacaccaccgggcagccgggatccttttccccagtccaacgccccaatcatggacgaggaaagggagattcccgaacgctcatggaactctggtcacgagtgggttaccgatttcaaagggaagactgtgtggtttgtccctagcataaaggcaggaaacgacatcgctgcctgcttgcgtaaaaatggcaagaaagtgattcagctaagtagaaagacattcgattccgaatacgtaaaaacccgggcaaacgactgggattttgtggttacgactgacatcagcgagatgggcgccaatttcaaggctgagagggtcattgatccacgccgatgtatgaagcccgtgatcctgacagacggggaagagagagtgatactcgccggacctatgccggtcacccattcttcagcggcacaacggaggggtcgcatcggcagaaaccccaagaatgaaaacgaccagtatatttacatgggggagcccttagaaaatgatgaggactgcgcccactggaaggaggctaaaatgctgcttgataacatcaatacccctgaaggaattatcccctccatgtttgagccagaaagggagaaggtagacgccatagatggcgaataccggctgcgtggtgaggctcgcaaaactttcgtggacctcatgcgaagaggggatttgcctgtttggctggcatataaggtggccgctgagggcattaactacgccgacaggaaatggtgttttgatggaatcaagaataaccagattctcgaagagaacgtcgaagtggagatctggacaaaggagggcgaacggaaaaagctgaaaccccgctggcttgacgcaagaatatatagtgatccactagcgctgaaggagttcaaagagttcgccgctgggagaaagagcttgaccttaaatctgatcacagagatgggacggctccctacttttatgacgcagaaggcccgaaacgcactggacaatcttgctgttctgcataccgccgaagtgggtggcaaagcatacacacacgccctctcggagttgccggagactctggaaaccctactgctccttacactgttagctgcggtcaccgggggaattttcttgtttctgatgtctggcaagggtatcgggaaaatgactctcggcatgtgctgcattatcacggcctccatactgctttggtatgcacaaattcagccccactggatcgctgccagcatcattctggagttctttctcatcgtgttgctgataccagaacctgagaagcagagaaccccacaggataaccaattaacatacgtagtgattgccatcctaactgttgtcgcagctaccatggccaatgaaatgggattcctggagaaaacaaagaaggacctcggctttgggtcaattaccactcaggagagtgaatctaacatccttgacatagatctgcgcccagcgtccgcttggacattgtatgccgtggcaacgaccttcgtgactcctatgctgaggcatagcatcgaaaattcaagtgtcaacgttagcctcacagccattgctaatcaggcaaccgtgctgatgggacttggtaaaggctggcccctctccaagatggacatcggggtaccgctgttggccattggatgttactctcaggtgaacccaatcaccctgacagcggctttactactgctcgtcgcccactacgcaattatcggccctggtcttcaagccaaagctactcgggaagcccagaagcgtgcagctgccgggataatgaaaaatcccacggtggatggcattaccgttatcgacctggagccaatcccctatgatcctaagtttgaaaagcagttgggacaggtgatgctgctcattctgtgcgtcacacaagtacttatgatgagaactacctgggcgttatgtgaggccctgacactcgcaaccggcccgataagcactttgtgggaggggaaccccggaaggttctggaatacgacaatcgctgtgtccatggccaacatttttcgcggctcatacctggccggtgctgggctactgttctctatcatgaaaaataccactaacacccggcgaggaacaggcaatgttggtgaaactctcggcgagaagtggaaaagtagacttaacgccctggggaagtcggaatttcagatttataaaaagagcggaatccaggaggtggacaggaccttggccaaagagggcataaagcgcggggaaacagatcatcacgcggtctcccggggatctgctaagctgagatggttcgtggagcgtaacatggtcacgccagaaggcaaagtggttgacctcggttgcgggaggggaggctggtcatactattgtggtggcctgaagaatgtgcgggaggtaaaagggttaaccaagggaggccctgggcatgaggaacccatccctatgagcacttacggatggaaccttgtgcgcctgcaatccggcgtcgatgttttctttacaccacccgagaaatgcgacaccctcctatgtgatattggtgaaagttctcctaatccaactatcgaggcagggcgaacactgagagtgttgaacctggtcgaaaattggctcaacaataacacccagttctgcattaaggtgcttaatccctatatgccgagcgtaatcgagaagatggaaacgctgcagaggaaatacggaggcgccttggtgcggaaccctctgtcacgcaattccacccacgagatgtactgggttagtaacgctacaggcaatatagtgagctctgtcaacatgatttccagaatgctcatcaataggtttactatgaagcacaaaaaggccacctatgagccagacgtggatttagggtcaggaacacgaaacatcggtattgaaagcgagatacccaacctggacatcgtcggcaaacggattgaaaagatcaagcaggagcatgaaacttcgtggcactacgaccaagatcatccttataaaacctgggcataccacgggtcttatgagacaaagcagaccggaagtgcctccagcatggtgaatggcgttgtacgtcttctgactaaaccatgggacgtggtccccatggtgacgcagatggctatgacagataccactccgttcggtcagcaaagagtttttaaggagaaagtggacacccgcacacaggaacctaaggaggggacgaagaaactaatgaagattaccgcggaatggctctggaaagagctgggaaaggagaaaactcccaggatgtgtacacgggaagagttcaccagaaaggtccgctcaaacgccgcattgggcgctgtgtttactgatgaaaataaatggaagtccgccagggaggcagtagaagacggccgattctgggagctggtggatcgggagagaaacctccaccttgaagggaagtgcgagacatgtgtttacaatatgatgggaaaaagggaaaagaaactgggtgagtttggcaaggccaaagggtctcgcgctatctggtatatgtggttaggagcccgtttcctggaatttgaggcgttgggcttcctcaacgaggaccattggtttagccggggtaatagtctgtccggggtcgaaggagagggcctacacagacttggctacatactgagggaagtggggaagaaggagggaggtgcaatgtacgccgatgacaccgctggctgggatacacgcatcactctcgaagacctgaaaaacgaggagatggtgaccaatcatatgaagggggaacacaaaaagttggccgaggcaattttcaaactgacgtatcagaacaaggtcgttcgagtgcagcggccaacccctagaggaacagtaatggacatcattagcaggaaggatcaacgcggctctggtcaggtggggacttacggactcaataccttcacaaacatggaagctcagcttatcagacaaatggagggcgagggcatttttaaatcaatacagcatctgactaccacggaagagatcgccgtccagaattggttagctcgggtggggagggaacgtctgagtcgaatggccatttccggagacgattgcgttgtgaagcccatcgacgatcgcttcgcaagcgcgttgacagccctcaacgacatgggtaaagtcagaaaggatatccagcaatgggagccatctcggggctggaatgactggacccaggtgcccttttgctcgcaccacttccatgaactggtaatgaaagatgggagggttctagtggtcccttgtcgcaaccaggacgagcttattggaagggctcggatatcacagggcgccggttggagcctgaaggagactgcatgcctcgggaagtcctatgctcaaatgtggacactgatgtactttcacaggcgagatttgcgtttagccgcaaacgccatctgtagtgcggtgccatctcattgggtgccgaccagcagaactacctggtccattcacgctaaacacgaatggatgacaacggaggacatgctggtcgtttggaatcgcgtgtggatccaggaaaacccctggatggaggataagacccctgtagaatcatgggaggaggtgccatatctcggaaaacgggaagaccagtggtgcggcagtcttattggcctgacttctagggccacatgggcaaagaatatccagaccgccataaaccaagtcagaagcctaatcgggaatgagggatacactgactatatgccctccatgaaacgcttccggagggaagaggaagaggctggtgtgctgtggtga

SEQ ID NO: 14575 - RNA, 9876 nt, synthetic construct
  misc_feature 1..9876: note = derived and/or modified CDS sequence (opt3) from DENV-2__KC294205__SS-prME
  source 1..9876: mol_type = other RNA
accgcaggcgtgatcgtcatgctgattcccacagctatggcattccacctcactacgaggaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccattactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgtattttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatgatcatccccaagaatttcgcaggccccgtcagccagcacaactaccgacctggttatcatacccaaacagctggcccatggcacctcgggaagctggaaatggattttgacttctgtgagggaactaccgtggttgtgacagaagattgcggcaatagagggccctctctaaggacgaccactgcctccggaaaactgattacagagtggtgctgtcgctcatgcaccctcccgcctctgcggtacagaggcgaggacggttgttggtacgggatggaaatcaggccacttaaggagaaggaagagaacttggtcaatagtctggtgactgcgggacatggccagattgataactttagcttaggtgttctcggcatggccctgttccttgaagagatgctgcgcacacgagtggggaccaaacacgctatattgctcgtagcactgtcgtttgtcacgctaatcactggaaatatgtccttccgggacctgggccgtgtgatggtgatggtcggggccaccatgacagatgacattggaatgggcgttacctatctcgctctgcttgccgcatttaaggtgagacccactttcgcggccggtttgctgttaaggaaactcacatctaaggagctgatgatggctaccatcgggattgcccttctgagccagtcaacactacctgaaactatcctcgagctgaccgatgcattggctctgggaatgatggccttaaaaatagtacgcaacatggaaaagtaccaactcgcagtgacgatcatggccattagttgcgtccccaatgctgtgatcctgcagaacgcgtggaaggtttcctgtacaattcttgccgcagtgtctgtcagcccactgttgctcacctcctcacaccagaaagctgactggatccctctggccctaactataaagggcctgaatcccaccgccatttttcttacaactctcagccggaccagtaaaaagagatcttggccactgaacgaggctatcatggcagtgggcatggtttccatcttggccagctcgctgctaaagaatgacattccgatgacggggcctctcgtggcgggaggtctgcttacagtctgctatgtactgaccggcaggtcagctgatttggaactcgagcgagccgcagacgtgaagtgggaggatcaggccgaaatatctgggagttcccccatcctgagcattactatctctgaggacggaagcatgtccattaaaaacgaagaggaggaacaaacactaaccatcctgatacgcactggccttctcgttatctcaggtgtgttcccagtcagtattcccatcacagctgcagcctggtacctgtgggaggtgaagaagcagcgggcgggggtattgtgggatgtgcctagcccaccccctgtcggaaaagctgaattagaggacggcgcctatagaattaagcagaggggcatcctggggtactctcagataggagccggtgtttataaagaaggcacctttcatacgatgtggcacgtgactcgtggggcagtgctcatgcatcgcggaaagcggattgagccgtcctgggctgatgtcaaaaaggacctgatctcatacggcggtgggtggaaacttgagggagaatggaaagagggcgaagaggtgcaagttctggccttggaaccaggcaagaatcccagagcagtacagaccaaacctgggatcttcaagacaaacaccggaacaattggtgctgtgagtctagattttagcccaggcacttccgggtctcccatcgtcgacaggaaaggaaaggtggttggcctgtacggtaatggggtggtcacccgatcgggagcctatgtgagcgcgatagcccagacggagaagtcaattgaggataaccctgaaatcgaggacgatattttccggaaaaagcgcctcacaatcatggacctgcacccgggcgcaggcaaaactaagagataccttcccgctatagtaagggaagccattaaacgggggttacgaaccctgatcctcgctccaacaagagtcgtggcagccgagatggaagaggccttgcgcggactgcctatcaggtatcagacccccgctattcgtgcggagcatactggtcgggaaatcgttgacctcatgtgtcacgcaaccttcacaatgagactgctttccccagtgagggtccctaactacaatctgattataatggatgaggcccactttacggaccccgctagtatcgccgcacgcggctatatttctactcgagtggaaatgggggaggccgctggaatcttcatgaccgcgacaccaccgggcagcagagatccttttccccaatccaacgccccaatcatggacgaggaacgggagattcccgaaaggtcatggaactctggtcatgagtgggttaccgatttcaaggggaagactgtgtggtttgtccctagcataaaagcaggaaacgacatcgctgcctgcttgcgcaagaatggcaaaaaggtgattcagctaagtcgtaaaacattcgattccgaatacgtaaagaccagagcaaacgactgggattttgtggttacgactgacatcagcgagatgggcgccaatttcaaggctgagcgggtcattgatccaaggcgctgtatgaaacccgtgatcctgacagacggggaagaacgagtgatactcgccggacctatgccggtcacccactcttcagcggcacagagacggggtaggatcggccgcaacccaaagaatgaaaacgaccaatatatttacatgggggagcccttagaaaatgatgaggactgcgcccattggaaagaggctaagatgctgcttgataacatcaatacccctgaaggaattatcccctccatgtttgagccagaaagagagaaagtagacgccatagatggcgaatacaggctgcggggtgaggctcgtaagactttcgtggacctcatgcgccgaggggatttgcctgtttggctggcatataaagtggccgctgagggcattaactacgccgacagaaagtggtgttttgatggaatcaagaataaccagattctcgaagagaacgtcgaagtggagatctggacaaaagagggcgaaaggaagaaactgaagccccggtggcttgacgcacgcatatatagtgatccactagcgctgaaagagttcaaggagttcgccgctgggagaaagagcttgaccttaaatctgatcacagagatgggaaggctccctacttttatgacgcagaaagcccggaacgcactggacaatcttgctgttctgcacaccgccgaagtgggtggcaaggcatacacacacgccctctcggagttgccggagactctggaaaccctactgctccttacactgttagctgcggtcaccgggggaattttcttgtttctgatgtctggcaaaggtatcgggaagatgactctcggcatgtgctgcattatcacggcctccatactgctttggtatgcacagattcaaccccattggatcgctgccagcatcattctggagttctttctcatcgtgttgctgataccagaacctgagaaacagcgaaccccacaggataaccagttaacatacgtagtgattgccatcctaactgttgtcgcagctaccatggccaatgaaatgggattcctggagaagacaaagaaagacctcggctttgggtcaattaccactcaagagagtgaatctaacatccttgacatagatctgagaccagcgtccgcttggacattgtatgccgtggcaacgaccttcgtgactcctatgctgcgccacagcatcgaaaattcaagtgtcaacgttagcctcacagccattgctaatcaggcaaccgtgctgatgggacttggtaagggctggcccctctccaaaatggacatcggggtaccgctgttggccattggatgttactctcaggtgaacccaatcaccctgacagcggctttactactgctcgtcgcccattacgcaattatcggccctggtcttcaggccaaggctactagggaagcccaaaaacgggcagctgccgggataatgaagaatcccacggtggatggcattaccgttatcgacctggagccaatcccctatgatcctaagtttgaaaaacagttgggacaggtgatgctgctcattctgtgcgtcacacaggtacttatgatgcgtactacctgggcgttatgtgaggccctgacactcgcaaccggcccgataagcactttgtgggaggggaaccccggaagattctggaatacgacaatcgctgtgtccatggccaacatttttaggggctcatacctggccggtgctgggctactgttctctatcatgaagaataccactaacacccgccggggaacaggcaatgttggtgaaactctcggcgagaaatggaagagtcgacttaacgccctggggaaatcggaatttcaaatttataagaaaagcggaatccaggaggtggacagaaccttggccaaggagggcataaagagaggggaaacagatcaccatgcggtctcccgcggatctgctaaactgcggtggttcgtggagagaaacatggtcacgccagaaggcaaggtggttgacctcggttgcgggcgtggaggctggtcatactattgtggtggcctgaaaaatgtgagggaggtaaaggggttaaccaaaggaggccctgggcacgaggaacccatccctatgagcacttacggatggaaccttgtgcggctgcagtccggcgtcgatgttttctttacaccacccgagaagtgcgacaccctcctatgtgatattggtgaaagttctcctaatccaactatcgaggcagggcgcacactgcgagtgttgaacctggtcgaaaattggctcaacaccaatacgcaattctgcattaaggtgcttaacccctatatgccgagcgtaatcgagaaaatggaaaccctgcagagaaagtacggaggcgccttggtgaggaatcctctgtcacggaactccacacacgagatgtactgggttagtaatgctactggcaacatagtgagctctgtcaatatgatttcccgcatgctcatcaacagatttaccatgaaacataagaaagccacatatgagccagacgtggatttagggtcaggaactaggaatatcggtattgaaagcgagatacccaacctggacatcgtcggcaagcgaattgaaaagatcaaacaggagcacgaaacctcgtggcattacgaccaggatcacccttataagacatgggcataccacgggtcttatgagaccaaacaaactggaagtgcctccagcatggtgaacggcgttgtacggcttctgacgaagccatgggacgtggtccccatggtgacacagatggctatgaccgatactaccccgttcggtcagcagcgtgtttttaaagagaaggtggacacaagaacgcaagaacctaaggaggggaccaaaaagctaatgaaaattactgcggaatggctctggaaggagctgggaaaagagaagacaccccgcatgtgtaccagggaagagttcactcggaaagtcagatcaaatgccgcattgggcgctgtgtttacagatgaaaacaagtggaagtccgcccgcgaggcagtagaagacggcaggttctgggagctggtggatcgagagcggaatctccatcttgaagggaaatgcgagacctgtgtttacaacatgatgggaaagagagagaaaaagctgggtgagtttggcaaagccaaggggtctagggctatctggtatatgtggttaggagcccgcttcctggaatttgaggcgttgggcttcctcaatgaggaccactggtttagccgtggtaacagtctgtccggggtcgaaggagagggcctacatcggcttggctacatactgagagaagtggggaagaaagagggaggtgcaatgtacgccgatgacacagctggctgggatactaggatcaccctcgaagacctgaagaatgaggagatggtgacgaaccacatgaaaggggaacataagaaattggccgaggcaattttcaagctgacctatcagaataaggtcgttcgcgtgcagcgaccaacacctcggggaactgtaatggacatcattagcagaaaagatcagaggggctctggtcaagtggggacctacggactcaacacattcactaatatggaagctcagcttatccgccagatggagggcgagggcatttttaagtcaatacaacacctgaccgccacggaagagatcgctgtccagaactggttagccagagtggggcgggaaaggctgagtcgtatggcaatttccggagacgattgcgttgtgaaacccatcgacgatcgattcgcgagcgccttgacagctctcaatgacatgggtaaggtccgcaaagatatccagcagtgggagccatctagaggctggaacgactggacccaagtgcccttttgctcgcaccatttccacgaactggtaatgaaggatgggcgggttctagtggtcccttgtaggaatcaggacgagcttattggacgcgccagaatatcacagggcgcaggttggagcctgaaggagactgcttgcctcgggaaatcctatgcccagatgtggacactgatgtactttcatcggagggatttgcgattagcagccaacgcgatctgtagtgctgtgccatctcactgggtgccgaccagccgtactacctggtccattcacgccaagcatgaatggatgacaacggaggacatgctggtcgtttggaacagagtgtggatccaagaaaatccctggatggaggataaaacccctgtagaatcatgggaggaggtgccatatctcggaaagcgcgaagaccagtggtgcggcagtcttattggcctgacttctcgggcaacatgggccaaaaacatccagaccgctataaatcaggtcaggagcctaatcgggaacgagggatacactgactatatgccctccatgaagagattccgccgggaagaggaagaggccggtgtgctgtggtga

SEQ ID NO: 14576 - RNA, 9876 nt, synthetic construct
  misc_feature 1..9876: note = derived and/or modified CDS sequence (opt3) from DENV-2__KC294210__SS-prME
  source 1..9876: mol_type = other RNA
accgcaggcgtgatcgtcatgctgattcccactgctatggcattccacctcactacgaggaacggggagcctcatatgatagttggaaggcaggaaaagggtaaaagccttctgtttaagaccgaggacggcgtgaatatgtgcaccttgatggcaatcgatttaggggaactgtgtgaggacactattacctacaaatgcccattactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgatgatggagagtagccccaggaccgggcttgatttcaacgaaatggtactgttgcaaatggaggacaaagcatggctcgtgcaccggcagtggtttctggatttacctctgccatggctccccggcgctgacactcagggatctaattggatacagaaggagacacttgtcacgttcaagaaccctcatgccaaaaagcaagacgtggttgtgctgggctcccaggaaggggcgatgcacaccgccttgactggagcaacagagattcagatgtcaagcggtaatctactgtttaccggccatctcaaatgtcgtctgcgcatggataaacttcaactgaaagggatgagttactctatgtgcacaggaaagttcaagatcgtcaaagaaatcgctgagactcagcacggcaccattgtgatcagagtacagtatgagggtgacgggtccccatgtaagattcccttcgaaataacggatttggagaaaaggcatgttctcggccggctgatcaccgtgaacccgattgtcacagaaaaggacagccctgtgaacatcgaggccgaacccccatttggagattcgtacatcattgtcggcgtggagcctgggcagttaaaactgaattggttcaagaagggatcttccataggtcaaatgtttgagactaccatgcgaggcgctaaacgcatggccatcctaggggacacagcatgggatttcggatcactcggcggtgtttttacaagtattgggaaggccctgcaccaggtgttcggcgctatctacggagcggcatttagcggcgtatcctggaccatgaaaattcttatcggggtcataatcacgtggattggaatgaactctagaagcacatcattgagtgtgtccctggttctcgtgggcgtcgtgaccctgtatcttggtgccatggtacaggctgacagcgggtgcatcgtgtcttggaagaataaagaactgaagtgtggatcaggcattttcatcactgataacgttcacacatggaccgagcagtacaagtttcaacccgaaagtccaagcaaattggcctccgcaatacagaaggcccatgaggaaggtatttgcggcatcaggtctgtcactcggctcgagaatctgatgtggaaacagattacccccgagttaaaccacatcctgtcggaaaatgaggtgaagctaacaataatgacgggggacatcaaaggaattatgcaggctggcaagcgcagcctcagacctcaaccaaccgaactgaaatattcctggaagacttgggggaaggccaaaatgctttcaacagagagtcataaccagaccttcttgatcgatggaccggaaacagcagagtgtcccaatactaacagggcgtggaactctctggaggtggaagactacggctttggtgtcttcaccacgaacatttggctcaagctgcgtgagaaacaggacgtattttgcgatagcaagttaatgtccgctgccatcaaagacaatcgggcagtgcacgccgatatggggtattggatagaatcagctctgaacgacacatggaagatggagaaggccagcttcattgaggtgaaatcttgtcactggcctaagtcccataccctttggagtaatggagtattggaaagcgagatgatcatccccaagaatttcgcaggccccgtctctcagcacaactaccgacctggttatcatactcaaaccgctggcccatggcacctcgggaagctggaaatggattttgacttctgcgagggaacaactgtggttgtgaccgaagattgtggcaatagagggccctccctaaggacaacgaccgcctcaggaaaactgattactgagtggtgctgccgcagttgtacactcccgcctctgcggtacagaggcgaggacggttgctggtacgggatggaaatcaggccacttaaggagaaggaagagaacttggtcaatagcctggtgaccgcgggacatggccagattgataacttttcgttaggtgttctcggcatggccctgttccttgaagagatgctgcgcactcgagtggggacaaaacacgctatattgctcgtagcactgtcctttgtcaccctaatcacgggaaatatgtctttccgggacctgggccgtgtgatggtgatggtcggggccactatgaccgatgacattggaatgggcgttacatatctcgctctgcttgccgcatttaaggtgagacccaccttcgcggccggtttgctgttaaggaaactcactagcaaggagctgatgatggctacaatcgggattgcccttctgtcacagagtaccctacctgaaacaatcctcgagctgactgatgcattggctctgggaatgatggccttaaaaatagtacgcaacatggaaaagtaccaactcgcagtgaccatcatggccatttcctgtgtccccaatgctgtgatcctgcagaacgcgtggaaggtttcttgcacgattcttgccgcagtgagcgtctccccactgttgctcacatcaagccagcagaaagctgactggatccctctggccctaaccataaagggcctgaatcccactgccatttttcttaccacactcagtcggacttctaaaaagagatcctggccactgaacgaggctatcatggcagtgggcatggttagcatcttggcctcgtcactgctaaagaatgacattccgatgaccgggcctctcgtggcgggaggtctgcttacggtctgttatgtactgacaggcaggtctgctgatttggaactcgagcgagccgcagacgtgaagtgggaggatcaagccgaaataagtgggtccagccccatcctgtctattaccatcagcgaggacggatccatgtcaattaaaaacgaagaggaggaacagactctaacaatcctgatacgcaccggccttctcgttatcagtggtgtgttcccagtcagcattcccatcactgctgcagcctggtacctgtgggaggtgaagaagcagcgggcgggggtattgtgggatgtgccttctccaccccctgtcggaaaagctgaattagaggacggcgcctatagaattaagcagaggggcatcctggggtactcccaaataggagccggtgtttataaagaaggcacatttcacaccatgtggcatgtgacgcgtggggcagtgctcatgcaccgcggaaagcggattgagccgtcatgggctgatgtcaaaaaggacctgatcagttacggcggtgggtggaaacttgagggagaatggaaagagggcgaagaggtgcaggttctggccttggaaccaggcaagaatcccagagcagtacagactaaacctgggatcttcaagaccaacacaggaaccattggtgctgtgagcctagatttttccccaggcacatctgggtcgcccatcgtcgacaggaaaggaaaggtggttggcctgtacggtaatggggtggtcactcgaagcggagcctatgtgtcagcgatagcccagaccgagaagtccattgaggataaccctgaaatcgaggacgatattttccggaaaaagcgcctcacgatcatggacctgcatccgggcgcaggcaaaacaaagagataccttcccgctatagtaagggaagccattaaacgggggttacgaactctgatcctcgctccaaccagagtcgtggcagccgagatggaagaggccttgcgcggactgcctatcaggtatcaaacacccgctattcgtgcggagcacaccggtcgggaaatcgttgacctcatgtgccatgcaactttcaccatgagactgcttagtccagtgagggtccctaactacaatctgattataatggatgaggcccactttacagaccccgcttctatcgccgcacgcggctatattagcacgcgagtggaaatgggggaggccgctggaatcttcatgactgcgaccccaccgggctccagagatccttttccccagtcaaacgccccaatcatggacgaggaacgggagattcccgaaaggtcttggaatagcggtcacgagtgggttacagatttcaaggggaagaccgtgtggtttgtccctagtataaaagcaggaaacgacatcgctgcctgtttgcgcaagaatggcaaaaaggtgattcagctatcccgtaaaactttcgatagcgaatacgtaaagacaagagcaaacgactgggattttgtggttaccacggacatctctgagatgggcgccaatttcaaggctgagcgggtcattgatccaaggcgctgcatgaaacccgtgatcctgactgacggggaagaacgagtgatactcgccggacctatgccggtcacacattcatccgcggcacaaagacggggtaggatcggccgcaacccaaagaatgaaaacgaccagtatatttacatgggggagcccttagaaaatgatgaggactgtgcccactggaaagaggctaagatgctgcttgataacatcaatacccctgaaggaattatccccagtatgtttgagccagaaagagagaaagtagacgccatagatggcgaatacaggctgcggggtgaggctcgtaagaccttcgtggacctcatgcgccgaggggatttgcctgtttggctggcatataaagtggccgctgagggcattaactacgccgacagaaagtggtgctttgatggaatcaagaataaccagattctcgaagagaacgtcgaagtggagatctggactaaagagggcgaaaggaagaaactgaagccccggtggcttgacgcacgcatatatagcgatccactagcgctgaaagagttcaaggagttcgccgctgggagaaagtcgttgacattaaatctgatcaccgagatgggaaggctccctacatttatgactcagaaagcccggaacgcactggacaatcttgctgttctgcatacggccgaagtgggtggcaaggcatacacccacgccctctctgagttgccggagacactggaaactctactgctccttaccctgttagctgcggtcacagggggaattttcttgtttctgatgtccggcaaaggtatcgggaagatgaccctcggcatgtgttgcattatcactgccagcatactgctttggtatgcacaaattcagccccactggatcgctgcctcaatcattctggagttctttctcatcgtgttgctgataccagaacctgagaaacagcgaacgccccaggataaccaattaacctacgtagtgattgccatcctaacagttgtcgcagctactatggccaatgaaatgggattcctggagaagaccaagaaagacctcggctttgggagtattacaacccaggagtctgaatccaacatccttgacatagatctgagaccagcgagcgcttggactttgtatgccgtggcaacaacgttcgtgacccctatgctgcgccattcaatcgagaatagtagcgtcaacgtttccctcactgccattgctaatcaggcaacagtgctgatgggacttggtaagggctggcccctctctaaaatggacatcggggtaccgctgttggccattggatgctacagccaggtgaacccaatcaccctgaccgcggctttactactgctcgtcgcccactacgcaattatcggccctggtcttcaagccaaggctacaagggaagcccagaaacgggcagctgccgggataatgaagaatcccactgtggatggcattacggttatcgacctggagccaatcccctatgatcctaagtttgaaaaacagttgggacaggtgatgctgctcattctgtgtgtcacccaagtacttatgatgcgtacaacttgggcgttatgcgaggccctgaccctcgcaacaggcccgatatccaccttgtgggaggggaaccccggaagattctggaatactacgatcgctgtgtcaatggccaacatttttaggggctcttacctggccggtgctgggctactgttcagtatcatgaagaatacaaccaacactcgccggggaaccggcaatgttggtgaaacactcggcgagaaatggaagtcgcgacttaacgccctggggaaaagcgaatttcagatttataagaaatccggaatccaggaggtggacagaactttggccaaggagggcataaagagaggggaaaccgatcatcacgcggtctctcgcggatcagctaaactgcggtggttcgtggagagaaacatggtcacaccagaaggcaaggtggttgacctcggttgtgggcgtggaggctggagctactattgcggtggcctgaaaaatgtgagggaggtaaaggggttaacgaaaggaggccctgggcatgaggaaccaatccctatgtccacctacggatggaaccttgtgcggctgcaaagtggcgtcgatgttttctttactccacccgagaagtgtgacacactcctatgcgatattggtgaatctagccctaatccaaccatcgaggcagggcgcactctgcgagtgttgaacctggtcgaaaattggctcaacaataacacacagttctgtattaaggtgcttaatccctatatgccgtcagtaatcgagaaaatggaaaccctgcagagaaagtacggaggcgccttggtgaggaaccctctgtcccggaatagtacgcacgagatgtactgggttagcaacgctaccggcaatatagtgtcttccgtcaacatgatttcacgcatgctcatcaatagatttacaatgaaacacaagaaagccacttatgagccagacgtggatttagggagcggaaccaggaacatcggtattgaatcggagatacccaacctggacatcgtcggcaagcgaattgaaaagatcaaacaggagcatgaaacatcttggcactacgaccaagatcatccttataagacttgggcataccacgggagttatgagaccaaacagacaggatccgccagctcaatggtgaatggcgttgtacggcttctgaccaagccatgggacgtggtccccatggtgactcagatggctatgacggatacaaccccgttcggtcagcaacgtgtttttaaagagaaggtggacactagaacccaggaacctaaggaggggacgaaaaagctaatgaaaattacagcggaatggctctggaaggagctgggaaaagagaagacaccccgcatgtgcactagggaagagttcacacggaaagtcagatccaacgccgcattgggcgctgtgtttaccgatgaaaataagtggaagtctgcccgcgaggcagtagaagacggcaggttctgggagctggtggatcgagagcggaacctccaccttgaagggaaatgtgagacttgcgtttacaatatgatgggaaagagagagaaaaagctgggtgagtttggcaaagccaaggggagcagggctatctggtatatgtggttaggagcccgcttcctggaatttgaggcgttgggcttcctcaacgaggaccattggtttagtcgtggtaattccctgagcggggtcgaaggagagggcctacaccggcttggctacatactgagagaagtggggaagaaagagggaggtgcaatgtacgccgatgacacagctggctgggataccaggatcacactcgaagacctgaagaacgaggagatggtgactaatcatatgaaaggggaacacaagaaattggccgaggcaattttcaagctgacctatcagaacaaggtcgttcgcgtgcagcgaccaacgcctcggggaaccgtaatggacatcatttctagaaaagatcaaaggggctcaggtcaggtggggacatacggactcaatactttcaccaacatggaagctcagcttatccgccaaatggagggcgagggcatttttaagagtatacagcatctgacagccactgaagagatcgctgtccagaattggttagtgagagttgggcgggaaaggctgtcccgtatggccattagcggagacgattgtgtggtcaaacccatcgacgatcgattcgcatctgcgttgaccgccctcaacgacatgggtaaggtgcgcaaagatatccagcaatgggagccatcgagaggctggaatgactggacgcaggtacccttttgctcacaccacttccatgaactggttatgaaggatgggcgggtgctagtcgtgccttgcaggaaccaggacgagcttattggacgcgctagaataagccagggcgccggttggtccctgaaggagacagcatgtctcgggaaaagttatgctcaaatgtggaccctgatgtactttcaccggagggatttgcgattagccgcaaacgccatctgctctgcggtgccaagccattgggtcccgacttcccgtacaacctggtcaattcacgctaagcacgaatggatgactaccgaggacatgctggttgtgtggaatagagtatggatccaggaaaacccctggatggaggataaaacacctgtggaaagttgggaggaggtcccatatctcggaaagcgcgaagaccagtggtgtggctctcttattggcctgacgagccgggccacctgggccaaaaatatccagactgccataaaccaagtgaggtccctaatcgggaatgagggatacacagactatatgccctcaatgaagagattccgccgggaagaggaagaggctggtgttctgtggtga

SEQ ID NO: 14577 - RNA, 9876 nt, synthetic construct
  misc_feature 1..9876: note = derived and/or modified CDS sequence (opt3) from DENV-2__KC294215__SS-prME
  source 1..9876: mol_type = other RNA
accgcaggcgtgatcgtcatgctgattcccacagctatggcattccacctcactacgaggaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccattactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagacccggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgtattttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatgatcatccccaagaatttcgcaggccccgtcagccagcacaactaccgacctggttatcatacccaaacagctggcccatggcacctcgggaagctggaaatggattttgacttctgtgagggaactaccgtggttgtgacagaagattgcggcaatagagggccctctctaaggacgaccactgcctccggaaaactgattacagagtggtgctgtcgctcatgcaccctcccgcctctgcggtacagaggcgaggacggttgttggtacgggatggaaatcaggccacttaaggagaaggaagagaacttggtcaatagtctggtgactgcgggacatggccagattgataactttagcttaggtgttctcggcatggccctgttccttgaagagatgctgcgcacacgagtggggaccaaacacgctatattgctcgtagcactgtcgtttgtcacgctaatcactggaaatatgtccttccgggacctgggccgtgtgatggtgatggtcggggccaccatgacagatgacattggaatgggcgttacctatctcgctctgcttgccgcatttaaggtgagacccactttcgcggccggtttgctgttaaggaaactcacatctaaggagctgatgatggctaccatcgggattgcccttctgagccagtcaacactacctgaaactatcctcgagctgaccgatgcattggctctgggaatgatggccttaaaaatagtacgcaacatggaaaagtaccaactcgcagtgacgatcatggccattagttgcgtccccaatgctgtgatcctgcagaacgcgtggaaggtttcctgtacaattcttgccgcagtgtctgtcagcccactgttgctcacctcctcacagcagaaagctgactggatccctctggccctaactataaagggcctgaatcccaccgccatttttcttacaactctcagccggaccagtaaaaagagatcttggccactgaacgaggctatcatggcagtgggcatggtttccatcttggccagctcgctgctaaagaatgacattccgatgacggggcctctcgtggcgggaggtctgcttacagtctgctatgtactgaccggcaggtcagctgatttggaactcgagcgagccgcagacgtgaagtgggaggatcaagccgaaatatctgggagttcccccatcctgagcattactatctctgaggacggaagcatgtccattaaaaacgaagaggaggaacagacactaaccatcctgatacgcactggccttctcgttatctcaggtgtgttcccagtcagtattcccatcacagctgcagcctggtacctgtgggaggtgaagaagcagcgggcgggggtattgtgggatgtgcctagcccaccccctgtcggaaaagctgaattagaggacggcgcctatagaattaagcagaggggcatcctggggtactctcaaataggagccggtgtttataaagaaggcacctttcacacgatgtggcatgtgactcgtggggcagtgctcatgcaccgcggaaagcggattgagccgtcctgggctgatgtcaaaaaggacctgatctcatacggcggtgggtggaaacttgagggagaatggaaagagggcgaagaggtgcaggttctggccttggaaccaggcaagaatcccagagcagtacagaccaaacctgggatcttcaagacaaacaccggaacaattggtgctgtgagtctagattttagcccaggcacttccgggtctcccatcgtcgacaggaaaggaaaggtggttggcctgtacggtaatggggtggtcacccgatcgggagcctatgtgagcgcgatagcccagacggagaagtcaattgaggataaccctgaaatcgaggacgatattttccggaaaaagcgcctcacaatcatggacctgcatccgggcgcaggcaaaactaagagataccttcccgctatagtaagggaagccattaaacgggggttacgaaccctgatcctcgctccaacaagagtcgtggcagccgagatggaagaggccttgcgcggactgcctatcaggtatcaaacccccgctattcgtgcggagcacactggtcgggaaatcgttgacctcatgtgtcatgcaaccttcacaatgagactgctttccccagtgagggtccctaactacaatctgattataatggatgaggcccactttacggaccccgctagtatcgccgcacgcggctatatttctactcgagtggaaatgggggaggccgctggaatcttcatgaccgcgacaccaccgggcagcagagatccttttccccagtccaacgccccaatcatggacgaggaacgggagattcccgaaaggtcatggaactctggtcacgagtgggttaccgatttcaaggggaagactgtgtggtttgtccctagcataaaagcaggaaacgacatcgctgcctgcttgcgcaagaatggcaaaaaggtgattcagctaagtcgtaaaacattcgattccgaatacgtaaagaccagagcaaacgactgggattttgtggttacgactgacatcagcgagatgggcgccaatttcaaggctgagcgggtcattgatccaaggcgctgtatgaaacccgtgatcctgacagacggggaagaacgagtgatactcgccggacctatgccggtcacccattcttcagcggcacaaagacggggtaggatcggccgcaacccaaagaatgaaaacgaccagtatatttacatgggggagcccttagaaaatgatgaggactgcgcccactggaaagaggctaagatgctgcttgataacatcaatacccctgaaggaattatcccctccatgtttgagccagaaagagagaaagtagacgccatagatggcgaatacaggctgcggggtgaggctcgtaagactttcgtggacctcatgcgccgaggggatttgcctgtttggctggcatataaagtggccgctgagggcattaactacgccgacagaaagtggtgttttgatggaatcaagaataaccagattctcgaagagaacgtcgaagtggagatctggacaaaagagggcgaaaggaagaaactgaagccccggtggcttgacgcacgcatatatagtgatccactagcgctgaaagagttcaaggagttcgccgctgggagaaagagcttgaccttaaatctgatcacagagatgggaaggctccctacttttatgacgcagaaagcccggaacgcactggacaatcttgctgttctgcataccgccgaagtgggtggcaaggcatacacacacgccctctcggagttgccggagactctggaaaccctactgctccttacactgttagctgcggtcaccgggggaattttcttgtttctgatgtctggcaaaggtatcgggaagatgactctcggcatgtgctgcattatcacggcctccatactgctttggtatgcacaaattcagccccactggatcgctgccagcatcattctggagttctttctcatcgtgttgctgataccagaacctgagaaacagcgaaccccacaggataaccaattaacatacgtagtgattgccatcctaactgttgtcgcagctaccatggccaatgaaatgggattcctggagaagacaaagaaagacctcggctttgggtcaattaccactcaggagagtgaatctaacatccttgacatagatctgagaccagcgtccgcttggacattgtatgccgtggcaacgaccttcgtgactcctatgctgcgccatagcatcgaaaattcaagtgtcaacgttagcctcacagccattgctaatcaggcaaccgtgctgatgggacttggtaagggctggcccctctccaaaatggacatcggggtaccgctgttggccattggatgttactctcaggtgaacccaatcaccctgacagcggctttactactgctcgtcgcccactacgcaattatcggccctggtcttcaagccaaggctactagggaagcccagaaacgggcagctgccgggataatgaagaatcccacggtggatggcattaccgttatcgacctggagccaatcccctatgatcctaagtttgaaaaacagttgggacaggtgatgctgctcattctgtgcgtcacacaagtacttatgatgcgtactacctgggcgttatgtgaggccctgacactcgcaaccggcccgataagcactttgtgggaggggaaccccggaagattctggaatacgacaatcgctgtgtccatggccaacatttttaggggctcatacctggccggtgctgggctactgttctctatcatgaagaataccactaacacccgccggggaacaggcaatgttggtgaaactctcggcgagaaatggaagagtcgacttaacgccctggggaaatcggaatttcagatttataagaaaagcggaatccaggaggtggacagaaccttggccaaggagggcataaagagaggggaaacagatcatcacgcggtctcccgcggatctgctaaactgcggtggttcgtggagagaaacatggtcacgccagaaggcaaggtggttgacctcggttgcgggcgtggaggctggtcatactattgtggtggcctgaaaaatgtgagggaggtaaaggggttaaccaaaggaggccctgggcatgaggaacccatccctatgagcacttacggatggaaccttgtgcggctgcaatccggcgtcgatgttttctttacaccacccgagaagtgcgacaccctcctatgtgatattggtgaaagttctcctaatccaactatcgaggcagggcgcacactgcgagtgttgaacctggtcgaaaattggctcaacaataacacccagttctgcattaaggtgcttaatccctatatgccgagcgtaatcgagaaaatggaaacgctgcagagaaagtacggaggcgccttggtgaggaaccctctgtcaagaaattccacccacgagatgtactgggttagtaacgctacaggcaatatagtgagctctgtcaacatgatttcccgcatgctcatcaatagatttactatgaaacacaagaaagccacctatgagccagacgtggatttagggtcaggaacaaggaacatcggtattgaaagcgagatacccaacctggacatcgtcggcaagcgaattgaaaagatcaaacaggagcatgaaacttcgtggcactacgaccaagatcatccttataagacctgggcataccacgggtcttatgagacaaaacagaccggaagtgcctccagcatggtgaatggcgttgtacggcttctgactaagccatgggacgtggtccccatggtgacgcagatggctatgacagataccactccgttcggtcagcaacgtgtttttaaagagaaggtggacaccagaacacaggaacctaaggaggggacgaaaaagctaatgaaaattaccgcgaagtggctctggaaagaactgggaaaggagaaaactccccgcatgtgtacaagggaggagttcacccggaaggtcagatcaaacgccgcattgggcgctgtgtttactgatgagaataagtggaaatccgcccgcgaagcagtagaggacggcaggttctgggaactggtggatcgagagcggaacctccaccttgaggggaagtgcgaaacatgtgtttacaatatgatgggaaaaagagagaagaaactgggtgaatttggcaaggccaaggggtctagggctatctggtatatgtggttaggagcccgcttcctggagtttgaagcgttgggcttcctcaacgaggaccattggtttagccgtggtaatagtctgtccggggtcgagggagaaggcctacaccggcttggctacatactgagagaggtggggaaaaaggaaggaggtgcaatgtacgccgatgacaccgctggctgggatacaaggatcactctcgaggacctgaaaaacgaagagatggtgaccaatcatatgaagggggagcacaaaaagttggccgaagcaattttcaagctgacgtatcagaacaaagtcgttcgcgtgcagcgaccaacccctcggggaacagtaatggacatcattagcagaaaggatcaaaggggctctggtcaggtggggacttacggactcaataccttcacaaacatggaggctcagcttatccgccaaatggaaggcgagggcatttttaaatcaatacagcatctgactgccaccgaggaaatcgctgtccagaattggttagccagagtggggcgggagaggctgagtcgtatggcaatttccggagacgattgcgttgtgaagcccatcgacgatcgattcgcgagcgccttgacggctctcaacgacatgggtaaagtccgcaaggatatccagcaatgggaaccatctagaggctggaatgactggacacaggtgcccttttgctcgcaccacttccatgagctggtaatgaaggatgggcgggttctagtggtcccttgtaggaaccaggacgaacttattggacgcgccagaatatcacagggcgcaggttggagcctgaaagagaccgcttgcctcgggaagtcctatgcccaaatgtggactctgatgtactttcaccggagggatttgcgattagcagccaacgcgatctgtagtgctgtgccatctcattgggtgccgacaagccgtaccacttggtccattcacgccaaacacgagtggatgaccacagaagacatgctggtcgtttggaatagagtgtggatccaggagaacccctggatggaagataagacgcctgtagagtcatgggaagaggtgccatatctcggaaaacgcgaggaccagtggtgcggcagtcttattggcctgacctctcgggcaacttgggccaagaatatccagacagctataaaccaagtcaggagcctaatcgggaatgaaggatacaccgactatatgccctccatgaagagattccgccgggaggaagaggaagccggtgtgctgtggtga

SEQ ID NO: 14578 - RNA, 9876 nt, synthetic construct
  misc_feature 1..9876: note = derived and/or modified CDS sequence (opt3) from DENV-2__KC294216__SS-prME
  source 1..9876: mol_type = other RNA
accgccggagtgatcattatgctgatacccaccgctatggcattccacctcactacgagaaatggggagcctcatatgatcgtaggaaggcaggaaaagggtaaaagccttctgttcaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgtactcgagcacgggagctgtgttaccactatggccaagaataagcccacattagatctggaacttattaaaaccgaggcgaagcagcctgcaacgttgcggaaatattgcatcgaagccaagctgaccaacacaactaccgagagtcgctgtccaacacaaggagagccctccctaaatgaggaacaggacaaacgattcatctgcaagcattctatggtggatagaggctggggtaacgggtgtggactctttggcaagggcgggattgtcacttgcgctatgtttacctgcaaaaagaatatggaaggaaaagtggtgctgcctgagaaccttgaatacacaatagtcatcaccccacacagcggtgaggagcatgccgttggcaatgacactgggaagcacggagaagagattaaaatcacgccgcagtcctcaataacagaagcagagctgaccggctatggtactgtgaccatggaatgtagtcccaggacagggttggattttaacgagatggtactcctgcagatggaggaaaaggcttggttagtgcaccggcaatggttcctggacctccctcttccatggctgcccggcgccgatacccagggaagcaattggattcagaaagagactttggtcacatttaagaaccctcatgcgaagaaacaggacgtggttgtgctaggctctcaagaaggggccatgcacacggcactgaccggagctactgagatccagatgtcctcaggtaatctcctgttcacaggccatcttaagtgccgtctgcgcatggacaaattgcagctcaaggggatgagctacagtatgtgtaccggaaaatttaagatcgtcaaggagattgccgaaacacaacacggcactatcgtgattagagtacagtatgagggtgatgggtctccatgcaaaatacccttcgaaatcatggacctggagaagaggcatgttttaggccggctgattaccgtgaacccgatcgtcacggaaaaagattcccctgtgaacatcgaggctgagcccccattcggagacagctacattataatcggcgtcgaacctgggcagctaaagctcaattggtttaaaaagggatcgtctattggtcagatgttcgagaccacaatgcgaggcgccaagcgcatggcaatcctgggggatactgcctgggactttggatcccttggcggtgtgttcacctcaattgggaaggctttgcaccaagtttttggcgcgatctacggagcagccttcagtggcgtgagctggacaatgaagatactgatcggggtaattatcacttggattggaatgaactccagatctaccagcctctcagtcagtctggtgcttgttggcgtggtcacgctgtatttgggtgctatggtgcaggccgattccgggtgtgtagtgagctggaaaaataaggaactcaaatgcggatctggcatctttataacagacaacgttcacacctggactgagcagtacaagttccagcccgaatcaccaagtaagctggcaagcgccattcaaaaagctcatgaggagggtatctgtggcattaggtccgtcacacggttagaaaatctgatgtggaagcagatcacccccgagctaaaccacatactctctgaaaatgaggtgaaactgactatcatgaccggggatattaagggaatcatgcaggccggcaaacgctcgcttagacctcagccaacagaattgaagtatagctggaaaacgtgggggaaggcaaagatgctgtccaccgagtcacataaccaaacttttctcattgacggaccggagacagcggaatgccccaataccaacagggcttggaatagtctggaggtggaagattacggcttcggtgtctttacaactaacatctggttaaaactgcgtgagaagcaggacgttttctgtgactctaaacttatgagcgccgcaataaaggataatcgggccgtgcacgctgacatggggtattggattgagtccgccttgaacgatacctggaaaatggaaaaggcatcatttatcgaggtgaaaagctgccactggcctaaatctcatacgctctggtccaatggagtactggaaagtgagatgatcattccaaagaacttcgctggccccgtcagccagcacaactaccgacctggttatcatacacagaccgccggcccatggcacctagggaaactggaaatggacttcgatttttgtgagggaactaccgtggttgtgacagaggactgcggcaatagagggccctctctcaggactaccacagcgtccggaaagctgatcacggaatggtgctgtcgctcatgcacccttccgcctttgcggtacagaggcgaggatggttgttggtacgggatggaaattaggccactgaaagagaaggaagagaacttagtcaatagtctcgtgactgccggacatggccaaatagacaacttcagcctgggtgttcttggcatggctctgtttttggaggaaatgctccgcacacgagtggggaccaagcacgcaatcctgctagtagccgtctcgttcctgactctcattacaggaaatatgtcctttcgggatctgggccgtgtgatggtgatggtcggggttgctatgaccgacgatatcggaatgggcgtgacgtatcttgccttgctggcagcgttcaaagtaagacccacttttgccgctggtttactcctgaggaaacttacctctaaagagctgatgatggccacaattgggatcaccctactcagccagtcaactacacctgaaaccatactggagttgacagacgcactggctttaggaatgatggtgctcaagatcgtccgcaacatggaaaaataccagctggccgtgactattatgaccatcagttgcgttcccaatgcaatgattcttatcaacgcctggaaggtgtcctgtacgatactggctgtcgtgtctgttagcccattgctcctgacatcctcacaacagaagaccgattggattcctctagcgctgactatcaaaggccttaatcccaccgccatcttcctcacaactctgagccggaccagtaagaaaagatcttggccattgaacgaggcagtgatggctgtcggcatggtatccattctggccagctcgttactcaagaatgacataccgatgacggggcctctggtggccggaggtcttctgacagtttgctatgtgttgaccggcaggtcagctgacctcgagctggaacgagcagccgatgtcaaatgggaggaccaggcggaaatctctgggagttcccccattctaagcatcactatttctgaggatggaagcatgtccatcaagaacgaggaagaggaacagacactgaccatacttatccgcactggcctcctggtgatttcaggtgtatttccagtgagtatccccattacagctgccgcatggtacttgtgggaggtccggaaacaaagagccggggttttatgggacgtgcctagcccaccccctgtggaaaaggctgagctggaggatggagcatataggatcaagcagcgtggcatactcggctactctcagattggggccggagtctataaagaaggtaccttccacacgatgtggcatgtgactcgcggcgcggttctgatgcaccgggggaagagaatcgagccgtcctgggctgacgtcaagaaggatcttatctcatacggaggcggttggaaactggaaggggagtggaaggaaggagaggaggtgcaggtcttggccctagaaccaggcaagaatcccagggcagtgcaaaccaaacctggcctgtttaagacaaacaccgggacaattggagccgttagtctcgacttcagcccaggtacttccggctctcccatcgtggatcgaaaagggaaggtcgtgggactgtacggcaatggtgtagtcacccggtcgggggcttatgtgagcgccatagcacagacggagaaatcaattgaagacaaccctgagatcgaagatgacatttttcgcaagaagagacttacaatcatggatttacatccgggagctggcaaaactaagaggtacctgcccgccatagttcgggaggcgattaaacgaggcctcagaaccttgatcctggccccaacacgcgtggtcgcagctgagatggaagaggccctcagggggctgcctatccgttatcagacccccgctattcgggcagaacacactggaagagagatcgtggaccttatgtgtcatgccaccttcacaatgaggctgttgtccccagttcgcgtgcctaactacaatctaattataatggacgaggcccacttcacggatcccgctagtatcgcggcacgaggttatatttctactagagtcgaaatgggcgaggccgctgggatctttatgaccgccacaccaccgggaagccgggaccctttcccccagtccaacgcaccaatcatggatgaagagagggaaattcccgagcgctcatggaactctggccacgagtgggtgaccgactttaagggtaaaactgtatggttcgtgcctagcataaaggccgggaacgatatcgctgcgtgcctgcgtaagaatggcaagaaggttattcaactcagtagaaaaacatttgactccgaatacgtcaagacccgggccaacgattgggacttcgtggtgacgactgatatcagcgagatgggcgcaaattttagggctgaacgcgtcattgacccacgaagatgtatgaaacccgtaatcttaacagatggcgaggaacgggtgatactggccgggcctatgccggttacccattcttcagcagcccagaggcgcggaagagtgggtaggaacccaaagaatgagaacgaccagtatatctacatgggcgagccccttgaaaatgacgaggattgcgctcactggaaggaagccaaaatgctgctcgacaacattaatacccctgaggggatcattccctccatgttcgaaccagagcgggagaaggtcgatgcgatcgacggagaataccgtttgcgcggcgaggcacgaaaaacttttgtggatctgatgagaaggggtgacctccctgtttggctggcctatcgggtggctgccgaagggataaactacgctgatcgcagatggtgtttcgacggcattaagaataaccaaatccttgaggagaacgtcgaagtggagatttggacaaaagaaggagagaggaagaaactaaagccccggtggctggatgcacgaatctatagtgacccattggccttaaaggaatttaaagagttcgctgccggcagaaagagcctgaccctcaatctgataacagagatggggcgccttcctactttcatgacgcagaaagcaaggaacgcgctggataatctcgccgtattgcataccgctgaagccggaggtcgggcatacaaccacgctctgtcggagctaccggaaacactggagactctccttctgttaaccttgctggccacagtgaccggcgggatctttctcttcctgatgtctggaaagggcattggtaaaatgactcttgggatgtgctgcatcattacggcatccatcctgctctggtatgcccagatacagccccactggattgctgcgagcatcatcttggaatttttcctgattgttttactaatcccagagcctgagaagcaacgtacaccccaggacaatcagctgacatacgtcgtgatagccattctcactgtggtcgcagctaccatggccaacgaaatgggctttcttgagaagacaaaaagagatctgggattgggctcaatcaccactcaggaaagtgagtctaatattctggacatcgacctcaggccagcctccgcatggacactgtatgctgttgccacgaccttcgtgactcctatgcttcgccatagcatagaaaactcaagtgtaaatgtgagcctcacagcgatcgctaaccaagccaccgtcctgatggggttgggaaagggttggcccctgtccaaaatggatattggcgtgccgttactagcaatcgggtgttactctcaggttaatccaattaccctgacagccgctctccttctgttggtggcacactacgccatcattggacctggcctgcaggcgaaggctactcgggaggcccagaaacgagcagccgctggtatcatgaagaaccccacggtcgacgggataaccgtaattgatctcgagccaatcccctatgaccctaagtttgaaaaacaactgggccaggtgatgcttttaatcctgtgcgttacacaggtgctcatgatgagaactacctgggccttgtgtgaggcactgacactagctaccggaccgattagcactctgtgggaaggcaatcccgggaggttctggaacacgacaatagccgtctccatggcgaatatctttcgcggatcatacctcgccggcgcaggtcttctgttctctattatgaagaacaccactaatacccggagagggacaggaaacatcggcgagactttgggtgagaaatggaagagtcgtctgaacgctctcggcaaatcggaatttcagatttataagaggagcgggatccaagaggtggatcggaccctggccaaggaaggaataaaacgcggcgagacagaccatcacgcagtctcccgagggtctgctaagttaagatggttcgtggaaaggaatatggttacgccagagggaaaagtggtagatcttggctgcggtagagggggatggtcatactattgtggcggtctgaagaacgtgcgcgaggtcaaaggcctcaccaaagggggacctggccatgaggaacccatccctatgagcacttacgggtggaatctagttagactgcagtccggagtggacgtctttttcacaccacccgaaaaatgcgataccttgctgtgtgacattggcgagagttctcctaacccaactatcgaagccggtaggacactccgagtgcttaatctggtagagaactggttgaataacaatacccagttctgcattaaggtgctgaacccctatatgccgagcgttatcgagaagatggaaacgctccaacggaaatacgggggagccttagtgcgtaatcctctgtcaagaaactccacccacgagatgtactgggtcagtaatgcgacaggcaacatagtgagctctgtcaatatgatttcccgcatgcttatcaacaggtttactatgaagcacaaaaaggctacctatgaaccagatgtggacctgggctcagggacacggaacatcggaattgagagcgaaatacccaatctagcaatcattggtaaaagaatcgagaagattaagcaggagcatgaaacttcgtggcactacgatcaggaccatccttataaaacctgggcctaccacggctcttatgagacaaagcagaccgggagtgcttccagcatggttaacggagtagtgcgcctcctgactaaaccatgggacgtcgtgcccatggttacgcaaatggccatgacagataccactccgttcggccagcagagggtgtttaaggaaaaagtcgacacccgaacacaggagcctaaggagggtacgaagaaattgatgcggatcaccgcagaatggctgtggaaggagctcgggaaaaagaaaactcccagaatgtgtacaagggaagagttcacccgcaaggtgcgttcaaatgccgctcttggagcgatatttactgatgaaaacaagtggaaatccgcccgggaggcagtagaggactctagattctgggaactggtggatagggagcgcaatttacacctggaaggcaagtgcgagacatgtgtttacaacatgatgggcaaacgagaaaagaaattgggggagtttggaaaggctaaaggtagccgggccatctggtatatgtggctcggcgcaagattcctggagtttgaagccctagggttccttaatgaggaccattggtttagtaggggaaactccctgagcggcgtcgaaggtgaggggctccaccgcctgggatacattttgagagatgtgtctaagaaggaaggcggcgctatgtacgccgacgataccgcggggtgggacacacggatcactctggaggatctcaaaaatgaggaaatggtgaccaaccatatgaagggagagcacaagaaacttgcagaagccgtcttcaaactgacgtatcaaaataaggttgtgagggtacagcgtccaacccctcgaggtacagtgatggacattatctcacgcagagaccagcggggcagtgggcaggtcggaacttacggcttaaacacctttacaaatatggaggctcaactgattaggcagatggagggtgaagggatattcaagtccatccagcatttgactgccaccgaggaaattgcagtgcaaaactggctcgctcgcgttggaagagagcggctgagcaggatggccatctctggcgatgactgcgtggtcaaacccctagatgaccgattcgcttcggcccttacggcactgaatgatatgggcaaggtgcgtaaagacatccagcagtgggaaccatcaagagggtggaacgattggacacaggtacccttttgcagccaccacttccatgagctcgttatgaaggacggacgcgtgctggtcgtgccttgtcggaaccaagatgagttgattggtagggcgagaatatcccagggcgccgggtggagtttaaaagaaaccgcttgcctgggaaagtcttatgcccagatgtggactctcatgtactttcaccgccgggaccttaggctggcagctaatgccatctgtagcgcagtgccatcccattgggtcccgacatcacgaaccacttggagtattcacgccaagcacgagtggatgaccacagaagatatgctagcggtttggaacagagtgtggatccaggagaatccctggatggaagacaaaacgcctgtagagtcttgggaggaagtgccatatctgggcaagcgggaggatcaatggtgcggtagcctcattgggttgacctccagggctacttgggccaaaaacatccagacagcaataaatcaggtccgctcactgatcggaaacgaagagtacaccgactatatgcccagcatgaagcgtttcagacgagaagaggaggaagccggcgtgctttggtga

SEQ ID NO: 14579 - RNA, 9876 nt, synthetic construct
  misc_feature 1..9876: note = derived and/or modified CDS sequence (opt3) from DENV-2__KC294218__SS-prME
  source 1..9876: mol_type = other RNA
accgcaggcgtgatcgtcatgctgattcccacagctatggcattccacctcactacgaggaacggggaacctcatatgatagttggaaggcaggaaaagggtaaaagccttctgtttaagaccgaggacggcgtgaatatgtgcacattgatggcaatcgatttaggggaactgtgtgaggacactattacctacaaatgcccactgctccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagacccggacagaaacttggatgagtagcgagggagcttggaaacacgttcagaggattgagacctggatcctgcggcatcctggcttcacaataatggccgcaatcttggcctacaccattggcacgactcactttcagcgcgctctcatcctgattctgctcacagcagtggccccatccatgaccatgagatgcatcgggatatctaacagggatttcgtcgaaggagtgtcgggtggctcatgggtagacattgttttagagcacgggagctgtgtgactacaatggctaagaataagcccaccctggattttgaacttatcaaaacggaggccaagcagcctgcgaccttgcggaaatattgcattgaagcaaagctgacaaacactaccacagagagtcgctgtccaactcaaggagagccctccctaaatgaagaacaggacaaacgattcatctgcaagcattctatggtcgatagaggctggggtaacgggtgtggactctttggcaagggcgggatcgtgacctgcgccatgttcacatgcaaaaagaatatggaaggaaaaattgtgcagcctgagaacctggaatacaccatagtcatcactccacacagcggtgaggagcatgctgttggcaatgacacggggaagcacggaaaagaaattaagatcacaccgcagtcctcaaccactgaggccgaacttaccggctatggtacagtgaccatggagtgtagtcccaggactgggctggattttaacgaaatggtattgctccaaatggaggacaaagcatggctggtgcaccggcagtggttcttagatctgcctctcccatggcttcccggcgctgacacacagggaagcaattggatacagaaggagacgctggtcacctttaagaaccctcatgccaaaaagcaagacgtggttgtgttgggctctcaggaaggggcgatgcacactgccctaacaggagcaaccgagattcagatgtcctcaggtaatctactcttcacaggccatctgaaatgccgtcttcgcatggataagctgcaattgaaagggatgagctacagtatgtgtactggaaagtttaagatcgtcaaagaaatcgctgagacccagcacggcacgattgtgatcagagtacagtatgagggtgacgggtctccatgcaagattcccttcgaaataaccgatctcgagaaaaggcatgttctgggccggttaatcacagtgaacccgattgtcactgaaaaggactcccctgtgaacatcgaggccgaacccccattcggagatagctacatcattgtcggcgtggagcctgggcagctgaaactaaattggtttaagaagggatcgtctataggtcaaatgttcgagaccacaatgcgaggcgctaaacgcatggccatcctcggggacactgcatgggattttggatccctgggcggtgttttcacctcaattgggaaggcccttcaccaggtgtttggcgctatctacggagcggcattcagtggcgtaagctggacgatgaaaattttgatcggggtcataatcacatggattggaatgaactccagatctaccagcctgtcagtgagtctcgttctggtgggcgtcgtgactctttatctgggtgccatggtacaggctgactccgggtgtatcgtgagctggaagaataaagaattgaagtgcggatctggcatttttatcacagataacgttcacacctggactgagcagtacaagttccaacccgaatcaccaagtaaactcgccagcgcaatacagaaggcccatgaggaaggtatttgtggcatcaggtccgtcacccggctggagaatttaatgtggaaacagattacacccgagctgaaccacatcctatctgaaaatgaggtgaagctcacgataatgaccggggacatcaaaggaattatgcaggctggcaagcgctcgctgagacctcaaccaactgaacttaaatatagctggaagacatgggggaaggccaaaatgttgtccaccgagtcacataaccagacatttctgatcgatggaccggaaactgcagagtgccccaataccaacagggcgtggaatagtctcgaggtggaagactacggcttcggtgtctttacgacaaacatttggctgaagttacgtgagaaacaggacgttttctgtgattctaagctgatgagcgctgccatcaaagacaatcgggcagtgcacgccgatatggggtattggatagaatccgctcttaacgacacctggaagatggagaaggcctcatttattgaggtgaaaagctgccactggcctaagtctcatactttgtggtccaatggagtactcgaaagtgagatgatcatccccaaaaatttcgcaggccccgtcagccagcacaactaccgacctggttatcatacccaaacagctggcccatggcacctggggaagctagaaatggatttcgacttttgtgagggaactaccgtggttgtgacagaagattgcggcaatagagggccctctctgaggacgaccactgcctccggaaaactcattacagagtggtgctgtcgctcatgcaccctgccgcctcttcggtacagaggcgaggacggttgttggtacgggatggaaatcaggccattgaaggagaaggaagagaacctggtcaatagtttagtgactgcgggacatggccagattgataacttcagcctcggtgttctgggcatggccctttttctggaagagatgttgcgcacacgagtggggaccaaacacgctatactcctggtagcactatcgttcgtcacgctgatcactggaaatatgtcctttcgggacctcggccgtgtgatggtgatggtcggggccaccatgacagatgacattggaatgggcgttacctatctggctcttttggccgcattcaaggtgagacccacttttgcggccggtctgttactcaggaaactgacatctaaggagcttatgatggctaccatcgggattgccctgctaagccagtcaacactccctgaaactatcctggagttgaccgatgcactggctttaggaatgatggccctcaaaatagtacgcaacatggaaaagtaccaactggcagtgacgatcatggccattagttgcgtccccaatgctgtgatccttcagaacgcgtggaaggtttcctgtacaattctggccgcagtgtctgtcagcccattgctcctgacctcctcacagcagaaagctgactggatccctctagccctgactataaagggccttaatcccaccgccattttcctcacaactctgagccggaccagtaaaaagagatcttggccattgaacgaggctatcatggcagtgggcatggtttccatcctggccagctcgttactcaaaaatgacattccgatgacggggcctctggtggcgggaggtcttctgacagtctgctatgtattgaccggcaggtcagctgatctcgaactggagcgagccgcagacgtgaagtgggaggatcaagccgaaatatctgggagttcccccatcctaagcattactatctctgaggacggaagcatgtccattaaaaacgaagaggaggaacagacactgaccatccttatacgcactggcctcctggttatctcaggtgtgtttccagtcagtattcccatcacagctgcagcctggtacttgtgggaggtgaagaagcagcgggcgggggtattatgggatgtgcctagcccaccccctgtcggaaaagctgaactggaggacggcgcctatagaattaagcagaggggcatcctcgggtactctcaaataggagccggtgtttataaagaaggcaccttccacacgatgtggcatgtgactcgtggggccgtgctgatgcaccgcggaaagcggattgagccgtcctgggctgatgtcaaaaaggaccttatctcatacggcggtgggtggaagctggagggagaatggaaagagggcgaagaggtgcaggttttggccctagaaccaggcaagaatcccagagcagtacagaccaaacctgggatctttaagacaaacaccggaacaattggtgctgtgagtctggatttcagcccaggcacttccgggtctcccatcgtcgacaggaaaggaaaggtggttggcctctacggtaatggggtggtcacccgatcgggagcctatgtgagcgcgatagcccagacggagaagtcaattgaggataaccctgaaatcgaggacgatatttttcggaaaaagcgcctgacaatcatggaccttcatccgggcgcaggcaaaactaagagatacttacccgctatagtaagggaagccattaaacgggggctgcgaaccctcatcttggctccaacaagagtcgtggcagccgagatggaagaggccctgcgcggactccctatcaggtatcaaacccccgctattcgtgcggagcacactggtcgggaaatcgttgacctgatgtgtcatgcaaccttcacaatgagacttctgtccccagtgagggtccctaactacaatttgattataatggatgaggcccacttcacggaccccgctagtatcgccgcacgcggctatatttctactcgagtggaaatgggggaggccgctggaatctttatgaccgcgacaccaccgggcagcagagatcctttcccccagtccaacgccccaatcatggacgaggaacgggagattcccgaaaggtcatggaactctggtcacgagtgggttaccgattttaaggggaagactgtgtggttcgtccctagcataaaagcaggaaacgacatcgctgcctgcctacgcaagaatggcaaaaaggtgattcagctgagtcgtaaaacatttgattccgaatacgtaaagaccagagcaaacgactgggatttcgtggttacgactgacatcagcgagatgggcgccaattttaaggctgagcgggtcattgatccaaggcgctgtatgaaacccgtgatcctcacagacggggaagaacgagtgatattagccggacctatgccggtcacccattcttcagcggcacaaagacggggtaggatcggccgcaacccaaagaatgaaaacgaccagtatatttacatgggggagcccctggaaaatgatgaggactgcgcccactggaaagaggctaagatgcttctggataacatcaatacccctgaaggaattatcccctccatgttcgagccagaaagagagaaagtagacgccatagatggcgaatacaggctccggggtgaggctcgtaagacttttgtggacttgatgcgccgaggggatctgcctgtttggctcgcatataaagtggccgctgagggcattaactacgccgacagaaagtggtgtttcgatggaatcaagaataaccagattctggaagagaacgtcgaagtggagatctggacaaaagagggcgaaaggaagaaacttaagccccggtggctagacgcacgcatatatagtgatccactggcgttgaaagagtttaaggagttcgccgctgggagaaagagcttaaccctgaatctcatcacagagatgggaaggctgcctactttcatgacgcagaaagcccggaacgcacttgacaatctggctgttctccataccgccgaagtgggtggcaaggcatacacacacgccttgtcggagctgccggagactctagaaaccctgctccttctgacattattggctgcggtcaccgggggaatttttctgttcctcatgtctggcaaaggtatcgggaagatgactctgggcatgtgctgcattatcacggcctccatacttctgtggtatgcacaaattcagccccactggatcgctgccagcatcattctcgagtttttcttgatcgtgctgttaataccagaacctgagaaacagcgaaccccacaggataaccaactaacatacgtagtgattgccatcctgactgttgtcgcagctaccatggccaatgaaatgggatttctcgagaagacaaagaaagaccttggcttcgggtcaattaccactcaggagagtgaatctaacatcctggacatagatttgagaccagcgtccgcttggacactgtatgccgtggcaacgacctttgtgactcctatgctccgccatagcatcgaaaattcaagtgtcaacgttagcctgacagccattgctaatcaggcaaccgtgcttatgggactcggtaagggctggcccctgtccaaaatggacatcggggtaccgttgctggccattggatgttactctcaggtgaacccaatcaccttaacagcggctctactgctccttgtcgcccactacgcaattatcggccctggtctgcaagccaaggctactagggaagcccagaaacgggcagctgccgggataatgaagaatcccacggtggatggcattaccgttatcgacttggagccaatcccctatgatcctaagttcgaaaaacagctgggacaggtgatgctcctgattctttgcgtcacacaagtattaatgatgcgtactacctgggcgctgtgtgaggccctcacattggcaaccggcccgataagcactctgtgggaggggaaccccggaagattttggaatacgacaatcgctgtgtccatggccaacattttcaggggctcatacctagccggtgctgggctgctcttttctatcatgaagaataccactaacacccgccggggaacaggcaatgttggtgaaactcttggcgagaaatggaagagtcgactgaacgccttggggaaatcggagttccagatttataagaaaagcggaatccaggaggtggacagaaccctggccaaggagggcataaagagaggggaaacagatcatcacgcggtctcccgcggatctgctaaactccggtggtttgtggagagaaacatggtcacgccagaaggcaaggtggttgacctgggttgcgggcgtggaggctggtcatactattgtggtggccttaaaaatgtgagggaggtaaaggggctaaccaaaggaggccctgggcatgaagaacccatccctatgagcacttacggatggaacctggtgcggctccaatccggcgtcgatgttttcttcacaccacccgagaagtgcgacaccctactgtgtgatattggtgaaagttctcctaatccaactatcgaggcagggcgcacattgcgagtgctgaacctcgtcgaaaattggcttaacaataacacccagttttgcattaaggtgctgaatccctatatgccgagcgtaatcgagaaaatggaaacgttgcagagaaagtacggaggcgccctggtgaggaaccctctctcaagaaattccacccacgagatgtactgggttagtaacgctacaggcaatatagtgagctctgtcaacatgatttcccgcatgttaatcaatagattcactatgaaacacaagaaagccacctatgagccagacgtggatctggggtcaggaacaaggaacatcggtattgaaagcgagatacccaaccttgacatcgtcggcaagcgaattgaaaagatcaaacaggagcatgaaacttcgtggcactacgaccaagatcatccttataagacctgggcataccacgggtcttatgagacaaaacagaccggaagtgcctccagcatggtgaatggcgttgtacggctgctaactaagccatgggacgtggtccccatggtgacgcagatggctatgacagataccactccgtttggtcagcaacgtgttttcaaagagaaggtggacaccagaacacaggaacctaaggaggggacgaaaaagctcatgaaaattaccgcggaatggctgtggaaggagttgggaaaagagaagactccccgcatgtgtacaagggaagagtttacccggaaagtcagatcaaacgccgcactgggcgctgtgttcactgatgaaaataagtggaagtccgcccgcgaggcagtagaagacggcaggttttgggagctcgtggatcgagagcggaaccttcacctggaagggaaatgcgagacatgtgtttacaatatgatgggaaagagagagaaaaagttaggtgagttcggcaaagccaaggggtctagggctatctggtatatgtggctgggagcccgctttttggagttcgaggcgctcggctttctgaacgaggaccattggttcagccgtggtaatagtctatccggggtcgaaggagagggccttcaccggctgggctacatactcagagaagtggggaagaaagagggaggtgcaatgtacgccgatgacaccgctggctgggatacaaggatcactctggaagacttgaagaacgaggagatggtgaccaatcatatgaaaggggaacacaagaaactggccgaggcaatttttaagctcacgtatcagaacaaggtcgttcgcgtgcagcgaccaacccctcggggaacagtaatggacatcattagcagaaaagatcaaaggggctctggtcaggtggggacttacggacttaataccttcacaaacatggaagctcagctgatccgccaaatggagggcgagggcattttcaagtcaatacagcatttaactgccaccgaagagatcgctgtccagaattggctggccagagtggggcgggaaaggttgagtcgtatggcaatttccggagacgattgcgttgtgaaacccatcgacgatcgatttgcgagcgccctcacggctctgaacgacatgggtaaggtccgcaaagatatccagcaatgggagccatctagaggctggaatgactggacacaggtgcccttctgctcgcaccactttcatgagttagtaatgaaggatgggcgggttcttgtggtcccttgtaggaaccaggacgagctgattggacgcgccagaatatcacagggcgcaggttggagcctcaaggagaccgcttgcctggggaaatcctatgcccaaatgtggactttgatgtacttccaccggagggatttacgactggcagccaacgcgatctgtagtgctgtgccatctcattgggtgccgacaagccgtaccacttggtccattcacgccaagcacgaatggatgaccacagaggacatgctcgtcgtttggaatagagtgtggatccaggaaaacccctggatggaggataaaacgcctgtagaatcatgggaggaggtgccatatcttggaaagcgcgaagaccagtggtgcggcagtctgattggcctaacctctcgggcaacttgggccaaaaatatccagacagctataaaccaagtcaggagcctgatcgggaatgagggatacaccgactatatgccctccatgaagagatttcgccgggaagaggaagaggccggtgtgctctggtga

SEQ ID NO: 14580 - RNA, 9876 nt, synthetic construct
  misc_feature 1..9876: note = derived and/or modified CDS sequence (opt3) from DENV-2__KC294220__SS-prME
  source 1..9876: mol_type = other RNA
accgcaggcgtgatcgtcatgctgattcccacagctatggcattccacctcactacgaggaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccattactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagacccggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgtattttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatgatcatccccaagaatttcgcaggccccgtcagccagcacaactaccgacctggttatcatacccaaacagctggcccatggcacctcgggaagctggaaatggattttgacttctgtgagggaactaccgtggttgtgacagaagattgcggcaatagagggccctctctaaggacgaccactgcctccggaaaactgattacagagtggtgctgtcgctcatgcaccctcccgcctctgcggtacagaggcgaggacggttgttggtacgggatggaaatcaggccacttaaggagaaggaagagaacttggtcaatagtctggtgactgcgggacatggccagattgataactttagcttaggtgttctcggcatggccctgttccttgaagagatgctgcgcacacgagtggggaccaaacacgctatattgctcgtagcactgtcgtttgtcacgctaatcactggaaatatgtccttccgggacctgggccgtgtgatggtgatggtcggggccaccatgacagatgacattggaatgggcgttacctatctcgctctgcttgccgcatttaaggtgagacccactttcgcggccggtttgctgttaaggaaactcacatctaaggagctgatgatggctaccatcgggattgcccttctgagccagtcaacactacctgaaactatcctcgagctgaccgatgcattggctctgggaatgatggccttaaaaatagtacgcaacatggaaaagtaccaactcgcagtgacgatcatggccattagttgcgtccccaatgctgtgatcctgcagaacgcgtggaaggtttcctgtacaattcttgccgcagtgtctgtcagcccactgttgctcacctcctcacagcagaaagctgactggatccctctggccctaactataaagggcctgaatcccaccgccatttttcttacaactctcagccggaccagtaaaaagagatcttggccactgaacgaggctatcatggcagtgggcatggtttccatcttggccagctcgctgctaaagaatgacattccgatgacggggcctctcgtggcgggaggtctgcttacagtctgctatgtactgaccggcaggtcagctgatttggaactcgagcgagccgcagacgtgaagtgggaggatcaagccgaaatatctgggagttcccccatcctgagcattactatctctgaggacggaagcatgtccattaaaaacgaagaggaggaacagacactaaccatcctgatacgcactggccttctcgttatctcaggtgtgttcccagtcagtattcccatcacagctgcagcctggtacctgtgggaggtgaagaagcagcgggcgggggtattgtgggatgtgcctagcccaccccctgtcggaaaagctgaattagaggacggcgcctatagaattaagcagaggggcatcctggggtactctcaaataggagccggtgtttataaagaaggcacctttcacacgatgtggcatgtgactcgtggggcagtgctcatgcaccgcggaaagcggattgagccgtcctgggctgatgtcaaaaaggacctgatctcatacggcggtgggtggaaacttgagggagaatggaaagagggcgaagaggtgcaggttctggccttggaaccaggcaagaatcccagagcagtacagaccaaacctgggatcttcaagacaaacaccggaacaattggtgctgtgagtctagattttagcccaggcacttccgggtctcccatcgtcgacaggaaaggaaaggtggttggcctgtacggtaatggggtggtcacccgatcgggagcctatgtgagcgcgatagcccagacggagaagtcaattgaggataaccctgaaatcgaggacgatattttccggaaaaagcgcctcacaatcatggacctgcatccgggcgcaggcaaaactaagagataccttcccgctatagtaagggaagccattaaacgggggttacgaaccctgatcctcgctccaacaagagtcgtggcagccgagatggaagaggccttgcgcggactgcctatcaggtatcaaacccccgctattcgtgcggagcacactggtcgggaaatcgttgacctcatgtgtcatgcaaccttcacaatgagactgctttccccagtgagggtccctaactacaatctgattataatggatgaggcccactttacggaccccgctagtatcgccgcacgcggctatatttctactcgagtggaaatgggggaggccgctggaatcttcatgaccgcgacaccaccgggcagcagagatccttttccccagtccaacgccccaatcatggacgaggaacgggagattcccgaaaggtcatggaactctggtcacgagtgggttaccgatttcaaggggaagactgtgtggtttgtccctagcataaaagcaggaaacgacatcgctgcctgcttgcgcaagaatggcaaaaaggtgattcagctaagtcgtaaaacattcgattccgaatacgtaaagaccagagcaaacgactgggattttgtggttacgactgacatcagcgagatgggcgccaatttcaaggctgagcgggtcattgatccaaggcgctgtatgaaacccgtgatcctgacagacggggaggaacgagtgatactcgccggacctatgccggtcacccattcttcagcggcacaaagacggggtaggatcggccgcaacccaaagaatgaaaacgaccagtatatttacatgggggagcccttagaaaatgatgaggactgcgcccactggaaagaggctaagatgctgcttgataacatcaatacccctgaaggaattatcccctccatgtttgagccagaaagagagaaagtagacgccatagatggcgaatacaggctgcggggtgaggctcgtaagactttcgtggacctcatgcgccgaggggatttgcctgtttggctggcatataaagtggccgctgagggcattaactacgccgacagaaagtggtgttttgatggaatcaagaataaccagattctcgaagagaacgtcgaagtggagatctggacaaaagagggcgaaaggaagaaactgaagccccggtggcttgacgcacgcatatatagtgatccactagcgctgaaagagttcaaggagttcgccgctgggagaaagagcttgaccttaaatctgatcacagagatgggaaggctccctacttttatgacgcagaaagcccggaacgcactggacaatcttgctgttctgcataccgccgaagtgggtggcaaggcatacacacacgccctctcggagttgccggagactctggaaaccctactgctccttacactgttagctgcggtcaccgggggaattttcttgtttctgatgtctggcaaaggtatcgggaagatgactctcggcatgtgctgcattatcacggcctccatactgctttggtatgcacaaattcagccccactggatcgctgccagcatcattctggagttctttctcatcgtgttgctgataccagaacctgagaaacagcgaaccccacaggataaccaattaacatacgtagtgattgccatcctaactgttgtcgcagctaccatggccaatgaaatgggattcctggagaagacaaagaaagacctcggctttgggtcaattaccactcaggagagtgaatctaacatccttgacatagatctgagaccagcgtccgcttggacattgtatgccgtggcaacgaccttcgtgactcctatgctgcgccatagcatcgaaaattcaagtgtcaacgttagcctcacagccattgctaatcaggcaaccgtgctgatgggacttggtaagggctggcccctctccaaaatggacatcggggtaccgctgttggccattggatgttactctcaggtgaacccaatcaccctgacagcggctttactactgctcgtcgcccactacgcaattatcggccctggtcttcaagccaaggctactagggaagcccagaaacgggcagctgccgggataatgaagaatcccacggtggatggcattaccgttatcgacctggagccaatcccctatgatcctaagtttgaaaaacagttgggacaggtgatgctgctcattctgtgcgtcacacaagtacttatgatgcgtactacctgggcgttatgtgaggccctgacactcgcaaccggcccgataagcactttgtgggaggggaaccccggaagattctggaatacgacaatcgctgtgtccatggccaacatttttaggggctcatacctggccggtgctgggctactgttctctatcatgaagaataccactaacacccgccggggaacaggcaatgttggtgaaactctcggcgagaaatggaagagtcgacttaacgccctggggaaatcggaatttcagatttataagaaaagcggaatccaggaggtggacagaaccttggccaaggagggcataaagagaggggaaacagatcatcacgcggtctcccgcggatctgctaaactgcggtggttcgtggagagaaacatggtcacgccagaaggcaaggtggttgacctcggttgcgggcgtggaggctggtcatactattgtggtggcctgaaaaatgtgagggaggtaaaggggttaaccaaaggaggccctgggcatgaggaacccatccctatgagcacttacggatggaaccttgtgcggctgcaatccggcgtcgatgttttctttacaccacccgagatgtgcgacaccctcctatgtgatattggtgaaagttctcctaatccaactatcgaggcagggcgcacactgcgagtgttgaacctggtcgaaaattggctcaacaataacacccagttctgcattaaggtgcttaatccctatatgccgagcgtaatcgagaagatggaaacgctgcagagaaaatacggaggcgccttggtgaggaaccctctgtcaagaaattccacccacgagatgtactgggttagtaacgctacaggcaatatagtgagctctgtcaacatgatttcccgcatgctcatcaatagatttactatgaagcacaaaaaggccacctatgagccagacgtggatttagggtcaggaacaaggaacatcggtattgaaagcgagatacccaacctggacatcgtcggcaaacgaattgaaaagatcaagcaggagcatgaaacttcgtggcactacgaccaagatcatccttataaaacctgggcataccacgggtcttatgagacaaagcagaccggaagtgcctccagcatggtgaatggcgttgtacggcttctgactaaaccatgggacgtggtccccatggtgacgcagatggctatgacagataccactccgttcggtcagcaacgtgtttttaaggagaaagtggacaccagaacacaggaacctaaggaggggacgaagaaactaatgaagattaccgcggaatggctctggaaagagctgggaaaggagaaaactccccgcatgtgtacaagggaagagttcacccggaaggtcagatcaaacgccgcattgggcgctgtgtttactgatgaaaataaatggaagtccgcccgcgaggcagtagaagacggcaggttctgggagctggtggatcgagagcggaacctccaccttgaagggaagtgcgagacatgtgtttacaatatgatgggaaaaagagaaaagaaactgggtgagtttggcaaggccaaagggtctagggctatctggtatatgtggttaggagcccgcttcctggaatttgaggcgttgggcttcctcaacgaggaccattggtttagccgtggtaatagtctgtccggggtcgaaggagagggcctacaccggcttggctacatactgagagaagtggggaagaaggagggaggtgcaatgtacgccgatgacaccgctggctgggatacaaggatcactctcgaagacctgaaaaacgaggagatggtgaccaatcatatgaagggggaacacaaaaagttggccgaggcaattttcaaactgacgtatcagaacaaggtcgttcgcgtgcagcgaccaacccctcggggaacagtaatggacatcattagcagaaaggatcaaaggggctctggtcaggtggggacttacggactcaataccttcacaaacatggaagctcagcttatccgccaaatggagggcgagggcatttttaaatcaatacagcatctgactgccaccgaagagatcgctgtccagaattggttagccagagtggggcgggaaaggctgagtcgtatggcaatttccggagacgattgcgttgtgaagcccatcgacgatcgattcgcgagcgccttgacggctctcaacgacatgggtaaagtccgcaaggatatccagcaatgggagccatctagaggctggaatgactggacacaggtgcccttttgctcgcaccacttccatgaactggtaatgaaagatgggcgggttctagtggtcccttgtaggaaccaggacgagcttattggacgcgccagaatatcacagggcgcaggttggagcctgaaggagaccgcttgcctcgggaagtcctatgcccaaatgtggactctgatgtactttcaccggagggatttgcgattagcagccaacgcgatctgtagtgctgtgccatctcattgggtgccgacaagccgtaccacttggtccattcacgccaaacacgaatggatgaccacagaggacatgctggtcgtttggaatagagtgtggatccaggaaaacccctggatggaggataagacgcctgtagaatcatgggaggaggtgccatatctcggaaaacgcgaagaccagtggtgcggcagtcttattggcctgacctctcgggcaacttgggccaagaatatccagacagctataaaccaagtcaggagcctaatcgggaatgagggatacaccgactatatgccctccatgaaaagattccgccgggaagaggaagaggccggtgtgctgtggtga

SEQ ID NO: 14581 - RNA, 9876 nt, synthetic construct
  misc_feature 1..9876: note = derived and/or modified CDS sequence (opt3) from DENV-2__KC294221__SS-prME
  source 1..9876: mol_type = other RNA
accgccggagtgatcgtcatgctgattcccacggctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccattactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagaggggaaaagaaattaagatcacaccgcagtcctcaaccactgaggccgaactgaccggctatggtacagtgaccatggagtgtagtccccggactgggcttgatttcaacgaaatggtactgttgcaaatggaggacaaagcatggctcgtgcaccgtcagtggtttctggatttacctctgccatggctccccggcgctgacacacagggaagcaattggatacagaaggagacgcttgtcaccttcaagaaccctcacgccaaaaagcaagacgtggttgtgctgggctctcaggaaggggcgatgcatactgccttgacaggagcaaccgagattcagatgtcctcaggtaatctactgtttacaggccacctcaaatgccgcctgagaatggataaacttcaactgaaagggatgagctacagtatgtgtactggaaagttcaagatcgtcaaagaaatcgctgagacccagcatggcacgattgtgatcagggtacagtatgagggtgacgggtctccatgcaagattcccttcgaaataaccgatttggagaaacggcacgttctcggccgactgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgcggcgctaaaagaatggccatcctaggggacactgcatgggatttcggatccctcggcggtgtttttacctcaattgggaaggccctgcatcaggtgttcggcgctatctacggagcggcatttagtggcgtaagctggacgatgaaaattcttatcggggtcataatcacatggattggaatgaactccaggtctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccacgaggaaggtatttgtggcatccggtccgtcacccgcctcgagaatctgatgtggaaacagattacacccgagttaaaccatatcctgtctgaaaatgaggtgaagctaacgataatgaccggggacatcaaaggaattatgcaggctggcaagagatcgctcaggcctcaaccaactgaactgaaatatagctggaagacatgggggaaggccaaaatgctttccaccgagtcacacaaccagacattcttgatcgatggaccggaaactgcagagtgccccaataccaaccgtgcgtggaatagtctggaggtggaagactacggctttggtgtcttctctacgaacatttggctcaagctgcgggagaaacaggacgtattttgtgatagcaagttaatgtccgctgccatcaaagacaatcgagcagtgcatgccgatatggggtattggatagaatcagctctgaacgacacatggaagatggagaaggccagcttcattgaggtgaaatcttgccactggcctaagtcccacaccctttggagtaatggagtattggaaagcgagatgatcatccccaagaacttcgcaggccccgtctctcagcataactacagacctggttatcacactcaaaccgctggcccatggcatctcgggaagctggaaatggattttgacttctgtgagggaacaactgtggttgtgaccgaagattgcggcaatagggggccctccctacgcacaacgaccgcctcaggaaaactgattactgagtggtgctgtcggagttgcacactcccgcctctgagatacaggggcgaggacggttgttggtacgggatggaaatccgcccacttaaggagaaggaagagaacttggtcaatagcctggtgaccgcgggacacggccagattgataacttttcgttaggtgttctcggcatggccctgttccttgaagagatgctgcgaactcgggtggggacaaaacatgctatattgctcgtagcactgtcctttgtcaccctaatcacgggaaatatgtctttccgtgacctgggcagagtgatggtgatggtcggggccactatgaccgatgacattggaatgggcgttacatatctcgctctgcttgccgcatttaaggtgaggcccaccttcgcggccggtttgctgttacgcaaactcactagcaaggagctgatgatggctacaatcgggattgcccttctgtcacagagtaccctacctgaaacaatcctcgagctgactgatgcattggctctgggaatgatggccttaaaaatagtacggaacatggaaaagtaccaactcgcagtgaccatcatggccatttcctgcgtccccaatgctgtgatcctgcagaacgcgtggaaggtttcttgtacgattcttgccgcagtgagcgtctccccactgttgctcacatcaagccagcagaaagctgactggatccctctggccctaaccataaagggcctgaatcccactgccatttttcttaccacactcagtagaacttctaaaaagaggtcctggccactgaacgaggctatcatggcagtgggcatggttagcatcttggcctcgtcactgctaaagaatgacattccgatgaccgggcctctcgtggcgggaggtctgcttacggtctgctatgtactgacaggccgatctgctgatttggaactcgagcgcgccgcagacgtgaagtgggaggatcaagccgaaataagtgggtccagccccatcctgtctattaccatcagcgaggacggatccatgtcaattaaaaacgaagaggaggaacagactctaacaatcctgatacggaccggccttctcgttatcagtggtgtgttcccagtcagcattcccatcactgctgcagcctggtacctgtgggaggtgaagaagcagagagcgggggtattgtgggatgtgccttctccaccccctgtcggaaaagctgaattagaggacggcgcctataggattaagcagcgtggcatcctggggtactcccaaataggagccggtgtttataaagaaggcacatttcacaccatgtggcacgtgacgcgcggggcagtgctcatgcatcggggaaagagaattgagccgtcatgggctgatgtcaaaaaggacctgatcagttacggcggtgggtggaaacttgagggagaatggaaagagggcgaagaggtgcaggttctggccttggaaccaggcaagaatcccagggcagtacagactaaacctgggatcttcaagaccaacacaggaaccattggtgctgtgagcctagatttttccccaggcacatctgggtcgcccatcgtcgaccgaaaaggaaaggtggttggcctgtacggtaatggggtggtcactcggagcggagcctatgtgtcagcgatagcccagaccgagaagtccattgaggataaccctgaaatcgaggacgatattttccgcaaaaagagactcacgatcatggacctgcacccgggcgcaggcaaaacaaagaggtaccttcccgctatagtacgggaagccattaaacgagggttaagaactctgatcctcgctccaacccgcgtcgtggcagccgagatggaagaggccttgaggggactgcctatccgttatcaaacacccgctattcgggcggagcataccggtagagaaatcgttgacctcatgtgtcacgcaactttcaccatgaggctgcttagtccagtgcgcgtccctaactacaatctgattataatggatgaggcccattttacagaccccgcttctatcgccgcacgaggctatattagcacgagagtggaaatgggggaggccgctggaatcttcatgactgcgaccccaccgggctcccgggatccttttccccagtcaaacgccccaatcatggacgaggaaagggagattcccgaacgctcttggaatagcggtcacgagtgggttacagatttcaaggggaagaccgtgtggtttgtccctagtataaaagcaggaaacgacatcgctgcctgcttgcgtaagaatggcaaaaaggtgattcagctatccagaaaaactttcgatagcgaatacgtaaagacacgggcaaacgactgggattttgtggttaccacggacatctctgagatgggcgccaatttcaaggctgagagggtcattgatccacgccgatgtatgaaacccgtgatcctgactgacggggaagagagagtgatactcgccggacctatgccggtcacacactcatccgcggcacaacggaggggtcgcatcggcagaaacccaaagaatgaaaacgaccagtatatttacatgggggagcccttagaaaatgatgaggactgcgcccattggaaagaggctaagatgctgcttgataacatcaatacccctgaaggaattatccccagtatgtttgagccagaaagggagaaagtagacgccatagatggcgaataccggctgcgtggtgaggctcgcaagaccttcgtggacctcatgcgaagaggggatttgcctgtttggctggcatataaagtggccgctgagggcattaactacgccgacaggaagtggtgttttgatggaatcaagaataaccagattctcgaagagaacgtcgaagtggagatctggactaaagagggcgaacggaagaaactgaagccccgctggcttgacgcaagaatatatagcgatccactagcgctgaaagagttcaaggagttcgccgctgggaggaagtcgttgacattaaatctgatcaccgagatgggacggctccctacatttatgactcagaaagcccgaaacgcactggacaatcttgctgttctgcacacggccgaagtgggtggcaaggcatacacccatgccctctctgagttgccggagacactggaaactctactgctccttaccctgttagctgcggtcacagggggaattttcttgtttctgatgtccggcaaaggtatcgggaagatgaccctcggcatgtgctgcattatcactgccagcatactgctttggtatgcacaaattcagccccactggatcgctgcctcaatcattctggagttctttctcatcgtgttgctgataccagaacctgagaaacagagaacgccccaggataaccaattaacctacgtagtgattgccatcctaacagttgtcgcagctactatggccaatgaaatgggattcctggagaagaccaagaaagacctcggctttgggagtattacaacccaggagtctgaatccaacatccttgacatagatctgcgcccagcgagcgcttggactttgtatgccgtggcaacaacgttcgtgacccctatgctgaggcactcaatcgagaatagtagcgtcaacgtttccctcactgccattgctaatcaggcaacagtgctgatgggacttggtaagggctggcccctctctaaaatggacatcggggtaccgctgttggccattggatgttacagccaggtgaacccaatcaccctgaccgcggctttactactgctcgtcgcccattacgcaattatcggccctggtcttcaagccaaggctacacgggaagcccagaaacgtgcagctgccgggataatgaagaatcccactgtggatggcattacggttatcgacctggagccaatcccctatgatcctaagtttgaaaaacagttgggacaggtgatgctgctcattctgtgcgtcacccaagtacttatgatgagaacaacttgggcgttatgtgaggccctgaccctcgcaacaggcccgatatccaccttgtgggaggggaaccccggaaggttctggaatactacgatcgctgtgtcaatggccaacatttttcgcggctcttacctggccggtgctgggctactgttcagtatcatgaagaatacaaccaacactcggcgaggaaccggcaatgttggtgaaacactcggcgagaaatggaagtcgagacttaacgccctggggaaaagcgaatttcagatttataagaaatccggaatccaggaggtggacaggactttggccaaggagggcataaagcgcggggaaaccgatcaccatgcggtctctcggggatcagctaaactgagatggttcgtggagcgtaacatggtcacaccagaaggcaaggtggttgacctcggttgcgggaggggaggctggagctactattgtggtggcctgaaaaatgtgcgggaggtaaaggggttaacgaaaggaggccctgggcacgaagaaccaatccctatgtccacctacggatggaaccttgtgcgcctgcaaagtggcgtcgatgttttctttactccacccgagaagtgcgacacactcctatgtgatattggtgaatctagccctaatccaaccatcgaggcagggcgaactctgagagtgttgaacctggtcgaaaattggctcaacaataacacacagttctgcattaaggtgcttaatccctatatgccgtcagtaatcgagaaaatggaaaccctgcagaggaagtacggaggcgccttggtgcggaaccctctgtcccgcaatagtacgcatgagatgtactgggttagcaacgctaccggcaatatagtgtcttccgtcaacatgatttcaagaatgctcatcaataggtttacaatgaaacacaagaaagccacttatgagccagacgtggatttagggagcggaacccgaaacatcggtattgaatcggagatacccaacctggacatcgtcggcaagcggattgaaaagatcaaacaggagcacgaaacatcttggcattacgaccaagatcacccttataagacttgggcataccatgggagttatgagaccaaacagacaggatccgccagctcaatggtgaatggcgttgtacgtcttctgaccaagccatgggacgtggtccccatggtgactcagatggctatgacggatacaaccccgttcggtcagcaaagagtttttaaagagaaggtggacactcgcacccaggaacctaaggaggggacgaaaaagctaatgaaaattacagcggaatggctctggaaggagctgggaaaagagaagacccccaggatgtgtactcgggaagagttcacaagaaaagtccgctccaacgccgcattgggcgctgtgtttaccgatgaaaataagtggaagtctgccagggaggcagtagaagacggccgattctgggagctggtggatcgggagagaaacctccaccttgaagggaaatgcgagacttgtgtttacaatatgatgggaaagagggagaaaaagctgggtgagtttggcaaagccaaggggagccgcgctatctggtatatgtggttaggagcccgtttcctggaatttgaggcgttgggcttcctcaacgaggaccactggtttagtcggggtaattccctgagcggggtcgaaggagagggcctacatagacttggctacatactgagggaagtggggaagaaagagggaggtgcaatgtacgccgatgacacagctggctgggatacccgcatcacactcgaagacctgaagaacgaggagatggtgactaatcacatgaaaggggaacataagaaattggccgaggcaattttcaagctgacctatcagaacaaggtcgttcgagtgcagcggccaacgcctagaggaaccgtaatggacatcatttctaggaaagatcaacgcggctcaggtcaggtggggacatacggactcaatactttcaccaacatggaagctcagcttatcagacaaatggagggcgagggcatttttaagagtatacagcacctgacagccactgaagagatcgctgtccagaattggttagcccgggtggggagggaacgtctgtcccgaatggcaattagcggagacgattgcgttgtgaaacccatcgacgatcgcttcgcgtctgccttgaccgctctcaacgacatgggtaaggtcagaaaagatatccagcaatgggagccatcgcggggctggaatgactggacacaggtgcccttttgctcacatcacttccacgaactggtaatgaaggatgggagggttctagtggtcccttgtcgcaaccaggacgagcttattggcagagcacggataagccagggcgcaggttggtccctgaaggagacagcttgcctcgggaaaagttatgcccaaatgtggaccctgatgtactttcataggcgagatttgcgtttagcagccaacgcgatctgttctgctgtgccaagccactgggtgccgacttccagaacaacctggtcaattcatgccaagcacgaatggatgactaccgaggacatgctggtcgtttggaatcgcgtgtggatccaggaaaacccctggatggaggataaaacacctgtagaaagttgggaggaggtgccatatctcggaaagcgggaagaccagtggtgcggctctcttattggcctgacgagcagggcaacctgggccaaaaatatccagactgctataaaccaagtcagatccctaatcgggaatgagggatacacagactatatgccctcaatgaagcgcttccggagggaagaggaagaggccggtgtgctgtggtga

SEQ ID NO: 14582 - RNA, 9876 nt, synthetic construct
  misc_feature 1..9876: note = derived and/or modified CDS sequence (opt3) from DENV-2__KC294223__SS-prME
  source 1..9876: mol_type = other RNA
accgcaggcgtgatcgtcatgctgattcccacagctatggcattccacctcactacgaggaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccattactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagacccggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataaacttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgtattttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatgatcatccccaagaatttcgcaggccccgtcagccagcacaactaccgacctggttatcatacccaaacagctggcccatggcacctcgggaagctggaaatggattttgacttctgtgagggaactaccgtggttgtgacagaagattgcggcaatagagggccctctctaaggacgaccactgcctccggaaaactgattacagagtggtgctgtcgctcatgcaccctcccgcctctgcggtacagaggcgaggacggttgttggtacgggatggaaatcaggccacttaaggagaaggaagagaacttggtcaatagtctggtgactgcgggacatggccagattgataactttagcttaggtgttctcggcatggccctgttccttgaagagatgctgcgcacacgagtggggaccaaacacgctatattgctcgtagcactgtcgtttgtcacgctaatcactggaaatatgtccttccgggacctgggccgtgtgatggtgatggtcggggccaccatgacagatgacattggaatgggcgttacctatctcgctctgcttgccgcatttaaggtgagacccactttcgcggccggtttgctgttaaggaaactcacatctaaggagctgatgatggctaccatcgggattgcccttctgagccagtcaacactacctgaaactatcctcgagctgaccgatgcattggctctgggaatgatggccttaaaaatagtacgcaacatggaaaagtaccaactcgcagtgacgatcatggccattagttgcgtccccaatgctgtgatcctgcagaacgcgtggaaggtttcctgtacaattcttgccgcagtgtctgtcagcccactgttgctcacctcctcacagcagaaagctgactggatccctctggccctaactataaagggcctgaatcccaccgccatttttcttacaactctcagccggaccagtaaaaagagatcttggccactgaacgaggctatcatggcagtgggcatggtttccatcttggccagctcgctgctaaagaatgacattccgatgacggggcctctcgtggcgggaggtctgcttacagtctgctatgtactgaccggcaggtcagctgatttggaactcgagcgagccgcagacgtgaagtgggaggatcaagccgaaatatctgggagttcccccatcctgagcattactatctctgaggacggaagcatgtccattaaaaacgaagaggaggaacagacactaaccatcctgatacgcactggccttctcgttatctcaggtgtgttcccagtcagtattcccatcacagctgcagcctggtacctgtgggaggtgaagaagcagcgggcgggggtattgtgggatgtgcctagcccaccccctgtcggaaaagctgaattagaggacggcgcctatagaattaagcagaggggcatcctggggtactctcaaataggagccggtgtttataaagaaggcacctttcacacgatgtggcatgtgactcgtggggcagtgctcatgcaccgcggaaagcggattgagccgtcctgggctgatgtcaaaaaggacctgatctcatacggcggtgggtggaaacttgagggagaatggaaagagggcgaagaggtgcaggttctggccttggaaccaggcaagaatcccagagcagtacagaccaaacctgggatcttcaagacaaacaccggaacaattggtgctgtgagtctagattttagcccaggcacttccgggtctcccatcgtcgacaggaaaggaaaggtggttggcctgtacggtaatggggtggtcacccgatcgggagcctatgtgagcgcgatagcccagacggagaagtcaattgaggataaccctgaaatcgaggacgatattttccggaaaaagcgcctcacaatcatggacctgcatccgggcgcaggcaaaactaagagataccttcccgctatagtaagggaagccattaaacgggggttacgaaccctgatcctcgctccaacaagagtcgtggcagccgagatggaagaggccttgcgcggactgcctatcaggtatcaaacccccgctattcgtgcggagcacactggtcgggaaatcgttgacctcatgtgtcatgcaaccttcacaatgagactgctttccccagtgagggtccctaactacaatctgattataatggatgaggcccactttacggaccccgctagtatcgccgcacgcggctatatttctactcgagtggaaatgggggaggccgctggaatcttcatgaccgcgacaccaccgggcagcagagatccttttccccagtccaacgccccaatcatggacgaggaacgggagattcccgaaaggtcatggaactctggtcacgagtgggttaccgatttcaaggggaagactgtgtggtttgtccctagcataaaagcaggaaacgacatcgctgcctgcttgcgcaagaatggcaaaaaggtgattcagctaagtcgtaaaacattcgattccgaatacgtaaagaccagagcaaacgactgggattttgtggttacgactgacatcagcgagatgggcgccaatttcaaggctgagcgggtcattgatccaaggcgctgtatgaaacccgtgatcctgacagacggggaagaacgagtgatactcgccggacctatgccggtcacccattcttcagcggcacaaagacggggtaggatcggccgcaacccaaagaatgaaaacgaccagtatatttacatgggggagcccttagaaaatgatgaggactgcgcccactggaaagaggctaagatgctgcttgataacatcaatacccctgaaggaattatcccctccatgtttgagccagaaagagagaaagtagacgccatagatggcgaatacaggctgcggggtgaggctcgtaagactttcgtggacctcatgcgccgaggggatttgcctgtttggctggcatataaagtggccgctgagggcattaactacgccgacagaaagtggtgttttgatggaatcaagaataaccagattctcgaagagaacgtcgaagtggagatctggacaaaagagggcgaaaggaagaaactgaagccccggtggcttgacgcacgcatatatagtgatccactagcgctgaaagagttcaaggagttcgccgctgggagaaagagcttgaccttaaatctgatcacagagatgggaaggctccctacttttatgacgcagaaagcccggaacgcactggacaatcttgctgttctgcataccgccgaagtgggtggcaaggcatacacacacgccctctcggagttgccggagactctggaaaccctactgctccttacactgttagctgcggtcaccgggggaattttcttgtttctgatgtctggcaaaggtatcgggaagatgactctcggcatgtgctgcattatcacggcctccatactgctttggtatgcacaaattcagccccactggatcgctgccagcatcattctggagttctttctcatcgtgttgctgataccagaacctgagaaacagcgaaccccacaggataaccaattaacatacgtagtgattgccatcctaactgttgtcgcagctaccatggccaatgaaatgggattcctggagaagacaaagaaagacctcggctttgggtcaattaccactcaggagagtgaatctaacatccttgacatagatctgagaccagcgtccgcttggacattgtatgccgtggcaacgaccttcgtgactcctatgctgcgccatagcatcgaaaattcaagtgtcaacgttagcctcacagccattgctaatcaggcaaccgtgctgatgggacttggtaagggctggcccctctccaaaatggacatcggggtaccgctgttggccattggatgttactctcaggtgaacccaatcaccctgacagcggctttactactgctcgtcgcccactacgcaattatcggccctggtcttcaagccaaggctactagggaagcccagaaacgggcagctgccgggataatgaagaatcccacggtggatggcattaccgttatcgacctggagccaatcccctatgatcctaagtttgaaaaacagttgggacaggtgatgctgctcattctgtgcgtcacacaagtacttatgatgcgtactacctgggcgttatgtgaggccctgacactcgcaaccggcccgataagcactttgtgggaggggaaccccggaagattctggaatacgacaatcgctgtgtccatggccaacatttttaggggctcatacctggccggtgctgggctactgttctctatcatgaagaataccactaacacccgccggggaacaggcaatgttggtgaaactctcggcgagaaatggaagagtcgacttaacgccctggggaaatcggaatttcagatttataagaaaagcggaatccaggaggtggacagaaccttggccaaggagggcataaagagaggggaaacagatcatcacgcggtctcccgcggatctgctaaactgcggtggttcgtggagagaaacatggtcacgccagaaggcaaggtggttgacctcggttgcgggcgtggaggctggtcatactattgtggtggcctgaaaaatgtgagggaggtaaaggggttaaccaaaggaggccctgggcatgaggaacccatccctatgagcacttacggatggaaccttgtgcggctgcaatccggcgtcgatgttttctttacaccacccgagaagtgcgacaccctcctatgtgatattggtgaaagttctcctaatccaactatcgaggcagggcgcacactgcgagtgttgaacctggtcgaaaattggctcaacaataacacccagttctgcattaaggtgcttaatccctatatgccgagcgtaatcgagaaaatggaaacgctgcagagaaagtacggaggcgccttggtgaggaaccctctgtcaagaaattccacccacgagatgtactgggttagtaacgctacaggcaatatagtgagctctgtcaacatgatttcccgcatgctcatcaatagatttactatgaaacacaagaaagccacctatgagccagacgtggatttagggtcaggaacaaggaacatcggtattgaaagcgagatacccaacctggacatcgtcggcaagcgaattgaaaagatcaaacaggagcatgaaacttcgtggcactacgaccaagatcatccttataagacctgggcataccacgggtcttatgagacaaaacagaccggaagtgcctccagcatggtgaatggcgttgtacggcttctgactaagccatgggacgtggtccccatggtgacgcagatggctatgacagataccactccgttcggtcagcaacgtgtttttaaagagaaggtggacaccagaacacaggaacctaaggaggggacgaaaaagctaatgaaaattaccgcggaatggctctggaaggagctgggaaaagagaagactccccgcatgtgtacaagggaagagttcacccggaaagtcagatcaaacgccgcattgggcgctgtgtttactgatgaaaataagtggaagtccgcccgcgaggcagtagaagacggcaggttctgggagctggtggatcgagagcggaacctccaccttgaagggaaatgcgagacatgtgtttacaatatgatgggaaagagagagaaaaagctgggtgagtttggcaaagccaaggggtctagggctatctggtatatgtggttaggagcccgcttcctggaatttgaggcgttgggcttcctcaacgaggaccattggtttagccgtggtaatagtctgtccggggtcgaaggagagggcctacaccggcttggctacatactgagagaagtggggaagaaagagggaggtgcaatgtacgccgatgacaccgctggctgggatacaaggatcactctcgaagacctgaagaacgaggagatggtgaccaatcatatgaaaggggaacacaagaaattggccgaggcaattttcaagctgacgtatcagaacaaggtcgttcgcgtgcagcgaccaacccctcggggaacagtaatggacatcattagcagaaaagatcaaaggggctctggtcaggtggggacttacggactcaataccttcacaaacatggaagctcagcttatccgccaaatggagggcgagggcatttttaagtcaatacagcatctgactgccaccgaagagatcgctgtccagaattggttagccagagtggggcgggaaaggctgagtcgtatggcaatttccggagacgattgcgttgtgaaacccatcgacgatcgattcgcgagcgccttgacggctctcaacgacatgggtaaggtccgcaaagatatccagcaatgggagccatctagaggctggaatgactggacacaggtgcccttttgctcgcaccacttccatgaactggtaatgaaggatgggcgggttctagtggtcccttgtaggaaccaggacgagcttattggacgcgccagaatatcacagggcgcaggttggagcctgaaggagaccgcttgcctcgggaaatcctatgcccaaatgtggactctgatgtactttcaccggagggatttgcgattagcagccaacgcgatctgtagtgctgtgccatctcattgggtgccgacaagccgtaccacttggtccattcacgccaagcacgaatggatgaccacagaggacatgctggtcgtttggaatagagtgtggatccaggaaaacccctggatggaggataaaacgcctgtagaatcatgggaggaggtgccatatctcggaaagcgcgaagaccagtggtgcggcagtcttattggcctgacctctcgggcaacttgggccaaaaatatccagacagctataaaccaagtcaggagcctaatcgggaatgagggatacaccgactatatgccctccatgaagagattccgccgggaagaggaagaggccggtgtgctgtggtga

SEQ ID NO: 14583 - RNA, 9876 nt, synthetic construct
  misc_feature 1..9876: note = derived and/or modified CDS sequence (opt3) from DENV-2__FJ906959__SS-prME
  source 1..9876: mol_type = other RNA
accgccggcatgatcattatgctgatacccacagtgatggctttccacctcactacgagaaacggggagcctcatatgatcgtcagcaggcaggaaaagggaaaatcccttctgtttaagaccgaggacggtgttaatatgtgcacattgatggcaatggatttaggcgaactgtgtgaggacactattacctacaaatgcccattcctaaagcaaaacgaaccggaggatatcgactgttggtgcaattctacatcaacctgggtgacttatgggacatgtaccacgactggagagcaccggcgcgaaaaacgaagtgtagccctcgtgccccatgtcggcatgggtctggagacccgtacagaaacttggatgagctccgagggggcgtggaagcacgctcagagaattgagacctggatccttaggcatcctggatttacaataatggccgcaatcctggcctacaccattggcacgactcacttccagcgggctttgatctttattctcctgacagcagtggccccatctatgaccatgcgctgcatcggcatatcgaacagagatttcgttgaaggggtgtcaggaggtagctgggtcgacattgtgctggagcacggcagttgtgtaactacaatggctaagaataaacccaccctcgattttgaattaatcaagacggaggccaaacagcctgcgaccctgaggaagtattgcattgaagcaaaacttacaaacactaccacagactcccggtgtccaactcaaggggagccctctttgaatgaggaacaggataagcgcttcgtttgcaagcatagcatggtggaccgaggatggggcaacggttgtgggctgtttggaaaaggcggcatcgtcacctgcgccatgttcacatgcaagaaaaatatgaaggggaaagtggtgcagcctgagaacctagaatacaccatcgtcattactccacactccggagaggaacatgctgttggtaatgatacgggcaagcacgggaaagagataaagatcacaccgcagtcaagtattaccgaggccgaactcactggatatggcaccgtgacaatggagtgtagccccagaaccggtctggactttaacgaaatggtacttctgcaaatggagaataaggcatggttggtgcacaggcagtggttcctcgatctgcctttaccatggctgcccggggctgacactcagggctctaactggatccagaaagaaacactcgtcacgtttaagaatcctcatgccaaaaagcaagacgtggttgtgcttggatcccaggagggcgcgatgcacaccgccctgactggggcaacagagatacagatgtcaagcggaaacttgctattcaccggtcatctgaaatgccggctccgtatggataagctgcaacttaagggcatgagttactctatgtgtacagggaaattcaaggtcgtgaaagaaattgctgagactcagcacggaaccatcgtaatccgcgttcagtatgaaggcgacggttccccatgcaagattccctttgagatcatggatctggagaaaagacatgtgttggggaggctcattacggtcaacccgatagtgaccgaaaaggacagccctgtcaatatcgaggccgaacccccattcggcgattcgtacattatcatcggagtggagcctggccagctgaagttaaactggtttaaaaaggggtcttccattggacaaatgatagaaacaactatgcggggtgctaaacgaatggccatcctgggcgacaccgcatgggatttcgggtcactaggaggcgtttttacaagtattggtaaggccctccaccaggtgttcggggctatctacggcgcggcatttagcggagtatcctggattatgaaaatcctgataggcgtcatcattacttggatcgggatgaattctcgcagcacctcacttagtgtgtccttggttctggtgggagtcgtgacgctctatctgggcgtaatggtgcaggccgacagcggttgtgttgtctcttggaagaacaaggagcttaaatgcgggtcaggaattttcatcacagataatgtgcacacctggactgagcagtacaagtttcaacccgaaagtccaagcaaactggcttccgccatacagaaggcacatgaggaaggcatttgtggtatcagatctgtgacaaggttggagaacctcatgtggaaacagattacccccgaactgaatcacatcttatcggagaacgaggtcaagctgactataatgaccggcgacatcaaagggattatgcaggccggaaagcggagcctacaacctcagccaacagaactcaagtattcctggaaaacgtggggcaaggctaaaatgctgtcaaccgagagtcataatcagactttccttatcgatgggccggaaacagccgagtgccccaacaccaatcgcgcatggaactctttggaagttgaggactacggatttggcgtgttcacaactaatatttggctgaagctcagagagaaacaggacgtgttttgtgatagcaagctgatgtccgcggctatcaaggacaacagggccgtacacgcagatatgggttattggatagaatcagccttaaatgacacctggaaaattgagaaggctagcttcatcgaagtcaaatcttgccactggcctaagtcccatacgctgtggagtaacggggtgcttgagagcgagatgatcattccaaaaaacttcgccggacccgtttctcaacacaattaccgtcctggctatcatacacagaccgcaggtccatggcacttgggcaagctcgaaatggattttgacttctgtgaggggactaccgtggtcgtgacagaagattgcggaaaccggggcccctccctgcgaactaccacagcttcagggaagctaatcacggagtggtgctgtagaagttgcaccctgccgcctctcaggtaccgcggagaagacggctgttggtacggtatggagattcggccactgaaagagaaggaagagaatcttgttaacagcttggtgactgccgggcatggacagatagataatttttcgctgggcgtattaggtatggcgctcttcctggaagagatgcttagaacaagggtcggcaccaaacacgccatcctgttggtggctgtgtcctttgtcactctcattacagggaacatgtctttccgcgacctgggacgagttatggtgatggtaggcgcaaccatgacggatgacatcgggatgggagtgacttatctagccctgctcgctgcctttaaggtccggcccaccttcgcagcgggcctgcttttgcgtaaactgacaagcaaggaattaatgatgaccactattggtatcgtgctcctgtcacaaagtacaatacctgagaccatccttgagctgacagatgccctagctctcgggatgatggttctgaagatggtgagaaaaatggaaaagtaccagttggccgtcactattatggcaatcctgtgcgtgcccaatgctgttattttacagaacgcctggaaagtgtcctgtaccatcctcgcagtcgtatctgtgagcccactgtttcttacgtcctcacagcaaaaggccgactggatacctctggctttgacaattaaaggactcaatcccaccgcgatcttcctgactaccctaagcaggacaaacaagaaacgcagttggccactgaatgaggccatcatggcagttggcatggtgtctattcttgcttccagcctcctgaagaacgacataccgatgactggccctttggtcgccgggggactgttaaccgtgtgctatgtactcacgggtcggtcggccgatctggaacttgagagagctgcagacgtgaagtgggaagatcaggccgagatctcaggctctagtcccattctgtccatcacaattagcgaggacgggtctatgagcatcaaaaatgaagaggaagagcagaccttgactatactcatcaggacaggactgctagtcatttccggcctgtttccagtttcaatccccattaccgcggctgcctggtacctttgggaggtgaagaaacagcgagcaggtgtgctctgggatgtccctagtccaccccctgtggggaaggccgaactggaggacggagcttatcgcatcaaacaaaagggcatattgggctacagccagattggggcaggagtttataaggaaggtactttccacacaatgtggcatgtaacccggggcgccgtgttaatgcacaaagggaagagaatcgagccgtcttgggcggatgtcaaaaaggacctgatctcctacggaggcggttggaaactcgaaggggagtggaaggagggagaagaggtgcaggttctggctcttgaaccaggcaagaaccccagggccgtgcagacgaaacctggcctgtttaagactaatgcagggaccattggagccgtctcattggatttcagtccaggtacaagcggctcccccatcatagacaaaaaggggaaagtggtaggactatacggcaacggtgtcgtgacccgttctggggcttatgtttcggccattgcacaaacagagaagagcatcgaagataaccctgagattgaggacgatatcttccgcaagcggaaactgactataatggacctccatccgggagctggcaagaccaaaagatacctgcccgccattgtgagggaagcgatcaagcgaggccttcggacgttaatcctggccccaacacgcgtcgtggcagctgagatggaagaggccctcagagggttgcctattaggtatcagactcccgctatccgggcagaacacaccggacgagagattgttgacctgatgtgtcatgccacatttaccatgagactcctgtcaccagtgcgcgtccctaattacaaccttataatcatggatgaggcccacttcactgaccccgcttccattgcggcaaggggttatatcagtacccgtgtggaaatgggcgaggccgctgggatctttatgacagccacgccaccgggatctcgggatcctttcccccagagcaatgcaccaattatggacgaagagagagagatacccgaaaggtcctggtcatctggccacgagtgggtaactgattttaaaggtaagaccgtgtggttcgttcctagcatcaaggccgggaacgacattgctgcgtgcctgcgcaaaaatggaaagaaagtcatccaattgagtcgaaagacatttgattccgaatacgtgaaaaccagaactaacgactgggatttcgtggtcacaaccgacattagcgagatgggcgccaattttaaggcagaacgggtaatcgatccaaggcgctgtatgaaacccgtgatactaacggacggcgaggagcgtgttatcctggctgggcctatgccggtgactcattcttcagccgcacagagacggggaaggattggtcgcaacccaaagaatgaaaacgaccagtatatctacatgggcgagcccctcgaaaatgatgaggactgcgcccactggaaggaagctaaaatgttactggataacattaatacacctgaggggatcataccctccatgttcgagccagaacgagagaaggtcgacgccattgatggagaatacagacttcggggcgaggcgaggaaaacctttgtggacctgatgcgcagaggtgatctccctgtttggttggcatatagggtggccgctgaagggatcaactacgccgaccggcgttggtgtttcgatggcattaagaataaccagatcctggaggagaacgtcgaagtggagatatggaccaaagaaggagagcgcaagaagctcaaaccccgatggctggacgctagaatctatagtgatccacttgcactaaaggagttcaaagaatttgccgctggcaggaagagcctgactttgaatttaattacagagatggggcggctgcctaccttcatgacacaaaaagcccgcgacgcactcgataacctggcggtacttcatactgccgaagctggaggtagagcctacaatcacgcactgtcggagctcccggaaacgttggagaccctgctactgctcacacttctggctactgtgaccggcgggatctttttattcttgatgtctggaaggggcattggtaagatgacactggggatgtgctgcatcataaccgcctccattctcctgtggtatgcacagatccagccccactggatcgccgctagcattatccttgagtttttcctgatagttctcttgattccagaacctgagaagcagcggactccccaagacaaccagctgacgtacgtcgtgatcgcgattttaaccgtggtcgccgcaacaatggctaatgaaatgggctttctagagaaaactaagaaagacctgggactcggctcaatcaccacacagcagccagaaagtaacatacttgatatcgacctgcgacctgcctctgcctggaccttgtatgcagttgctactacattcgtgacgcccatgctgagacattccattgagaatagctcagtaaacgtgagtctcaccgccatcgcgaatcaagctactgtcctgatggggcttggaaagggttggccgctcagcaaaatggatattggcgtgccactgttggccatcgggtgttactcccaggttaaccctattacactgaccgcagccttatttctactggtggctcactacgcaatcataggacccggcctccaggccaaggcgacccgcgaggctcagaagagggccgcagccggtattatgaaaaatccaacagtcgacgggatcactgtaatcgatcttgaccccattccttatgatccgaagttcgaaaaacaactgggccaggtgatgttgctggttctctgcgtgacgcaggtcctgatgatgcggaccacatgggctctttgtgaggccttaactctggcaaccggacccatatctacactctgggaaggcaacccagggcgtttttggaataccactatcgctgtgagcatggccaacattttcagaggatcctacttggcgggcgccggtctgctattttcaatcatgaagaatacgacaaacaccaggcgcgggactggaaatattggcgagaccctgggtgaaaaatggaagtctcggctcaacgcacttggcaaaagtgagttccaaatctataagaagtcggggatacaggaggtcgaccgaacactggctaaagaaggaatcaagagaggcgagactgatcatcacgccgtgagcagggggtccgcaaaattgcgctggttcgttgaacggaacatggtgacccctgagggaaaggtagtggacctgggctgcggtagagggggatggtcttactattgtggcggtctcaaaaatgtccgtgaggttaagggcctgacaaaggggggacccggccatgaagagcctattccaatgtcaacgtacgggtggaacttagtgaggcttcagagcggagtcgatgtgtttttcaccccccctgaaaaatgcgacactctgctctgtgatatcggcgagtccagtccaaatcccacagtagaagctggtcggaccctacgcgtgctgaacttggttgagaattggctgaacaataacactcagttttgcattaaggtgctcaatccgtatatgccttctgtcatcgagaaaatggaagcccttcaacgaaagtacgggggagccctggtgagaaacccattgagcaggaattcaacacacgagatgtactgggtctccaacgcgagtggcaatatagtgagctctgttaacatgatttcccggatgctgatcaatcgcttcaccatgagacacaaaaaggctacgtatgaacccgacgtagacctcggctcagggaccaggaacatcggaattgagagcgaaatacctaacttagatatcattggtaagcgaatcgagaaaattaagcaggagcatgaaacatcgtggcactacgaccaggatcatccatataaaacttgggcataccacggctcttatgagaccaagcagacagggagtgcctccagcatggtgaatggagtcgtgcggctgcttactaaaccctgggacgttgtgccgatggtcacccaaatggctatgacagataccactccttttggccagcagcgtgtgttcaaggaaaaggtagacacgagaacacaggagcccaaagaaggtaccaagaaactgatgaagatcactgccgagtggctatggaaagagctcgggaagaaaaagaccccacgcatgtgtacaagggaagagtttacgcggaaggtgagatcaaacgcagccctgggagctatattcaccgatgaaaataaatggaagtccgcgcgcgaggccgttgaggactctaggttttgggaattggtcgataaagagcgaaacctgcacctcgaaggcaagtgcgagacttgtgtgtacaatatgatgggcaaacgggaaaagaagcttggggagttcggaaaagcaaagggtagcagagctatctggtatatgtggctgggcgccaggtttttagagttcgaagcactggggtttttgaacgaggaccattggttcagtcgcgaaaattccctcagcggagtggagggcgaaggtctgcacaaactagggtacattcttcgtgatgtctctaagaaagagggaggcgccatgtacgctgacgacacagccggctgggatacccggatcactctggaggacctcaagaacgaagagatggttacaaatcatatggaaggggagcacaagaaactggcggaagcaattttcaagttgacctatcaaaacaaagtggtaagagtgcagaggcctacaccccgcggaactgtcatggatatcatttcacgacgggaccagagaggtagtggccaagtggggacctacggactgaatacgtttaccaacatggaggcccagctcataaggcagatggagggcgaaggtgttttcaagtccatccagcatcttacagtgactgaggaaattgctgtccaaaattggctggcccgcgtggggagagagcggttaagcaggatggcaatctctggagatgactgcgtagttaaaccactggatgaccgttttgcttcggccttgaccgctctcaacgatatgggcaaggtgcgaaaggacatccagcagtgggagccctcacgcggctggaatgattggacacaggtccctttctgcagccaccactttcatgaactgattatgaaagacgggagagtgctagtggtcccatgtcggaaccaagatgagcttataggaagggcccgcatctcccagggtgcaggctggagtctgagagaaactgcgtgcctcgggaagtcttatgcccagatgtggagcctgatgtacttccaccggagggacttgcgattagctgccaacgcaatttgttccgctgttccgtcacattgggtgcccaccagtcgtacgacatggtctatccacgccaaacacgagtggatgaccactgaagacatgctgacagtatggaatagagtgtggattcaggagaacccttggatggaggataagaccccagtcgaaagctgggaggaaatcccctatctcggaaaacgcgaggaccaatggtgcggctcccttataggtctgacttcacgggcaacctgggccaagaatatccagacagcgattaaccaggtgaggagcctaatcgggaatgaagagtacacggattatatgccttctatgaagagatttcgccgggaggaagaggaagctggagttctgtggtga

SEQ ID NO: 14584 - RNA, 9876 nt, synthetic construct
  misc_feature 1..9876: note = derived and/or modified CDS sequence (opt3) from DENV-2__KF360005__SS-prME
  source 1..9876: mol_type = other RNA
accgcaggagtgatcattatgaggatacccactgctatggcattccacctgactacgaggaacggggaacctcatatgatcgtcagcaagcaggaaaaggggaagtccctcctttttaaaaccgaagacggtgttaatatgtgcacactgatggccatggatttgggagaattatgtgaagacactattacctacaactgcccactgctgcggcaaaatgaaccggaagatatcgactgttggtgcaactctacatcaacctgggtgacttatgggacatgtaccgcgacgggagaacaccgccgagaaaagcgtagtgtagctctcgtgccccatgtcggcatgggtctggagactagaaccgaaacatggatgagctccgagggggcctggaaacacgcacagaggattgagacttggatccttcggcatcctggattcaccataatggccgctatcctggcatacacaattggcaccacgtattttcagcgcgtgttgatcttcattctcctgactgccgttgctccatctatgacaatgagatgcatcggcatatcgaatagggattttgtggaaggggtctcaggaggtagctgggtggacattgtactggagcacggcagttgtgttaccactatggccaagaacaagcccacactcgatttcgaattaatcaaaaccgaggcgaagcagcctgcaacgctgcggaaatactgcattgaagccaaacttaccaatacaactaccgcttcccgctgtccaacacaaggggagccctctttgaacgaggaacaggacaaacgatttgtgtgcaagcacagcatggtcggaagaggctggggtgatgggtgtggactgttcggcaagggcgggatcgtgacttgcgccatgtttacctgcaaaaagaatatggagggaaaaatcgtgcagcctgaaaacctagagtatacaattgtcgttaccccacattccggtgaagagaatgcagtgggcaacgacactgggaagcacggaaaagagataaaggtaacgccgcagtcaagtatcacagaagctgagctcaccggctacggtactgtgaccatggaatgtagccccaggacagggctggatttcaatgagatggtccttctgcaaatggaaaacaaagcctggttggtgcatcggcagtggtttctcgacctgcctttaccatggctgcccggcgcggatattcagggatctaattggatccagaaggagaccctcgttactttcaagaaccctcacgccaaaaagcaagacgtggtcgtgcttggctcccaggagggggcactgcacacagctttgacgggagccaccgaaatacagatgtcaagcggtaacctactgtttactggccatctcaaatgccgtctgcgcatggacaaacttcaactgaaagggatgagttattctatgtgtacaggaaagttcaaggtagttaaagagattgctgaaacccagcacggcacaatcgtggtcagaatccagtacgagggtgatgggtccccatgcaagattcccttcgagatcatggacttggagaagaggcatgtgctcggccggctgattactgtcaatccgatagtgaccgagaaggatagccctgttaacatcgaagccgagcccccatttggagactcgtacattatcatcggcgtggaacctgggcagttaaaactgtcttggttcaagaagggatcctcaattggtcaaatgtttgagacgaccatgcgaggcgcaaaacgcatggccatactaggggatacagcttgggacttcggaagtctcggcggtgtatttactagcatcgggaaggcgctgcaccaggtcttcggcgcaatttatggagccgctttttccggcgtgtcttggaccatgaaaatccttattggggttgtgatcacatggataggaatgaatagcagatcaacaagtttgtccgtcagcctggtgctcgtaggcgtggttaccctgtaccttggtgtcatggtgcaggccgattctgggtgtgtggtctcatggaggaacaaggagctgaaatgcggaagtggcatcttcattacggacaatgttcatacatggaccgaacagtataagtttcaacccgagagcccatccaagttggcatctgccatccagaaagctcacgaagagggtatttgtggcatccggtcggtgactcgcctcgaaaacctgatgtggaagcagataacacccgagttaaatcacattctgagcgagaacgaagtgaaactatccatcatgaccggggatattaagggaatcatgcaggccggcaaaagatcactcaggcctcaaccaactgagctgaagtacagttggaaaacctgggggaaggcaaagatgctttctacagaaccgcataatcagacgttcttgatagacggacccgagaccgcggaatgccctaacactaatcgtgcttggaacagcctggaggtagaggattatggctttggtgtcttcacaaccaatatctggctcaaactgaaggaacggcaggacgtgttttgtgactccaaattaatgtcagccgcaattaaggataaccgagccgttcacgctgacatggggtactggatcgagagcgccctgaatgatacatggaaaattgaaaaggcatctttcatcgaggtgaagtcctgccattggccaaaaagtcacactctttggagcaacggagtcttggagtctgaaatgataattcccaagaacttcgctggccctgtgtcccagcacaattatagaccaggttaccatacccaaacggccggcccctggcacctcgggaaactggagatggactttgatttctgtgaaggaacaaccgttgtggtaactgaggactgcggcaacagggggccgtcactacgcaccacaactgcgagtggaaagctgatcaccgaatggtgctgtcggagctgcacactccctccactgagatacaggggcgaggatggttgttggtatgggatggagatccgcccccttaaagaaaaggaggaaaatttggtcaactcgctggtgacggccggacatggccagattgacaatttttccttaggtgtgctcggcatggctctgttccttgaggaaatgctgcgaacccgggtcgggactaagcacgcagttttgctcgtggccgtatcttttatgacactgatcaccggaaacatgagcttccgtgatctaggcagagtgatggtcatggtgggggctgccatgactgacgatattggaatgggcgttacatacctggcactcctggcggcctttaaagtgaggcctaccttcgctgccggtcttttgctgcgcaagttaacgtcaaaagagctcatgatgactaccatagggatcgtcctgcttagtcagtccacaacccccgagactattctggaactaacagacgcactcgctctgggaatgatgatcttgaagattgtgcggaatatggagaaatatcaactggccgttaccatcatggcaatattatgcgtgccaaacgccgtcatcctccagaatgcttggaaggtatcttgtacaattctggcggccgtgagcgtttcccctcttctgttgacttcaagccagcagaaggcagattggatccccctcgctctgaccattaaaggcctaaacccaacggccatctttctgacaacccttagtagaactaataagaaaaggtcttggccgctcaacgaagccataatggctgtgggcatggtctccattctggcaagctcgttgctgaagaatgacatccctatgaccgggcccttagtggccggaggtctcctgacagtatgctacgtgcttactggccgatcagcggacctggagttggaacgcgctgccgatgtccggtgggaggaccaagcagaggtttctgggagttccccaatcctcagcattaccatatctgaagatggaagcatgtccatcaaaaacgaggaagaggagcagacgctgacaattctaatcagaaccggcctgcttgtgatttcaggtctcttccccgtgagtatccctataactgccgctgcatggtatctgtgggaagtcaagaaacagagggccggggtgttgagcgcggttccatctccccctccggtaggaaaggctgagttagaagacggcgcctaccgtatcaagcagaaaggcattctggggtattcccaaatcggagccggtgtgtacaaggagggcacatttcataccatgtggcacgtcactcgcggggcagtgctcatgcacaaaggaaagcggattgaaccatcatgggctgatgttagaaaagacctgatcagttacggcggtgggaggaaacttgagggagagtggaaggaaggcgaggaagtgcaggtcctggccttggagcccggcaaaaatcctcgagcagtgcagacaaagccagggctattcaaaaccaacacgggaactataggtgctgtaagcctggatttttcccccggcgcctctgggtcgcctattgtcgacaagaaaggaaaggtggttggcctctatggtaacggggtggtcacccggagcggaacatacgtgtcagcgatcgcccagaccgaaaagtccatcgaggataatccggagattgaagacgatatcttccgcaaaaagagactgacaataatggaccttcatcccggcgcaggcaaaactaagaggtatttaccagctattgttcgggaggccatcaaacgagggctgagaaccctcattttggctcctacgcgcgtggtcgcagccgaaatggaggaagccctgaggggactccccatccgttaccaaacaccagctatacgggcggagcacactggtagagagattgtggatctgatgtgtcatgcaaccttcacaatgaggcttctgagtcctgtacgcgtgcccaactataatttgatcatcatggacgaagcccactttaccgacccagcttctattgccgcacgaggctacatcagcactagagttgagatgggggaagccgctggaattttcatgaccgcgacaccgcctggctcccgggatccctttccacagtcaaacgcccccataatggacgaggagagggaaatccctgagcgctcttggaatagcggtcatgaatgggtcacggatttcaaggggaagactgtgtggtttgtgccaagtattaaagcaggaaacgacatcgctgcctgcctacgtaagaatggcaaaaaggtcatccagctgtccagaaaaaccttcgatagcgagtatattaagacacggaccaacgactgggattttgtagtgactacagacatatctgaaatgggcgcaaatttcaaggccgagagggttatcgatccccgccgatgtatgaaacctgtgattctcaccgacggggaggaaagagtcatcttagctggaccgatgccagtgacgcactcatccgccgcgcaacggaggggtcgcattggcagaaaccccaagaatgagaacgatcagtacatctacatgggggaacctctggagaatgacgaagactgcgcacactggaaagaggccaagatgcttctggataacataaatactcccgagggaatcattccaagtatgtttgaacctgagagggaaaaagttgacgctatcgatggcgagtatcggctccgtggtgaagcccgcaagacattcgtggacttgatgcgaagaggggatctgcccgtctggctcgcttacagggtggcagccgagggcattaactatgctgaccggcgctggtgttttgatggaatcaaaaacaatcagatactggaggaaaacgtagaggtggaaatttggaccaaggagggcgagagaaagaaacttaagccaaggtggctagacgcccggatctacagcgatcctctggcattgaaagagttcaaggagttcgcggccgggcgaaaatcgttaaccctgaatctcattactgaaatgggaagactgccgacatttatgacccagaaggctcgcaacgcccttgacaatctggcagttctccatacagctgaggccggtggcagggcatataaccacgccttgtctgaactgcccgagactctagagacgctgctccttctgaccttattggctacagtcactgggggaatcttcctgtttctcatgtccggcaagggtatagggaaaatgaccctgggcatgtgctgcatcattacagcgagcatccttctgtggtacgcccaaattcagccacattggatcgcagcttcaataattctcgagttctttttgatcgtgctgttaatccctgagcccgaaaagcagcggaccccacaggataatcaactaacttatgtggtcattgccatcctgacggttgtggccgcaaccatggctaacgagatgggattcctcgaaaagactaagaaagactttggccttgggagtatagccactcagcagcctgagtctaatattctggatatcgacttgcgtcccgcgtccgcttggaccctgtacgccgtagcaacaaccttcattactccgatgctcagacacagcatcgagaactcaagtgtgaatgtcagcctgacagccatagctaaccaggcaacggtgcttatgggactcggtaagggctggccactgtccaagatggacatcggggttcctttgctggccattggatgttactctcaagtgaatcccatcaccttaactgcggctctactgctccttgtcgcccactatgcaattatcggcccaggtctgcaggccaaagctacaagggaagcccagaagcgcgcagctgccgggattatgaaaaaccccaccgcggatggcatcaccgtaatagacttggatcctattccgtacgaccccaagtttgagaaacagctgggacaagtgatgctcctggttctttgcgtgacacaggtcttaatgatgcggactacgtgggccctgtgtgaagcactcaccttggctacaggcccaatcagcactctgtgggaggggtcccctggacgattctggaataccacaatcgccgtgtcaatggcaaacatttttagaggctcttatctagctggtgccgggctactcttcagtataatgaagaataccactaacacgaggcgcggaacaggcaacaccggtgaaactcttggcgagaagtggaaaaatcggctgaactcgttgggaaagagcgagtttcagatctacaaaagatccggcattcaagaagtcgatcgtaccctggccaaggagggcatcaaaagaggggaaacagaccatcacgcggtgtctcggggatcagctaagctccgctggttcgttgagcgaaatctggtgactcccgagggcaaagtagtggatttaggttgcgggagaggaggctggagctattactgtggtggccttaagaacgtcagggaagttcgggggctgaccaagggaggccctgggcatgaggaaccaattcccatgtccacatatggatggaatctcgtgcgcctacagagtggcgtcgacgtgttctttacgcctccagagaaatgcgataccctgttgtgtgacatcggtgaatctagccccaacccgactgtagaggcagggagaacactgagggtgctcaatcttgttgagaactggctgaataacaatacccagttctgcataaaggtgttgaacccttacatgccatcagtcatcgagaagatggagactctgcagcgaaagtacggaggcgccctcgtgcggaatcccttatcccgtaacagtacacacgaaatgtattgggtcagcaatgcttctggcaacattgtgtcctcagttaacatgatcagcagaatgctgattaatcgctttaccatgaggcataaaaaggccacgtacgagcctgatgtagaccttgggtcgggaacccggaacatcggtatagaatctgagacaccaaatctggatattatcggcaagagaatcgagaaaattaagcaagaacacgagacaagttggcactatgaccaggaccatccctacaaaacctgggcatatcacgggtcctacgaaacaaagcagactggaagcgcctcatccgtggtcaacggcgtggttcgcctactcaccaaaccgtgggatgtgatacctatggtcacacagatggctatgaccgacactacgcccttcggtcaacagagggtgtttaaggagaaggtagatacacgaacccaggaaccaaaagaggggactaagaaactgatgaagatcaccgcggagtggttgtggaaagaactgggaaagaagaaaacacctcggatgtgtacgagagaggagttcgccaggaaggtgcgctctaatgcagctctcggcgccatttttaccgacgagaacaaatggaaaagcgcacgtgaggccgttgaagatagtcggttctgggagcttgtcgacaaagaaagaaatctgcatttagagggcaagtgcgaaacttgtgtgtataacatgatggggaaaagggagaagaagatcggagagtttggtaaagctaagggctcccgcgccgtgtggtacatgtggctgggggcgcgattcttggaatttgaggcactcggattcctgaatgaagatcactggtttagccgggagaactctctatcaggcgtcgaaggtgaggggcttcacaaactgggatacattctcagagaggttagtaagaaagaaggcggcgccatgtatgctgacgatacagccgggtgggacaccaggatcactctggaggatttgaagaatgaagagatggtgacaaaccatatggaaggagagcacaagaaactggcagaggctatattcaagctcacctaccagaataaagtagtgcgcgtccaaagacccacaccacggggtactgtgatggacatcatttccaggcgtgaccagcgaagctctggccaggttgggacctatggacttaacacgttcaccaatatgggcgcccaactgatccgccagatggaaggtgagggggtgtttaagggcattcagcatttaacagctactgaagaggtcgccgtgcaggattggctggcaagagtaggccgggagaggttgtcgcgcatggcgatctcaggcgacgattgcgttgtgaaacccctcgacgatagattcgccagcgctctgaccgccctaaacgacatggggaaggtccggaaggatattcaacagtgggaaccttccaggggatggaacgactggacacaggtgccattttgcagtcaccatttccacgagcttataatgaaagatggtcgagtgctggtcgttccgtgtcgtaatcaggacgaactcatcggcagagcacgcatttctcaaggggctggatggagcctgcgggagactgcctgcttgggcaagtcctacgcacagatgtggtcattaatgtattttcacaggagaggtctgcgcctcgccgcgaacgctatctgtagtgccgtgccctctcattgggtacctaccagccggacgacatggtccatccacgcaaggcatgaatggatgaccactgaggatatgcttacagtgtggaatcgagtctggattcaggagaacccatggatggaagacaaaacccccgtggagtcatgggaagagataccttacctggggaagagaggagatcagtggtgcggcagcctaatcggcctgacttctcgggccacctgggctaggaatattcaaacagccatcaaccgcgttcgttccctcattgggagtgaaggatatacggactacatgccaagcatgaaaagattccgaagggaggaggacgaagccggtgtgttgtggtga

SEQ ID NO: 14585 - RNA, 9876 nt, synthetic construct
  misc_feature 1..9876: note = derived and/or modified CDS sequence (opt3) from DENV-2__KJ010185__SS-prME
  source 1..9876: mol_type = other RNA
accgcaggcgtgatcattatgctgatacccactgctatggcattccacctcactacgagaaatggggaacctcatatgatcgtcagcaagcaggaaaaaggaaagtcccttctgtttaaaaccgaagacggtgttaatatgtgcaccttgatggccatggatttaggcgaactgtgtgaagacactattacctacaactgcccactactcaggcaaaatgaaccggaagatatcgactgttggtgcaacgcgacatctacctgggtgacttatgggacatgtaccgctacgggagaacaccggcgcgaaaagcgatcagtagccctggtgccccatgtcggcatgggtcttgagactcgtaccgaaacatggatgagtagcgagggggcatggaaacacgcccagagaattgagacttggatcctgaggcatcctggattcaccataatggctgcaatcttggcctacacaattggcaccacgtattttcagcgggtgctcatcttcattctgctgactgctgttgccccatccatgacaatgcgctgcatcggcatatctaatagagattttgtggaaggggtctcgggaggttcatgggtggacattgtactcgagcacggcagctgtgttaccactatggcgaagaacaagcccacattagatttcgaactgatcaaaaccgaggcaaagcagcctgccacgcttaggaaatactgcattgaagctaagttgaccaatacaactaccgccagtcggtgtccaacacaaggggagccctccctgaacgaggaacaggacaaacgctttgtgtgcaagcactctatggtcgatcgaggatggggcaatggttgtgggctattcggaaagggcggcatcgtgacttgcgcaatgtttacctgcaaaaagaacatggaggggaaaatcgtgcagcctgaaaatctcgagtatacaattgtcgttaccccacatagcggagaagagaacgctgtgggtaatgacactggcaagcacgggaaagagataaaggtaacgccgcagtcctcaatcacagaagccgagctgaccggatacggcactgtgaccatggaatgtagtcccagaacaggtcttgatttcaacgagatggtcctgttgcaaatggaaaataaagcgtggctcgtgcataggcagtggtttctggacttacctctgccatggctccccggggccgatattcagggcagcaactggatccagaaggagacccttgttactttcaagaaccctcacgccaagaagcaagacgtggtcgtgctgggatctcaggagggcgctatgcacacagccttgacgggggctaccgaaatacagatgtcctcaggaaatccactatttactggtcatctgaaatgccggctccgtatggacaagctgcaacttaaaggcatgagctatagtatgtgtacagggaagttcaaggtagttaaagagattgccgaaacccagcacggaacaatcgtggtccgcatccagtacgagggcgatggttctccctgcaagattccgttcgagatcatggacctggagaaaagacatgtgttggggaggctcattactgtcaaccctatagtgaccgagaaggattcccccgttaatatcgaagcagagccaccttttggcgacagctacattatcatcggagtggaacccggccagctgaaattatcgtggttcaagaaggggtcttccattggacaaatgtttgagacgaccatgcggggtgccaaacgaatggctatactgggcgatacagcgtgggacttcgggtcactaggaggcgtatttacaagtatcggtaaggcactccaccaggtcttcggggccatttatggcgctgcctttagcggagtgtcctggaccatgaaaatcctgattggcgttgtgatcacatggatagggatgaactctcgcagcacttcacttagtgtctccttggtgctggtaggagtggttaccctctacctgggcgtcatggtgcaggcagatagcggttgtgtggtctcttggaagaataaagagcttaagtgcgggtcaggaatcttctttacggacaacgttcatacatggaccgaacagtataagttccaaccagagagtcccagcaaactggcctccgctattcagaaggcccacgaagagggcatctgtggtattagatctatcactaggttggataatctcatgtggaaacagataacacctgaactgaaccacattttatcggagaatgaggtgaagctgagcatcatgaccggcgacattaaagggatcatgcaggcaggaaagcggtccctacgcccacaaccgactgaactcaaatactcatggaagacctggggcaaggcgaaaatgctgagtacagagccccataaccagacgtttcttatagatgggcctgaaaccgctcagtgcccaaatactaacagagcctggaactctttggaggtggaagactatggattcggcgtatttacaaccaacatctggctgaagctcaaagagaggcaggacgtcttctgtgatagcaagctgatgtccgcagccattaaagacaatcgtgctgtgcacgccgatatgggttactggatcgagtcagcattaaacgacacatggaagattgaaaaggctagcttcatcgaggttaaatcttgccattggcccaagtcccacactctgtggagtaacggggtgcttgaaagcgagatgataattcctaaaaattttgccggaccagtctctcaacacaactatcggcccggctaccatacccagacggcgggtccgtggcacttgggcaagctcgagatggatttcgacttttgtgaagggacaaccgtggttgtgactgaggattgcggaaatcgaggcccttccctgagaaccacaactgcctcagggaaactaatcaccgaatggtgctgtaggagttgcacactgccacccctccgctaccggggagaggacggctgttggtatggtatggaaatcagacctctgaaggagaaggaggaaaaccttgtaaatagcttggtcacggctgggcatggacagattgataacttctcgctgggcgtgttaggtatggcactctttctggaggaaatgcttaggacccgcgtgggcactaaacacgccgtcctgttggttgctgtgtccttcatgacactcatcaccgggaatatgtcttttcgagacctgggacgggtaatggtgatggtcggcgccgcaatgactgatgacattgggatgggagtgacatacctagcgctgctcgccgctttcaaggttcgtcccacctttgccgcaggcctgcttttgagaaaactgacgagcaaggagttaatgatgactaccataggtatcgtgctcctgtcacaaagtacaaccccagaaactattcttgagctgacagatgctctagccctcgggatgatgatcctgaaaattgtcaggaacatggagaagtatcagttggcagtgaccatcatggccatactgtgcgttcctaatgctgtgatcttacagaacgcgtggaaggtctcctgtacaattctcgccgcagtatctgtgagccccctgcttctgacttcctcacagcaaaaagctgactggatcccattggccctcaccattaagggactgaatccgacggccatcttcctaacaaccctgagccgcactaacaaaaagcggagttggcctcttaatgaagctataatggcagttggcatggtgtctattctcgcctccagcctgttgaaaaacgacatccccatgaccggcccactggtcgctgggggattactcacagtgtgctacgtactgactggtagatcggcggatcttgagctggaaagggccgcagacgtgcgatgggaggatcaggccgaaatctcaggctctagtcccattttgtccataaccatcagcgaggacgggtctatgagcattaagaatgaggaagaggaacagacgctcacaatcctgattcgcaccggactactggtcatctccggcctttttcctgtttcaataccaatcactgctgcagcctggtatctctgggaggtgaaaaagcagcgggcgggtgtgctgtgggatgtccccagtcctccgccagtggggaaggctgagttggaagacggagcctacagaattaaacaaaagggcatcttaggctatagccagattggggcaggagtttacaaagagggtacattccataccatgtggcacgtaactaggggcgccgtgctgatgcacaaggggaaacgtatcgaaccctcttgggctgatgtccgcaaggacctcatatcctacggaggcggttggaagctggagggggaatggaaagagggagaggaagtgcaggttcttgccctggagcctggcaagaacccacgggcagtgcagacaaaacccggcttgtttaagaccaacacggggactattggagctgtctcactagatttcagtcctggtaccagcggctccccgatcgtggacaaaaaggggaaggtagtcggactgtatggcaatggtgtggttacaagatctgggacctacgtgtcggccatcgcgcaaacagagaaaagcattgaggataaccccgaaatcgaggacgatatattcaggaagaaacgactcactattatggacctgcatccaggagccggcaagaccaaacggtatcttcctgcaatcgtccgcgaggctattaagagaggcttaaggacgctgatcctcgcccccacacgggtggttgctgcagaaatggaggaagccttgcgagggctgccaataagataccagactcctgccattcgcgctgagcacaccggaagggaaatcgtggacctcatgtgtcatgcgacatttaccatgcgtctgctttcacccgtccgggtgccaaattataacctgatcattatggatgaggcacacttcactgacccggcctccatcgctgccagaggttacattagtaccagggtagagatgggcgaagcagccgggatatttatgacagctacgcctcccggatctcgcgatccattcccccagagcaatgcgcctatcatggacgaggaacgagagattccagagagatcctggaactcaggccatgaatgggtgactgattttaagggtaaaaccgtttggttcgtcccctctatcaaggccgggaatgacatcgcagcttgcttgcggaaaaacggaaagaaagtgattcaactaagcaggaagacatttgatagtgagtatataaagacccgcactaatgactgggatttcgtggtcacaaccgacatctccgaaatgggcgccaactttaaagcagagcgtgtaattgatcctagacggtgtatgaagccggtgatcctgacggacggcgaagagagggttattctcgccgggccaatgcccgtgactcacagctctgctgcccagcgccgaggaagaatcggtcggaatcctaaaaacgagaatgaccagtacatatacatgggcgaacccttagagaacgatgaagactgcgcgcactggaaggaggcaaaaatgctgcttgataatatcaacacaccagaagggattatcccttcaatgttcgagcccgagagggaaaaggtcgacgccattgatggagagtatcgcctgagaggcgaagctaggaaaacctttgtggacctcatgcggcgtggtgatttgccagtttggctggcctaccgcgtggctgcagaggggatcaactatgccgaccgaagatggtgtttcgatggcataaagaataaccagattctcgaagagaatgtcgaggtggaaatctggaccaaggagggagaaaggaaaaagctgaaacctcggtggcttgacgctcgcatttactccgatccgctagccctgaaggagttcaaagagtttgcagcgggcagaaagagtttgactttaaacctgatcacagaaatggggaggctccccaccttcatgacacaaaaggcccggaatgctctggacaaccttgccgtactgcatactgcagaggctggaggtcgagcctataatcacgcactcagcgaattgccagagacgctggaaaccctactgctccttacactgttagccactgtgaccggcgggatatttttgttcctgatgtcgggaaaaggcatcggtaagatgacactcgggatgtgctgcattatcaccgcttctattctgctttggtacgcgcagatccagcctcattggatagccgcatccattatcctggagtttttcctcatcgttttgctgattcccgagccagaaaaacagagaactcctcaagataaccagttaacgtatgtcgtgatcgctatactaaccgtggtcgccgccacaatggcaaatgagatgggctttctggaaaagactaaaaaggacttcggactcggcagcattgctacccagcagcccgagtcaaacatccttgacattgatctgcgcccggccagtgcgtggacattgtacgctgttgccaccacttttatcacaccaatgctgaggcactctatagaaaattccagcgtgaacgtatcactcacggcaatcgccaatcaagctaccgtgctgatggggcttggaaagggttggcctctcagtaaaatggacattggcgtccccctgttggcaatcgggtgttacagccaggtgaacccaattactctgacagccgcgttactactgctcgttgctcactatgccatcattggacccggccttcaggcaaaggcctcccgggaggctcagaaacgtgccgcagctggtatcatgaagaatcctaccgtggatgggataaccgtcattgacctggatccgatcccctacgacccaaaattcgagaagcaattgggccaggtaatgctgctcatcctgtgcgtgacacaggttcttatgatgagaactacgtgggccttatgtgaagcgctgaccctcgccacaggacctatttctactttgtgggagggcaaccccgggaggttttggaataccacaatagcagtgagcatggctaacatcttccgcggatcctatctggccggcgcaggtctactgttttcaattatgaagaacaccactaatacgcggcgagggacaggaaacaccggcgaaactctcggtgagaaatggaagaatagagtctctcttctgggcaaaagtgagttccaaatctacaagaggtcggggattcaggaggtggatcgcaccttggctaaagagggaatcaagcggggcgaaacagaccatcacgccgtcagcagagggtccgccaaactgcgttggttcgtggagaggaacctcgttactcctgaaggaaaggtggtagatctgggctgcggtcgcgggggatggtcttattactgtggcggtttaaagaatgtgcgggaggtcaaaggccttaccaaagggggaccaggccatgaggaacccatacctatgtcaacatatgggtggaacctggttcgactcctaacgggagcggacgtgtttttcaccccacccgagaaatgcgatactctgttgtgtgacatcggcgaaagctccccgaatcctacagtcgaggctggtagaaccctgagggtgctcaaccttgtagaaaattggctgaacaataacactcagttttgcattaaggtgttgaatccatacatgcccagtgttatcgagaaaatggagacactgcagcggaagtacgggggagcactcgtgcgcaaccctttatctagaaatagcacccacgaaatgtattgggtctcaaacgcctccggcaacattgtgagtagcgtcaatatgatctctaggatgctgataaaccgattcacgatgcggcataagaaagctacctacgatccagacgtggaccttggctccgggacacgtaatattggaatcgagtcagaaactcccaacctggatatcattggtaagagaatagagaaaatcaagcaagaacacgagaccagccgccactatgaccaggatcatccgtacaaaacatgggcctatcacggctcgtacgagactaagcagaccgggtctgcaagttccacagttaatggagtagtgaggctactcaccaagccttgggacgtcattcccatggtgactcagatggccatgacggatacaaccccatttggccaacagcgggttttcaaagaaaaggtggacactagaacccaggagcctaaagaaggtacaaagaaactgatgaagatcacggctgagtggttgtggaaggaactggggaaaaagaaaacaccccgcatgtgtactagggaggagtttgcgcgaaaggtccggagcaacgccgcactcggagctattttcacagatgaaaataaatggaagtcagccagagaggcagtggaagactccaggttttgggagcttgtagataaagagcgcaacctgcatttagaaggcaagtgcgagacctgtgtgtataatatgatgggcaagcgtgagaaaaagatcggggagttcggaaaagccaagggttctcgggctatatggtacatgtggctgggcgccagatttttggagttcgaggcgctcgggtttctgaacgaggaccactggttcagcagggaaaatagtctatccggagttgagggcgaaggtcttcacaaactggggtacatcctccgcgaggtcagcaagaaggaaggaggcgcaatgtatgccgatgacactgctggctgggacacacgaattaccctggaggatttgaaaaacgaggaaatggtgacaaatcatatggagggggaacacaagaaactggccgaggcaatcttcaagctcacttaccagaacaaagtggtccgggttcaaagaccaacccccaggggaacggtgatggacattatctctcgcagagatcagcggggttcagtacaggtgggcacctatgggcttggaacatttactaatatgggcgctcaactgattaggcagatggaaggtgagggggtcttcaagggaatacagcatttaaccgccacagaggaagtggctgttcaggactggctggcccgtgtgggccgagagcgcttgagtagaatggcaatctccggcgatgactgcgtcgtgaagcctctcgatgaccggtttgcgagcgccctgactgctctaaacgatatggggaaagtaaggaaggacattcaacagtgggaaccatctcgcggatggaacgattggacccaggttccgttctgctcgcaccattttcacgagcttatcatgaaagacggtagagtgctggtcgtgccctgtcggaatcaggatgagctcatcggcagggcccgaatttcacaaggggcaggatggagcctgcgtgaaacggcttgcttgggcaagtcctacgcccagatgtggagtttaatgtatttccacagacgcgacctgcggctcgcagccaacgcgatatgttctgctgtgcctagccattgggtcccaacatccaggaccacttggtcaatccacgccggtcatgagtggatgacaaccgaagacatgcttactgtttggaatagagtgtggattcaggagaacccctggatggaagataaaacccctgtagagagttgggaggaaatcccatacctggggaagcgcgaggaccagtggtgcggatctctaattggcctgacaagccgggcaacgtgggccaggaatatccaaaccgctataaaccaggtgcgatccctcatcggctcagaagagtatactgattacatgcccagcatgaagagatttgggcgggaagaggaggaagccggagtcttgtggtga

SEQ ID NO: 14586 - RNA, 9876 nt, synthetic construct
  misc_feature 1..9876: note = derived and/or modified CDS sequence (opt3) from DENV-2__KJ010186__SS-prME
  source 1..9876: mol_type = other RNA
accgccggcgtgatcattatgctgatacccacagctatggcattccacctcactacgagaaacggggagcctcatatgatcgtcagcaagcaggaaaaaggaaagtcccttctgtttaaaaccgaggacggtgttaatatgtgcacattgatggccatggatttaggcgaactgtgtgaggacactattacctacaactgcccactactcaggcaaaatgaaccggaggatatcgactgttggtgcaacgcgacatctacctgggtgacttatgggacatgtaccgctacgggagagcaccggcgcgaaaagcgatcagtagccctggtgccccatgtcggcatgggtcttgagactcgtaccgaaacatggatgagtagcgagggggcatggaaacacgcccagagaattgagacttggatcctgaggcatcctggattcaccataatggctgcaatcttggcctacacaattggcaccacgtattttcagcgggtgctcatcttcattctgctgactgctgttgccccatccatgacaatgcgctgcatcggcatatctaatagagattttgtggaaggggtctcgggaggttcatgggtggacattgtactcgagcacggcagctgtgttaccactatggcgaagaacaagcccacattagatttcgaactgatcaaaaccgaggcaaagcagcctgccacgcttaggaaatactgcattgaagctcggttgaccaatacaactaccgccagtcgctgtccaacacaaggggagccctccctgaacgaggaacaggacaagcgatttgtgtgcaaacactctatggtcgatagaggatggggcaatggttgtgggctattcggaaagggcggcatcgtgacttgcgcaatgtttacctgcaagaaaaacatggaggggaagatcgtgcagcctgaaaatctcgagtatacaattgtcgttaccccacatagcggagaagagaacgctgtgggtaatgacactggcaaacacgggaaggagataaaagtaacgccgcagtcctcaatcacagaagccgagctgaccggatacggcactgtgaccatggaatgtagtcccaggacaggtcttgatttcaacgagatggtcctgttgcaaatggaaaataaggcgtggctcgtgcatcggcagtggtttctggacttacctctgccatggctccccggggccgatattcagggcagcaactggatccagaaagagacccttgttactttcaagaagcctcacgcaaaaaagcaagacgtggtcgtgctgggatctcaggagggcgctatgcacacagccttgacgggggctaccgaaatacagatgtcctcaggaaacctactgtttactggtcatctcaaatgccgtctgcgcatggacaagcttcaactgaaaggcatgagctatagtatgtgtacagggaagttcaaggtagttaaagagattgccgaaacccagcacggaacaatcgtggtcagagtgcagtacgagggcgatggttctccatgcaagatccccttcgagattatggacttggaaaaaaggcatgtcctcgggcggctgatcactgtgaatccgattgttaccgagaaggattcccctgtgaacatagaagcagagcccccatttggcgacagctacatcattatcggagtagaacctggccagttaaaactgtcgtggttcaagaaggggtcttccatcggacaaatgtttgagacgaccatgcgaggtgccaaacgcatggctattctaggcgatacagcgtgggacttcgggtcactcggaggcgtctttactagtataggtaaggcactgcaccaggtgttcggggccatctatggcgctgcctttagcggagtttcctggaccatgaaaattcttatcggcgtggtcattacatggatcgggatgaattctagaagcacttcattgagtgtgtccctggtactcgtgggagttgtcaccctgtaccttggcgtgatggtgcaggcagatagcggttgtgtcgtttcttggaagaacacggccctgaaatgcgggtcaggaatattcatcacagacaatgtgcatacctggactgagcagtataagtttcaacccgaaagtccaagcaagttggcttccgccattcagaaagcacacgaggaaggcatctgtggtattaggtctgtgacacggctcgagaacctgatgtggaagcagatcacccccgaattaaatcacatactgtcggagaacgaggtaaaactaagcattatgactggcgatatcaaggggattctccaggcgggaaaacgctccctgagacctcaaccaaccgaacttaagtactcatggaaaacatggggcaaggctaagatgttgagtacggagtctcataatcagaccttcctgatcgacgggccggaaactgccgagtgccccaacacaaatagggcatggaacagcctcgaagtcgaggattatggatttggcgtgttcaccacaaatatatggctgaaattaaaggagcgtcaggacgttttttgtgactccaaactgatgtcagccgctatcaaggataaccgggccgtgcacgcagacatgggttactggattgaaagcgctcttaatgatacttggaaaatcgagaaggcctctttcattgaagtcaagtcctgccattggcctaaaagtcacaccttgtggagcaacggggtgctcgagtctgagatgatcataccaaagaacttcgcgggacccgtttcccagcacaattatcgacctggctaccatacgcaaacagccggtccatggcacctgggcaaactagaaatggactttgatttctgtgaggggaccactgtggtagtcaccgaagactgcggaaacagaggcccctcactgaggacaactaccgctagtgggaagctcattacagagtggtgctgtcgcagctgcacgctgccgcctcttcggtacagaggagaagatggctgttggtatggtatggagatcaggccattgaaagagaaggaagagaatctggtgaactcgttagtgaccgcagggcatggacagatcgacaatttttccctcggcgtcctgggtatggcccttttcctggaagagatgttgcgcactcgagttggcacaaagcacgctgtgctcctggtagccgtgtcttttatgaccctaattactgggaacatgagcttccgggatctgggacgtgtcatggtgatggttggcgcagcgatgacagacgatatcgggatgggagtgacctacctcgccctgcttgctgcctttaaagtcagacccacgttcgcagctggcttgctgttaaggaagctcacttcaaaagaactgatgatgaccacaattggtatagtgcttctgagtcagtccaccactcctgagacaatcctagagctcaccgacgccctggcattggggatgatgattctgaagatcgttcgcaatatggaaaaatatcaattagccgtgacaattatggctatcctctgcgtccccaacgcggtaatactgcagaatgcctggaaggtgtcttgtactatccttgcagctgttagcgtgtccccactgttgctcacctcaagccagcagaaggccgattggattcctctggccctaacgatcaaaggactgaaccccacagctatttttcttaccactctcagtcggaccaataagaaaagatcttggccactgaacgaggcaatcatggccgtcggcatggtgtccatattggcgagctcgctgttaaagaatgacattccgatgacaggccctctcgtagctgggggactgcttactgtgtgctacgtcctgaccggtaggtcagccgacttggaactcgagcgagcagccgatgttcgctgggaagaccaagctgagatctctggcagttcccccatcctgagcattacgatatctgaggatgggagcatgtccatcaaaaacgaagaggaagagcagacactaaccattctgatccggactggacttctcgtgatttcaggcctgttcccagtgagtatccccataacagcagccgcgtggtatttgtgggaggtcaagaaacagagagctggtgtgttatgggacgttaggagctaccctccagtagggaaggccgaactggaggatggagcatatcgtatcaagcagaaaggcattctcggctactctcaaatcggggccggagtgtacaaggaaggtacctttcatactatgtggcacgtcacacgcggcgctgtgctgatgcacaaagggaagcggattgagccctcctgggccgacgttagaaaagatcttatctcatatggaggcggttggaagctggaaggggagtggaaggagggagaagaggtgcaggtcttggcactagaacctggcaaaaatccgagggctgtgcagaccaagccaggcctgttcaaaacgaacactgggaccataggagccgtaagtctcgactttagccccggtacatccggctctcctattgtcgataagaaagggaaggtggttggactgtacggcaacggtgtggtcacccgatcggggacatatgtgagcgcgatcgcccagactgagaagtcaatcgaagacaatccagagattgaggatgacatcttccggaaaaagcgccttaccataatggatttacatcccggagcaggcaaaacgaagagatacctgcctgctattgttagggaagccatcaaacggggcctccgaacattgattctggctccgactagagtggtcgcagccgagatggaagaggccctccgcgggctgcccatcaggtatcaaaccccagctatacgtgcggaacacacaggacgggagattgtggaccttatgtgtcatgcaaccttcactatgagactgttgtcccctgtaagggtgcccaactacaatctaatcatcatggacgaggcccactttaccgatccagctagtattgccgcacgcggttatatctctacacgagttgaaatgggcgaggccgctgggattttcatgacggcgactcctcccggaagcagagacccatttccgcagtccaacgcccctataatggatgaagagcgggagatccccgaaaggtcatggaattctggccatgagtgggtcaccgacttcaagggtaagacagtgtggtttgtgccaagcattaaagcagggaacgatatcgctgcctgcctgcgcaagaatggaaaaaaggtcatccagctcagtcgtaaaaccttcgactccgaatacattaagactagaacaaacgattgggactttgtagtgaccacggatataagcgagatgggcgcaaatttcaaggccgaacgggttatcgaccccaggcgctgtatgaaacctgtgattttaactgatggcgaggagcgagtcatcctggctgggccaatgcccgtgacacactcttcagccgcgcaaagacggggaaggattggtcgcaaccctaagaatgaaaacgaccagtacatctatatgggcgagccgcttgaaaatgacgaggattgcgcacactggaaagaagccaagatgctgctcgacaacataaataccccagaggggatcattccctccatgtttgagcctgaaagagagaaagttgatgctatcgacggagaatacaggttgcggggcgaggcccgtaagaccttcgtggatctgatgcgccgaggtgacctccccgtctggctggcttatagagtggcagccgaagggattaactacgctgataggcggtggtgttttgacggcatcaaaaacaatcagatacttgaggagaacgtagaagtggagatttggactaaggaaggagagcgcaagaaactaaagccaagatggctggatgccaggatctatagtgaccctttggcattaaaagagttcaaggaattcgcggccggccggaaaagcctgacactcaatctgattaccgagatggggcgacttcccacatttatgactcagaaggctagaaacgccctggataatctcgcagttttgcatacggctgaagccggaggtcgcgcatacaaccacgccctgtcggagctaccagaaaccctggagacactccttctgttaactttgctggctaccgtcacaggcgggatcttcctctttctgatgtctggaaagggcataggtaaaatgacccttgggatgtgctgcatcattactgcgtccatcctgctctggtatgcccaaattcagcctcattggatcgcagctagcataattttggagttctttctgatcgtgttactaatcccggaacccgagaagcagaggacgccacaggacaatcaactgacctacgtggtcattgccatcctcacagttgtggccgcaactatggctaacgaaatgggcttccttgagaaaaccaagaaagattttggactgggctcaatagccacacagcagcctgaaagtaatattttggacatcgacctgcggcccgcgtctgcttggaccctctacgccgtagcaactacattcattacgccaatgctgcgtcactccatcgagaacagctcagtgaatgtcagtcttaccgccatagctaaccaggcaactgtgctcatggggctgggaaagggttggcctttgagcaagatggatatcggcgttcccctgttagccattgggtgttattcccaagtgaatccgatcacactaaccgcggctctgctccttctggtcgcccactacgcaattatcggaccaggcttgcaggccaaagctaccagagaggcccagaagagggcagctgccggtattatgaaaaaccctacagtagacgggatcactgtgatagatctggaccccattccatatgatcccaagtttgaaaaacagctcggccaagttatgctgcttgtgttatgcgtcacgcaggtgctgatgatgcgcaccacatgggcgctctgtgaggccttgactctggcaaccggacctatctctacactatgggaaggcaatccggggcggttctggaacaccactatcgctgtcagcatggccaatatttttcgaggatcctacctggcaggcgctggtctccttttctcaataatgaagaacacgacaaacaccagaagggggactggaaataccggcgagacactgggtgaaaagtggaaaaaccgcttgaattctctgggcaagagtgagtttcagatctataaacggtcggggattcaagaggtggacagaactctcgccaaggaaggaatcaaacgtggcgagaccgatcatcacgccgttagcagggggtccgcgaagctgcggtggttcgtggaacgcaacttagtaacacccgagggaaaagtggtcgaccttggctgcggtcgagggggatggtcttactattgtggcggtctgaagaatgttagagaggtgaagggcctcacgaaagggggaccaggccatgaagagcctattcccatgtcaacctacgggtggaacctagtcaggctgcagagcggagtggatgtattctttactcctccagaaaagtgcgacacattgctgtgtgatatcggcgagtccagtcccaatcctaccgtggaagctggtcggactctccgcgttcttaacctggtggagaattggttgaacaataacacacagttctgcataaaagtcctgaatccatacatgccctctgtgatcgagaagatggaaaccctccagagaaaatatgggggagcattagtcaggaacccgctgagccgaaattcaacgcacgagatgtactgggtgtccaacgccagtggcaacattgttagctctgtaaatatgatctcccggatgcttattaaccgttttaccatgagacataagaaggctacatatgaacctgacgtggatctgggctcagggactcgcaatatcggaatagagagcgaaaccccaaacctagacattatcggtaaaaggatcgagaagattaaacaagagcacgaaacatcgtggcactacgaccaggatcatccctataagacttgggcctaccacggctcttatgagaccaaacagacagggagtgcatccagcatggtcaatggagtggttcggctcctgaccaagccttgggacgtgataccaatggtcactcagatggccatgacggatacaacccccttcggccaacagagagtgtttaaggaaaaagtagacactcgcacccaggagccgaaggaaggtacaaaaaagttgatgaaaatcacggctgagtggctgtggaaggagctcgggaagaaaaagacccctaggatgtgtactcgagaagagttcgcgcggaaagtgagatcaaacgccgcacttggagctatttttacagatgaaaataagtggaaatccgccagggaggcagttgaggactctcgcttctgggaactggtcgataaggagcgtaacttacatctggaaggcaaatgcgagacctgtgtgtacaatatgatgggcaagcgggaaaagaaaatcggggagtttggaaaggccaaaggtagcagagctatttggtacatgtggttgggcgccaggttcctcgagtttgaagcgctggggttcctaaacgaggaccactggtttagtcgcgaaaattcccttagcggagtggagggcgaaggtctgcacaagctcgggtatatcctgcgagaggtctctaaaaaggagggaggcgcaatgtacgccgatgacactgctggctgggatacacggataaccttggaagacctgaagaacgaggaaatggttacaaatcatatggagggggaacacaaaaagctcgccgaggcaatcttcaaacttacttatcagaacaaggtggtaagagtgcaaaggcccaccccacgcggaacggtcatggacattatctcaagacgggatcagaggggtagtggccaggtggggacctacggactgaatacattcactaacatgggcgctcaattaattcgtcagatggagggtgaaggggtttttaaaggaatccagcatctgaccgccacagaggaagtggctgtccaggactggttggcccgagtgggccgcgagagactctcccggatggcaattagcggcgatgactgcgtagttaagcctctggatgacaggttcgcgaacgccctaactgctcttaatgatatggggaaggtgcgcaaagacatacaacagtgggagccctctagaggatggaacgattggacccaggtcccattttgctcgcaccatttccacgaactgatcatgaaggacggtcgggtgctcgtggtcccctgtaggaatcaggatgagctgattggccgagcccgtatctcacaaggggcaggatggagcttgagagaaacggcttgcttaggcaaatcctatgcccagatgtggagtctgatgtactttcaccgccgggacctcaggcttgcagccaacgcgatctgttctgctgttcctagccattgggtgccaacatccagaaccacttggtcaattcacgcccgccatgagtggatgacaaccgaagatatgctgactgtatggaatcgggtgtggatacaggagaacccgtggatggaggacaagacccccgtcgaaagttgggaggaaatcccttatctaggtaaaagggaggaccagtggtgcgggtctctgattggactcacaagccgagcaacgtgggccagaaatatccaaaccgctattaaccaggtgcggtccttgatcggctcagaagagtacactgattacatgccaagcatgaagaggttccgccgtgaggaagaggaagccggcgttctgtggtga

SEQ ID NO: 14587 - RNA, 9876 nt, synthetic construct
  misc_feature 1..9876: note = derived and/or modified CDS sequence (opt3) from DENV-2__KF955364__SS-prME
  source 1..9876: mol_type = other RNA
accgcaggcgtgataattatgctgataccaacggctatggcattccacctcactacgcggaacggggaacctcatatgatcgtcggaaggcaggaaaagggtaaaagccttctgtttaagaccgaagacggcgttaatatgtgcacattgatggccattgatttaggggaactgtgtgaagacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccacatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggattattcggcaagggcgggattgtaacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgacaccgggtgtgtggtttcctggaagaataaagaattgaagtgcggaagcggcatcttcataactgataacgtccacacatggaccgagcagtacaagtttcagcccgaatctccatcaaaactcgctagtgccattcaaaaggcacatgaggaaggtatctgtggcattaggagcgtgactcggctggagaatttaatgtggaaacagatcacccccgagctgaaccacatactatccgaaaatggggtgaagctcacaatcatgacgggagacattaaaggcatcatgcaggccgggaagcgctctctgagacctcagccaaccgagcttaaatattcgtggaagacttggggaaaggctaaaatgttgagcacagaatcccataaccaaaccttcctgattgatggcccggagacagccgaatgccccaatactaacagggcatggaactcactcgaggtcgaggactacggttttggggttttcagtaccaacatctggctgaagttacgtgaaaaacaggacgtgctgtgtgattctaaacttatgagcgcggctataaaagacaatcgggccgtgcacgcagatatgggatattggattgagtccgccttgaacgacacgtggaagatggaaaaggcttcatttatcgagatcaaaagctgccactggcctaagtctcatacactctggtccaatggcgtactggagagtgaaatgattatccccaagaatttcgccggtcccgtcagccagcacaactaccgacctggctatcatacccagactgcagggccatggcacctaggaaagctggagatggatttcgacttttgtgaaggcaccacagtggttgtgactgaggattgcgggaatagaggaccctctctcaggaccacaacggcttccggcaaactgattaccgaatggtgctgtcgctcatgcactcttccgcctttgcggtacagaggtgaggacgggtgttggtacggaatggagataaggccactgaaggaaaaggaggaaaacttagtcaatagtctcgtgacagccggccatggtcaaatcgataacttcagcctgggcgttcttgggatggcgctgtttttggaggaaatgctccgcacccgagtgggaactaaatatgccattctgctagtagctgtctcgttcgtgacactgatcaccggcaatatgtcctttcgggacctcgggcgtgtgatggtcatggttggagcaacgatgactgatgacattggcatgggtgtgacctacctggcccttttggctgccttcaaggtaagacccacatttgcagcggggctgttactcaggaaactgacctctaaggagcttatgatggccactatcggaatagctctgctaagccagtcaacaatccctgagaccattctcgaactgacagatgccttggcactgggcatgatggtgttaaaaatcgtccgcaacatggagaagtatcagctcgctgtgactattatggccatcagttgcgttcccaatgcagtgatactgcaaaacgcctggaaggtctcctgtaccattcttgctgcggtgtctgttagcccactgttgctcacgtcctcacagcagaaagccgactggatccctctggcactaacaatcaagggcctgaatcccaccgctattttccttactaccctcagccggacaagtaaaaagagatcttggccactgaacgaagccgtgatggccgtcgggatggtatccatattggctagctcgctgctcaaaaatgacatcccgatgactggacctctagtggccggtggcctgcttaccgtttgctacgtgctgacggggaggtcagccgatttggagctcgaacgagcggctgacgtcaagtgggaggatcaggccgagatttctggaagttcccccatcctgagcattacaatctctgaagacggcagcatgtccatcaaaaatgaggaagaggagcacaccctaactatcctgattcgcacaggtcttctcgtgatctcaggggtatttccagtgagtattcccatcaccgcagccgcttggtatctgtgggaagtcaagaagcaacgggcaggagttttgtgggatgtgcctagcccaccccctgtgggcaaagccgagttagaagacggcgcgtacagaataaagcagagggggattttcggatattctcagatcggtgctggcgtctacaaagaggggacttttcacacaatgtggcatgtgacccgtggagccgttctgatgcaccgcggcaagcggatcgaaccgtcctgggcagatgtcaaaaaggacctcatttcatacggtgggggatggaagctggagggcgagtggaaagaaggcgaggaagtgcaggtccttgccctggagccagggaagaatcccagagctgtgcaaacgaaacctggattgttcaagactaacaccggtacaatcggcgccgttagtctagattttagcccagggacctccggatctcccatagtggacaggaaaggcaaggtcgtgggtctgtatgggaatggagtagtcacacgatcgggcgcatacgtgagcgctattgcccagactgaaaagtcaatcgaggataaccctgagattgaagacgatatcttccggaaaaagcgcctcaccataatggacctgcatccgggcgcggggaaaacgaagagatatcttcccgccattgttagggaggcaatcaaacggggattacgaacactgatcctcgctccaactagagtggtcgccgctgaaatggaggaagcattgcgcggtctgcctattaggtaccagacccccgccatccgtgccgagcacacaggccgggagattgtggacctcatgtgtcatgctaccttcactatgagactgctttccccagttagggtgcctaactataatctgataatcatggatgaagcgcactttaccgaccccgcaagtattgccgctcgcgggtacatctctacacgagtcgagatgggagaagccgcaggcatcttcatgacggccactccaccgggtagcagagatccttttccccagtccaacgctccaattatggacgaggagcgggaaatacccgagaggtcatggaactctgggcacgaatgggtgaccgatttcaagggaaagacagtatggtttgtgcctagcatcaaagcgggcaacgacattgccgcatgcttgcgcaagaatggcaaaaaggttatccaactaagtcgtaaaaccttcgattccgagtatgtcaagactagagctaacgactgggattttgtggtgacaaccgacattagcgaaatgggggccaatttccgggcagagagggtcatcgatccacgccgatgtatgaagcccgtaatactgacggacggagaggaaagagtgatcctcgccggtcctatgccggttactcattcttcagctgcccagcggaggggccgcattgggagaaaccccaaaaatgagaacgaccagtacatctacatgggagaacccttagagaatgatgaagactgcgcgcactggaaggaggcaaaaatgctgcttgataacattaatacacctgagggcatcataccctccatgtttgaaccagagagggaaaaggtggacgccattgatggtgagtatcggctgcgtggggaagctcgcaaaaccttcgtcgacctcatgcgaagaggcgatttgcctgtgtggctggcctacagggttgctgcagagggaatcaactatgccgaccggcgctggtgttttgatggcattaagaataaccaaatcctcgaggaaaacgtggaggtcgaaatatggaccaaagagggggagagaaagaagctgaaacccaggtggcttgacgctcggatctacagtgatccactagccctgaaggagttcaaagagttcgcagcgggacgaaagagcttgactttaaatctgattacagaaatgggtagactccctacctttatgacacagaaagcccgcgacgctctggataaccttgccgtgctgcatactgcagaggtaggcgggagggcttataatcacgccctctcggaattgccggagacgctggagaccctactgctccttacactgttagcaactgtgaccggaggcatcttcttgtttctgatgtctggtaaggggattggcaagatgacactcggaatgtgctgcatcataaccgcctccattctgctttggtacgctcagatccagccccactggatcgcggccagcattatcctggagttctttctcatagttttgctgattccagagcctgaaaaacaacggactccccaggacaaccagttaacgtatgtcgtgatcgcaattctaaccgtggtcgctgccacaatggccaatgagatgggcttcctggaaaagactaaaaaggacctcgggcttggatcaatcaccacacaggagagtgagtctaacatactggatatcgacttgcgtccagcatccgcttggaccctgtacgccgttgcgactacatttgtgacgcctatgctcagacatagcattgaaaattcaagtgtaaacgtgagcctgaccgctatcgccaatcaagcaactgtccttatgggtctcggcagggggtggcccctgtccaaaatggatattggagtgccgttgctggccatcggctgttactctcaggttaacccaattacattaaccgctgcactactgctccttgtggcccactatgcgatcataggtcctgggctgcaggctaaggccacccgcgaggcacagaagcggacagccgctggcattatgaaaaatcccactgtcgacggaatcacggtaatcgatttggaaccaattccctacgaccctaagttcgagaaacaactgggccaggtgatgctcctggttctttgcgtgacccaggtcttaatgatgcgaacaacttgggccctgtgtgaagcactcaccttggctacagggccgataagcaccctgtgggagggaaaccccggcagattttggaatactacgatcgccgtgtccatggcgaacattttcaggggttcatatctagccggggcaggactgctcttttctatcatgaagaatacaaccaacactcgccggggcaccggtaatattggcgagacacttggggaaaaatggaagagtagactgaacgctttgggaaagtcggagttccagatctacaaaaagagcggcatacaagaagtcgatcgtactctggccaaagaggggatcaagaggggagagaccgaccatcacgcagtgtcccggggctctgctaaactccgctggtttgttgaacgaaacatggtgacaccagagggtaaggtagtggatctggggtgcggaagaggcggttggtcatattactgtggcgggcttaaaaatgtcagggaagttaagggactaacgaagggcgggcctggacatgaggaacccattcctatgagcacctatggctggaacctggtgcggctccagtccggtgtcgacgtgttcttcactccacccgagaaatgcgatacactactgtgtgacatcggggagagttctcctaatccaaccattgaagccggacgcactttgagagtactgaacctcgtggagaattggcttaacaataacacacagttttgcgttaaggtgctgaatccctacatgccgagcgtcatcgagaaaatggagaccttgcaaaggaagtacggcggcgccctggtgcgaaaccctctctcaagaaattccacgcacgaaatgtattgggtcagtaacgcgaccgggaatatagtgagctctgttaacatgatttcccgtatgttaatcaatagattcacaatgaaacacaagaaggctacttacgagccagatgtagacctgggatcaggtacccgcaacatcggcattgagaacgaaatacccaatcttgacatcattgggaaaaggatcgagaagattaaacaggaacatgagacaagctggcactatgatcaggaccatccttacaagacttgggcatatcacggatcgtacgaaaccaaacagacaggctctgccagttccatggtgaacggtgtcgtgaagctgctaaccaagccatgggatgttgtgcccatggtcactcaaatggctatgacggacacaaccccgtttgggcagcagcgggtgttcaaagagaaggtagatactagaacccaggagcctaaagaaggaacaaagaaactcatgcgcatcacggccgagtggctgtggaaggaattgggcaagaaaaagacccccaggatgtgtactcgagaggagtttacacggaaagtgagaagcaatgcagccctgggcgctatattcaccgacgaaaacaagtggaaatcagcgagggaggccgttgaagattcccgcttttgggagctcgtcgaccgtgaacggaatcttcacctggaggggaagtgcgagacttgtgtgtataacatgatgggaaaaagagaaaagaagttaggtgagttcggcaaagcaaaggggtctagggctatctggtacatgtggctgggagcccgctttttggagttcgaggcactcggctttctgaatgaagatcattggttcagccgaggtaacagtctatccggggtggagggagagggccttcacaaactgggctacattctccgggacgtcagcaagaaagaagggggagccatgtatgctgatgacacagccggttgggacaccagaatcacactggaggatttgaagaatgaagagatggttactaaccatatgaagggcgaacacaaaaagctggcggaggcaatttttaaactcacctaccaaaataaggtggtaagggtgcagcgcccaacgcctagagggaccgtcatggacatcatttctcggaaagatcagaggggatcaggccaggtgggtacatatgggcttaacactttcaccaatatggaggcccaactgatacgtcagatggaaggagagggcatcttcaagagtattcagcgattaacagttactgaagagatcgctgtgcaaaactggctggcccgcgtcggcagagagcggttgtccaggatggcaatcagcggggacgattgcgtggtaaagcccctcgacgatcgctttgcttctgccctgaccgctctaaatgacatgggaaaagttagaaaggatattcagcagtgggaaccatcgcggggttggaacgactggacacaggtgcccttctgctcacatcactttcacgagcttgtcatgaaagatggcagggtgctggtggtcccttgtcgaaaccaagacgaactcatagggcgtgccagaatcagccagggagcaggctggtccctgaaggagacagcgtgcttgggtaaaagttacgcccagatgtggaccttaatgtatttccatcgccgggatctgaggctcgctgccaatgcaatttgttctgctgttccaagccactgggtgccgacttccagaacaacctggtcaatccatgccaagcacgaatggatgactaccgaggacatgcttgcagtatggaaccgcgtgtggattcaggagaatccctggatggaagacaagacacctgtcgagagttgggaagaggtgccatacctggggaaacgggaagatcaatggtgcggatctctaatcggcctgacgagcagggccacctgggcgaagaacatacagactgctatcaatcaggttcgatccctcattggcaacgaggagtatacagactacatgccctcaatgaaaagatttcggaaggaagaggaagaggccggggtgttgtggtga

SEQ ID NO: 14588 - RNA, 9876 nt, synthetic construct
  misc_feature 1..9876: note = derived and/or modified CDS sequence (opt3) from DENV-2__KF955372__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagtatgctgttggcaatgacacggggaagcatggaaaagaaattaagatcacaccgcagtcctcaataaccgaggccgaacttactggctacggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcacgccaaaaagcaggacgtggttgtgttgggctctcaagaaggggcgatgcataccgccctaactggagcaacagagatccagatgtcctcaggtaatctgctctttaccggccacctgaaatgccgtcttcgcatggataagctgcagttgaaagggatgagctatagtatgtgtacaggaaagttcaagatcgtcaaagaaattgctgagactcaacatggcaccatcgtgattagagtacagtacgagggtgacgggtctccatgcaagatacccttcgaaatcatggatctcgagaaaaggcacgttctgggccggttaattacggtgaacccgatcgtcaccgaaaaggactcccctgtgaacgtcgaggccgaacccccatttggagatagctacatcattataggcgtggagcctgggcagctgaaactaaattggttcaagaagggatcgtctatcggtcagatgtttgagacaactatgcgaggcgctaaacgcatggccattctcggggacaccgcatgggatttcggatccctgggcggtgtttttacatcaatcgggaaggcccttcatcaagtgttcggcgctatttatggagcggcatttagtggcgtaagctggactatgaaaatcttgataggggtcatcattacctggatcggaatgaactccagatctacgagcctgtcagtgagtctcgttctggtgggcgtcgtgacactttacctgggtgtaatggtgcaggccgactccgggtgtgttgtcagctggaagaataaagaattgaagtgcggatctggcattttcatcaccgataacgtgcacacttggacagagcagtataagtttcagcccgaatcaccaagtaaactcgctagcgccatacaaaaggcacacgaggaaggtatttgtggcatcaggtccgtgacccggctggagaatttaatgtggaaacagattactcccgagctgaaccatatcctatctgaaaatgaggtcaagctcaccataatgacaggggacatcaaaggaattatgcaggccggcaagcgctcgctgagacctcagccaacggaacttaaatacagctggaagacctgggggaaggctaaaatgttgtccactgagtcacacaaccaaacattcctgatcgatggaccggaaaccgccgagtgccccaatacaaacagggcatggaatagtctcgaggttgaagactatggctttggtgtgttctctactaacatttggctgaagttacgtgagaaacaggacgtgttttgtgatagcaagctgatgtccgcggctatcaaagacaatcgggccgtacatgcagatatggggtactggatagaatcagcccttaacgacacctggaagatggagaaggctagcttcattgaggtcaaatcttgccactggcctaagtcccacacgttgtggagtaatggagtgctcgaaagcgagatgatcatcccaaaaaacttcgccggccccgtttctcagcataactatcgacctggttaccacacacagaccgcaggcccatggcatctggggaagctagaaatggattttgacttctgtgagggaactaccgtggtcgtgacagaagattgcggcaatagagggccctccctgaggactaccacagcttcaggaaaactcattacggagtggtgctgtcgcagttgcaccctgccgcctcttcggtacagaggcgaggacggttgttggtatgggatggaaatcaggccattgaaggagaaggaagagaacctggttaatagcttagtgactgccggacacggccaaattgataacttttcgctcggtgtactgggcatggcgcttttcctggaagagatgttgcgcacacgagtcgggaccaaacatgccatactcctggtggctgtgtcctttgtcactctaatcacaggaaatatgtctttccgggacctgggccgtgttatggtgatggtaggggcaaccatgacggatgacattggaatgggcgtgacttacctcgccctgcttgctgcctttaaggtcagacccaccttcgcagcgggtttgctgttaaggaaactcacaagcaaggagctgatgatggccaccatcgggattgctcttctgtcacagagtactatccctgaaacaatactagagctcaccgatgccctggcattgggaatgatggtgctgaaaatcgttcgcaacatggaaaagtatcagttagctgtgacaattatggccatctcctgcgtccccaatgcagtgattctccaaaacgcctggaaggtttcttgtactatcctggctgcggtgagcgtctccccacttctgttgacctcaagccagcagaaagccgactggatacctctcgcactgacgattaagggcctaaatcccacagctatctttctgaccactcttagtcggacctctaaaaagagatcctggccactcaacgaggccgtaatggccgtgggcatggttagcatcctggcttcgtcattgctgaaaaatgacattccgatgacagggcctttagtggcaggaggtctcctgactgtctgctacgtgcttaccggcaggtctgccgatctggaattggagcgagcggctgacgtaaagtgggaggatcaggccgaaataagtgggtccagccccatcctctctattacgatcagcgaggacggatccatgtcaattaaaaacgaagaggaggaacaaacactgaccatcctaatacgcactggcctgcttgtgatcagtggtgtcttcccagttagcattcccatcacagcagccgcttggtatctctgggaggtgaagaagcagcgggcaggggtgctgtgggatgtcccttctccaccccctgtgggaaaagccgaattggaggacggcgcgtacagaattaagcagaggggcatctttgggtattcccagataggagctggtgtttacaaagaaggcaccttccacactatgtggcacgtaacacgtggggccgtgttaatgcatcgcggaaagcggattgagccgtcatgggcagatgtcaaaaaggacctgatcagttacggcggtgggtggaagctcgagggagaatggaaagagggcgaagaggtgcaagttctggcccttgaaccaggcaagaatcccagagctgtgcagaccaaacctgggctgtttaagacgaacactggaaccatcggtgccgtcagcttggatttctccccaggcacatctgggtcgcccattgtggacaggaaaggaaaggtagtcggcctatatggtaatggggtggttacccgaagcggagcatacgtgtcagctatcgcccagacagagaagtccatagaggataaccctgaaattgaggacgatatcttccggaaaaagcgcctgactattatggacctccacccgggcgcgggcaaaaccaagagatatctgcccgccatcgtcagggaagcaataaaacgggggcttcgaacgttaattctggctccaacaagagtggttgccgctgagatggaagaggcactccgcggattgcctatcaggtaccagactcccgccatccgtgccgagcataccggtcgggaaattgtggacctgatgtgtcacgctacatttaccatgagactcctgagtccagtcagggtgcctaactataatcttatcattatggatgaggcgcatttcactgaccccgcatctaccgccgctcgcggctacataagcacacgagtagaaatgggggaggccgcaggaatctttatgacggccactccaccgggctccagagatcctttcccccaatcaaacgctccaattatggacgaggaacgggagatccccgaaaggtcttggaatagcggtcacgagtgggtgaccgattttaaggggaagacagtttggttcgtccctagtatcaaagcgggaaacgacattgccgcatgcctgcgcaagaatggcaaaaaggtgatacagttgtcccgtaaaacctttgatagcgaatatgtgaagactagagctaacgactgggatttcgtcgtaacaaccgacatctctgagatgggcgccaattttcgggcagagagggtgattgatccacgccgatgtatgaagcccgttatcctaacggacggggaagagagagtgattctggccggacctatgccggtcactcactcatccgctgcccagcggaggggtcgcatcggcagaaacccaaaaaatgaaaacgaccaatacatatacatgggggagcccctcgaaaatgatgaggactgcgcgcattggaaggaggcaaaaatgttactggataacatcaatacacctgaaggaattatccccagtatgttcgagccagaaagggagaaggtggacgccattgatggcgaatatcggcttcgtggtgaggctcgcaaaacctttgttgacctgatgcgaagaggggatctccctgtgtggttggcctacagggtcgctgcagagggcatcaactatgccgaccggcgctggtgtttcgatggaataaagaataaccagattctggaagagaacgtggaagtagagatctggaccaaagagggcgaaagaaagaagctcaaacccaggtggctggacgctcggatttacagcgatccacttgccctaaaggagttcaaagaatttgcagcggggcgaaagtcgctgactttgaatttaatcacagagatgggaagactgcctaccttcatgacacagaaagcccgcgacgctctcgataacctggccgtgcttcacactgcagaagttggtggcagggcttataatcatgccctgtctgagctcccggagacgttggaaaccctgctactgctcacacttctggcaactgtcaccgggggaatatttttattcttgatgtccggcaagggtatcgggaagatgacactgggcatgtgctgcattatcaccgccagcattctcctgtggtacgctcagatccaaccccactggatagcggcctcaattatccttgagtttttcctgatcgtgctcttgattccagaacctgagaaacagcggactccccaggacaaccagctgacgtatgtggtcatcgcaatattaaccgttgtggctgccacaatggccaatgaaatgggatttctagagaagactaaaaaggacctgggcctcgggagtattaccacacaagagtctgaatccaacatccttgatattgacctgcgtccagcaagcgcttggaccttgtacgccgtagcgactacattcgtgacgcctatgctgagacactcaatcgagaatagtagcgtcaacgtgtccctcaccgctatagccaatcaggcaactgttctgatgggacttggtaggggctggcccctctctaaaatggatatcggggtgccgctgttggccattggatgttacagccaggtcaacccaatcacactgaccgctgcattactactgctcgtagcccattatgcgattatcggccctggtcttcaggctaaggccacccgcgaagcacaaaagcgggccgctgccgggattatgaaaaatcccacagtggacggcatcactgttatagatctggagccaattccctacgaccctaagtttgaaaaacagttgggacaggtgatgctgctcgtcctgtgcgtgacgcaggtccttatgatgcgaaccacatgggcattatgtgaggctctgactctcgccaccggcccgatctccacattgtgggaggggaaccccggaagattctggaataccactatcgcggtgtcaatggccaacatttttaggggctcttatctggcaggtgctgggctactgttcagtataatgaagaatacgacaaacacccgccggggaactggcaatatcggtgaaaccctcggcgagaaatggaagtcgagacttaacgccctggggaagagcgaatttcaaatttacaaaaagtccggaatccaggaggttgatcgtacattggcaaaagagggcattaagaggggggaaactgaccaccatgctgtgtctcggggatcagccaaactgcgctggttcgtagagcgaaacatggtgaccccagaaggcaaggtcgttgatctcggttgcgggagaggaggctggagctattactgtggtggcctgaaaaatgtgagggaggtcaaggggttaacaaagggaggccctgggcacgaagagcccatccctatgtccacgtatggatggaaccttgtgcggctgcagagtggcgtagacgtgttctttaccccacccgagaaatgcgatactctcctatgtgacataggtgaatctagccctaatccaacaatcgaggccgggcgcaccctgagagttttgaacctggtggaaaattggctcaacaataacactcaattctgcattaaggtccttaatccctacatgccgtcagtgatcgagaaaatggaaacactgcagaggaagtacggaggcgcgttggtccgaaaccctctgtcccggaatagtacccatgagatgtattgggtgagcaacgctacgggcaatattgtttcttccgtaaacatgatctcacgtatgctcataaatagatttaccatgaaacacaagaaggcaacatacgagccagatgtggacttagggagcggaactcgcaacattggtatcgaaaacgagatccccaatctggacattataggcaaaaggatcgaaaagattaaacaggagcacgaaacctcgtggcattatgatcaggaccacccttacaagacatgggcctatcatgggtcttacgagactaaacaaaccggaagtgcttccagcatggtcaacggcgtggttcggcttctgacaaagccatgggatgtggtccccatggtgacccagatggccatgactgacacgacaccgttcggtcagcagagagtatttaaggagaaagtggatacccgcactcaagaacctaaggaggggaccaaaaagctaatgaggatcacagcagaatggctctggaaagagctgggaaagaagaaaacgccccgaatgtgtacccgggaggaattcactagaaaggttaggtcaaatgccgctttgggcgcgatttttacagacgagaacaaatggaagtccgcccgcgaagcagtcgaggattctcgtttctgggaactggtggaccgggagagaaatctccaccttgagggcaaatgcgaaacctgtgtgtataacatgatggggaagagggagaaaaagctgggagaatttggtaaggctaaaggcagccgcgccatctggtacatgtggttaggggcacgattcctggagtttgaagccttgggattcctcaatgaggatcactggtttagtcggggcaactccctgagcggtgtcgagggggaaggactacataagcttggctacatactgagagacgtttctaaaaaggagggcggggctatgtatgccgatgacactgcgggatgggacacaaggatcaccctcgaagatctgaaaaatgaggaaatggtgacaaaccacatgaagggtgagcataagaaattggcagaggccattttcaagctgacttaccagaataaagtagtgcgcgtccagagaccaacccctcggggcacggtgatggacatcatttcaaggaaggatcagcgtgggagtggacaagttggcacctatggtctcaacacattcactaatatggaagctcagcttatccgacagatggagggggaaggaatttttaaatccatacaacgcctgaccgtgacagaggagatcgccgtccagaactggttagcaagagtgggccgggaaaggctgagccgcatggctatttctggcgacgattgcgtagttaagcccttggacgatagattcgcctcggctctcactgccctgaatgacatggggaaggtgcggaaagatatccagcagtgggagccatcaaggggatggaacgactggacccaagtccccttttgcagccaccatttccacgaactagtgatgaaggatggtcgagtgcttgtcgttccttgtcgtaaccaggacgagctgatcggcagagcacgcatttcccagggggcgggatggagtctcaaagaaacggcctgcctgggcaagtcttacgctcagatgtggacattgatgtattttcaccggagggatttaagactggccgcaaatgctatatgtagcgccgtgccatcccattgggtaccgacctcacgcactacatggagtatccacgcaaaacatgagtggatgaccactgaggacatgctcgccgtgtggaaccgggtctggattcaagaaaatccctggatggaggacaagacccctgtggaatcttgggaggaagttccataccttggtaagagggaggatcagtggtgcgggagcctgatcggactaacatcccgagcgacgtgggctaaaaacattcagaccgccatcaatcaggtgagatcactgataggcaacgaggaatatactgactacatgcccagcatgaagcggttcaggaaagaggaagaggaagcaggcgtcctctggtga

SEQ ID NO: 14589 - RNA, 9876 nt, synthetic construct
  misc_feature 1..9876: note = derived and/or modified CDS sequence (opt3) from DENV-2__KF955373__SS-prME
  source 1..9876: mol_type = other RNA
accgccggcgtgatcattatgctgatacccacagctatggcattccacctcactacgaggaacggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggattctgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggactgttcggcaagggcgggattgtaacatgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgaggtaaaatcttgccactggcctaagtcccatacgttgtggagtaatggagtcctcgaaagcgagatgatcattcccaaaaacttcgccggccccgtgtctcagcacaactaccgacctggttatcatacacagaccgcaggcccatggcacctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtacgggatggaaattaggccattgaaggagaaggaagagaacctggtgaatagcttagttactgccggacatggccaaatagataacttttcgctcggtgtgctgggcatggcgcttttcctggaagagatgttgcgcacacgagtagggaccaaacacgccatcctcctggtcgctgtgtcctttgtgactctaattacaggaaatatgtctttccgggacctgggccgtgtcatggttatggtgggggcaaccatgacggatgacatcggaatgggcgtaacttatctcgccctgcttgctgcctttaaggtgagacccaccttcgcagcgggtttgctgttaaggaaactcacaagcaaggagctgatgatggccaccattgggatcgcacttctgtcacagagtactatacctgaaacaatcctagagctcaccgatgccctggcattgggaatgatggtcctgaaaattgtgcgcaacatggaaaagtaccagttagctgttacaatcatggccatttcctgcgtgcccaatgcagtcatcctccaaaacgcctggaaggtgtcttgtactatactggctgcggttagcgtgtccccacttctgttgacctcaagccagcagaaagccgactggattcctctcgcactgacgatcaagggcctaaatcccacagctatctttctgaccactcttagtcggacctctaaaaagagatcctggccactcaacgaggccgtcatggccgtaggcatggtgagcattctggcttcgtcattgctgaaaaatgacataccgatgacagggcctttagttgcaggaggtctcctgactgtgtgctatgtccttaccggcaggtctgccgatctggaattggagcgagcggctgacgtgaagtgggaggatcaggccgaaatcagtgggtccagccccattctctctatcacgattagcgaggacggatccatgtcaatcaaaaacgaagaggaggaacacacactgaccatactaatccgcactggcctgcttgtaattagtggtgtgttcccactcagcatccccattacagcagccgcttggtacctgtgggaggtcaagaagcaacgggcaggggttttgtgggatgtgccttctccaccccctgtgggaaaagccgaattagaggacggcgcgtatagaatcaagcagaggggcatatttgggtactcccagattggagctggtgtctataaagaaggcaccttccatactatgtggcacgtgacacgtggggccgttctgatgcatcgcggaaagcggatcgagccgtcatgggcagatgtcaaaaaggacctcatcagttacggcggtgggtggaagctggagggagaatggaaagagggcgaagaggtgcaggtccttgccctggaaccaggcaagaatcccagagctgtgcaaaccaaacctgggttgtttaagacgaacactggaaccattggtgccgttagcctagatttctccccaggcacatctgggtcgcccatcgtggacaggaaaggaaaggtcgtgggcctgtacggtaatggggtagtcacccgaagcggagcatatgtgtcagctatagcccagacagagaagtccattgaggataaccctgaaatcgaggacgatattttccggaaaaagcgcctcactatcatggacctgcacccgggcgcgggcaaaaccaagagataccttcccgccatagttagggaagcaattaaacgggggttacgaacgctgatcctcgctccaacaagagtggtcgccgctgagatggaagaggcattgcgcggactgcctatcaggtatcagactcccgccattcgtgccgagcataccggtcgggaaatcgtggacctcatgtgtcacgctacatttaccatgagactgcttagtccagttagggtgcctaactacaatctgattataatggatgaggcgcacttcactgaccccgcatctatcgccgctcgcggctatattagcacccgagtcgaaatgggggaggccgcaggaatctttatgacagccacgccaccgggctccagagatcctttcccccagtcaaacgctccaatcatggacgaggaacgggagattcccgaaaggtcttggaatagcggtcatgagtgggtgactgattttaaggggaagaccgtatggttcgtgcctagtataaaagcgggaaacgacatcgccgcatgcttgcgcaagaatggcaaaaaggttattcaactatcccgtaaaacatttgatagcgaatacgtcaagaccagagctaacgactgggatttcgtggtgactacagacatctctgagatgggcgccaattttcgggcagagagggtcattgatccacgccgatgtatgaagcccgtaatcctgaccgacggggaagagagagtgatactcgccggacctatgccggttacgcactcatccgctgcccagcggaggggtcgcatcggcagaaaccccaaaaatgaaaacgaccagtatatttacatgggggagcccttagaaaatgatgaggactgcgcgcattggaaggaggcaaaaatgctgcttgataacatcaatactcctgaaggaattatccccagtatgttcgagccagaaagggagaaggtggacgccatagatggcgaataccggctgcgtggtgaggctcgcaaaacatttgtcgacctcatgcgaagaggggatttgcctgtgtggctggcctatagggttgctgcagagggcattaactacgccgaccggcgctggtgtttcgatggaatcaagaataaccaaattctcgaagagaacgtggaagtcgagatctggaccaaagagggcgaaagaaagaagctgaaacccaggtggcttgacgctcggatatatagcgatccactagccctgaaggagttcaaagaatttgcagcggggcgaaagtcgttgaccttaaatctgatcactgagatgggaagactccctacattcatgacccagaaagcccgcgacgctctggataaccttgccgtgctgcacacagcagaagtaggtggcagggcttacaatcacgccctctctgagttgccggagactctggaaacgctactgctccttaccctgttagcaacagtgactgggggaatatttttgttcctgatgtccggcaagggtatcgggaagatgaccctcggcatgtgctgcattatcacagccagcatactgctttggtatgctcagattcagccccattggatcgcggcctcaatcattctggagtttttcctcatcgttttgctgataccagaacctgagaaacaacggaccccacaggacaaccagttaacttacgtcgtgattgcaatcctaacggtggtcgctgccaccatggccaatgaaatgggatttctggagaagaccaaaaaggacctcggccttgggagtattactacccaggagtctgaatccaacatcctggatatagacttgcgtccagcaagcgcttggacactgtatgccgttgcgaccactttcgtgacacctatgctcagacactcaatcgagaatagtagcgtaaacgtgtccctgacggctattgccaatcaagcaaccgtccttatgggactcggtaggggctggcccctgtctaaaatggatatcggggtgccgttgctggccattggatgttacagccaggttaacccaatcactttaacagctgcactactgctccttgtggcccattacgcgattatcggccctggtctgcaggctaaggccacccgcgaagcacagaagcgggccgctgccgggataatgaaaaatcccaccgtcgacggcattacagtaatcgatttggagccaatcccctatgaccctaagtttgaaaaacaactgggacaggtgatgctcctggttctttgcgtgactcaggtcttaatgatgcgaacgacctgggcactgtgtgaggctctcacattggccactggcccgatttccaccctgtgggaggggaaccccggaagattctggaatacaaccatagcggtgtcaatggccaacatctttaggggctcttacctagctggtgctgggctactcttcagtattatgaagaatactacgaacacacgccggggaaccggcaatatcggtgaaactcttggcgagaaatggaagtcgagactgaacgccttgggaaagagcgaatttcagatttataaaaagtccggaatccaagaggtcgatcgtaccctggcaaaagagggcataaagagaggggaaacagaccaccatgctgtgtctcggggatcagccaaactccgctggttcgttgagcgaaacatggtgactccagaaggcaaggtagtggatctgggttgcgggagaggaggctggagctactattgtggtggccttaaaaatgtcagggaggttaaggggctaaccaagggaggccctgggcacgaggaaccaatccctatgtccacatacggatggaacctggtgcggctccagagtggcgtcgacgtgttctttacgccacccgagaaatgcgataccctactgtgtgacattggtgaatctagccctaatccaactatcgaggccgggcgcacattgagagtactgaacctcgtggaaaattggcttaacaataacacccagttctgcattaaggttctgaatccctatatgccgtcagtgatcgagaaaatggaaactttgcaaaggaagtacggaggcgcgctggtccgaaaccctctctcccggaatagtacacacgagatgtactgggtgagcaacgctaccggcaatatagtctcttccgtgaacatgatttcacgtatgttaatcaatagatttacgatgaaacataagaaggcaacctatgagccagatgttgacctggggagcggaacacgcaacatcggtattgaaaacgagatacccaatcttgacatcattggcaaaaggatcgaaaagattaaacaggagcacgaaacttcgtggcattacgatcaggaccacccttataagacctgggcctaccacgggtcttatgagacaaaacagactggaagtgcttccagcatggtaaacggcgtggtcaagctgctaaccaagccatgggatgtggttcccatggtgacacaaatggccatgaccgacactacgccgttcggtcagcagcgggtctttaaagagaaggtggatacaagaacccaggaacctaaagaggggactaagaaactcatgcgcatcaccgcagaatggctgtggaaggagttgggaaagaaaaagacacccaggatgtgtacgcgagaggagttcacccggaaagtaagatcaaatgccgctctgggcgcgatatttactgacgagaacaagtggaaatccgccagggaagcagtggaggattctcgcttctgggaactcgttgaccgtgagcggaatcttcatctggagggcaagtgcgaaacatgtgtctacaacatgatggggaaaagagagaagaagttaggagaatttggtaaagctaagggcagcagggccatctggtatatgtggctgggggcacgcttcttggagtttgaagccctcggattcctgaatgaggatcactggtttagtcgaggcaactccctaagcggtgtggagggggaaggacttcataaactgggctacattctccgggacgtgtctaagaaagagggcggggctatgtacgccgatgacaccgcgggatgggacactagaatcacactggaagatttgaagaatgaggaaatggtcaccaaccacatgaagggtgagcataaaaagctggcagaggccattttcaaactcacatatcaaaataaggttgtgagggtacagcgcccaactcctagaggcaccgtgatggacatcatttcacggaaagatcagagggggagtggacaggtcggcacgtacggtcttaacaccttcacaaatatggaagctcaactgatacgtcagatggagggggaaggaatctttaagtccattcagcgattaactgtgaccgaggagatcgccgttcaaaactggctggcacgcgtgggcagagaacggttgagcaggatggctatctctggcgacgattgcgtcgtgaagcccctcgacgatcgcttcgcctcggctctgacagccctaaatgacatggggaaagtaagaaaggatattcagcagtgggagccatcacggggatggaacgactggactcaggttcccttttgcagccaccacttccatgaacttgtgatgaaagatggtagggtcctggtggtgccttgtcgaaaccaagacgagctcataggccgtgcaagaatctcccagggggcgggatggagtctgaaggaaaccgcctgcttgggcaaatcttatgctcagatgtggacgttaatgtactttcaccgccgggatctgaggctcgccgcaaatgctatttgtagcgccgtcccatcccattgggttccgacatcaagaaccacttggagtatccacgcaaagcacgagtggatgacaaccgaggacatgcttgccgtgtggaaccgcgtatggattcaggaaaatccctggatggaggacaagactcctgtggaatcttgggaggaagtcccatatctgggtaaacgggaggatcaatggtgcgggagcctaatcggactgacctccagggcgacatgggctaagaacatacagacggccatcaatcaggtgcgatcactcattggcaacgaggaatacaccgactatatgcccagcatgaaaagattccggaaggaggaagaggaagcaggcgttttgtggtga

SEQ ID NO: 14590 - RNA, 9876 nt, synthetic construct
  misc_feature 1..9876: note = derived and/or modified CDS sequence (opt3) from DENV-2__GQ868600__SS-prME
  source 1..9876: mol_type = other RNA
accgccggcatgatcattatgctgatacccacagtgatggctttccacctcactacgagaaacggggagcctcatatgatcgtcagcaggcaggaaaagggaaaatcccttctgtttaagaccaaagacggtacaaatatgtgcactttgatggcaatggatttaggcgagctgtgtgaagacaccattacatacaagtgcccattcctaaaacaaaacgagccggaagatatcgactgttggtgcaattctacctcaacttgggttacatatgggacctgtacgactaccggagagcaccggcgcgagaagcgaagtgtggccctcgtaccccatgtgggcatgggtctggaaacacgtactgagacctggatgagctccgaaggggcgtggaagcacgctcagagaattgagacatggatccttaggcatcctggatttaccataatggccgcaatcctggcctacacgattggcactacacacttccagcgggtcttgatctttattctcctgaccgctatcgcaccatctatgactatgcgctgcataggcatttcgaacagagatttcgtggagggggtttcaggaggtagctgggtggacatcgtcctggaacacggcagttgtgtgacaaccatggccaaaaataagcccacgctcgattttgagttaattaaaaccgaagctaagcagcctgccacactgaggaaatattgcatcgaggcgaagcttactaacaccacaactgactcccggtgtccaacccaaggggaacccacattgaatgaggagcaggataagcgcttcgtatgcaaacattctatggttgaccgaggatggggcaacggttgtgggctgtttggaaagggcggcatcgtgacctgcgcaatgttcacttgcaaaaagaatatggaagggaaaattgtccagcctgagaacctagaatacacggtggtgataacaccacacagcggagaggaacatgccgtcggtaatgataccggcaagcacgggaaagaggttaagatcactccgcagtcctcaattaccgaggctgaactcacaggatatggcaccgtgactatggagtgtagtcccagaacaggtctggactttaacgaaatggtacttctgcaaatggaggataaggcctggttggtgcacaggcagtggttcctcgacctgcctttaccatggctgcccggggcagacacgcagggcagcaattggatccagaaagaaaccctcgtcacttttaagaaccctcatgctaaaaagcaagatgtggttgtgcttggatctcaggagggcgccatgcacacagcgctgaccggggccacagagatacagatgtcctcaggaaatttgctattcactggtcatctgaaatgccggctccgtatggacaagctgcaacttaagggcatgagctacagtatgtgtaccgggaaattcaagattgtcaaagaaatcgcagagacgcagcacggaaccatcgtgattcgcgtacagtatgaaggcgatggttctccatgcaagatcccctttgagattatggacctggagaaaagacatgttttggggaggctcataacagtgaacccgatcgtcactgaaaaggattcccctgtgaacattgaggctgaacccccattcggcgacagctacatcatcattggagtcgagcctggccagctgaagttagattggtttaaaaaggggtcgtctataggacaaatgttcgaaaccacaatgcggggtgccaaacgaatggctatcctgggcgacactgcctgggattttgggtccctaggaggcgtgttcacctcaattggtaaggcactccaccaggtttttggggccatctacggcgctgcgttcagtggagtgagctggacgatgaaaattctgatcggcgtaataatcacatggattgggatgaattcccgctctaccagcctttcagtcagtttggtgctggttggaatcgtgactctctatctgggcgtcatggtgcaggcagactccggttgtgtagtgagctggaagaacaaggagcttaaatgcgggtctggaatttttgttacagataatgtccacacctggactgagcagtacaagttccaacccgaatcaccaagtaaactggccagcgctatccagaaggcccatgaggaaggcatatgtggtattagatccgtgaccaggttggagaacctcatgtggaaacagatcacatctgaactgaatcacattttatcggagaacgaggtgaagctgacgatcatgaccggcgacataaaagggatcatgcaggtcggaaagcggagcctacgcccccaacctactgaactcagatattcctggaagacatggggcaaagcaaagatgctgtcaaccgagcttcataatcagacatttttgattgacgggccagaaactgccgagtgcccgaacaccaatagggcttggaacagtctggaagttgaggattacggattcggcgtgtttacgacaaatatctggctccgtctgcgggagaaacaggacgccttctgtgattctaagttaatgagcgcagcgattaaagacaaccgagctgtgcacgccgatatgggttattggatcgaatccgcactgaatgacacctggaagatagagaaggcctcattcattgaagtaaaaagctgccactggcccaagtctcatactctttggtccaacggggtcttggagagtgagatggtgatccctaaaaattttgctggaccagttagccagcacaacaacagacccggctaccatacccaaacagccggtccttggcacctcggcaagctggaaatggatttcgacttttgtgaggggactaccgtggtcgtgacagaagattgcggaaataggggcccatctctacgcacgaccactgcatccgggaaactgatcacagagtggtgctgtcggtcatgcaccctccccccgctgagatataggggagaagacggctgttggtacggtatggagattcgccctcttaaggagaaggaagagaacttggttagtagcctggtgactgctgggcatggacagatcgataatttctcgttaggcattctcggtatggccctgtttcttgaagagatgctgcgaacacgggtaggcaccaaacacgcgatattgctcgtcgccgtgtccttcgtgacgctgatcactgggaacatgtcttttcgtgacctaggaagagtcatggttatggtgggcgctaccatgacagatgacattgggatgggagtaacctacctggcactcctggccgctttcaaggtgaggccaacttttgccgcaggccttttgctgcgcaaattaacaagcaaggaactcatgatgaccacaatcggtattgtcctgctttcacagagttccatccccgagactatactggagctaaccgacgcgctcgccctggggatgatggtgttgaaaatggttcggaatatggaaaagtatcaactggctgtgacgatcatggccattttatgcgtccctaacgcagtgatcctccagaatgcttggaaggtttcttgtacaattctggccgtggtcagcgtatccccccttctgttgacctcaagccagcagaaagcagattggatcccactcgccctgactataaagggactaaaccctaccgctattttcctgacaactcttagtagaacctctaaaaagaggtcctggcccctcaatgaggcgatcatggccgtgggcatggttagcatcctggcatcgtcattgctgaaaaacgacattccaatgacgggcccgttagtggctgggggactcctgacagtctgctacgtgcttaccggtcgatctgccgatctggaattggagcgcgccactgacgtaaagtgggatgaccaagctgaaataagtggctccagccctatcctctctattacaatcagcgaggatgggtccatgtcaattaaaaatgaggaagaggaacagaccctgactatcctaatacggacaggactgcttgtgatcagtggcctctttcccgtcagcattccaatcaccgcagccgcgtggtatctgtgggaggttaagaagcagagagctggtgtgttgtgggacgtgccctctcctccacccgtcgggaaagccgagttagaagatggagcatacaggattaagcagaaaggcatcctgggctattcccaaataggggccggagtgtacaaggagggtacgttccacactatgtggcatgttacccgtggcgctgtactcatgcacaaagggaagcgcattgaaccttcatgggcagacgtgaagaaagatctgatcagttatggaggcggttggaagcttgagggggaatggaaagagggagaggaagtccaggtgctggccttggagccgggcaagaacccacgggcggttcagacaaaacccggcctatttagaaccaatacagggactatcggagctgtgagcctggacttctcccctggtacctctggctcgccaattgtcgataagaaggggaaagtggtaggactctacggcaacggtgtcgtgacgaggagcggggcctacgtttcagcaatcgcccagacagaaaagtccatagaggacaatcccgaaattgaggacgatatcttccgaaaacggcgcctgactattatggaccttcatcctggagctggcaagaccaaaagatatttaccggccatcgtgagggaggcaataaagcggggcctgcgaacactcattttggctcccaccagagtcgtggccgcggaaatggaggaagccctgcgcgggctcccaatcaggtaccaaactcctgcaatccgtgctgagcacaccggacgggaaattgttgatctgatgtgtcatgccacatttacgatgagacttctgagtcccatcagggtgccaaactataacttgattataatggacgaggctcacttcactgatcctgcatctatcgccgcccgcggttacattagcacccgagtcgagatgggcgaagctgcggggatctttatgacagcaacccccccaggatccagagacccgttccctcagtcaaatgcccccatcatggatgaggaacgggagattccagagaggtcttggaacagcggccacgaatgggtgactgactttaagggtaaaacagtatggttcgtgcccagtataaagaccgggaatgatatcgctgcctgcctacgcaaaaacggaaagcgtgttattcagctgtccagaaaaacgtttgacagcgagtatgtcaagactcggacaaatgattgggacttcgtggtgaccaccgacatctctgaaatgggcgcaaactttaaggccgagagggtcattgatcctcgccgatgtatgaaaccagtaatcctcactgacggcgaagagagagtgatattagctgggcccatgcctgttacacattcatccgcggcccaacggaggggacgcatcggtagaaatccgaggaacgagaatgatcagtacatttatatgggcgaaccactggagaacgacgaagattgcgcacactggaaggaggctaaaatgcttctggacaatatcaacacccccgaagggattatccctagtatgttcgagcccgagcgggaaaaggtggatgccatagacggagagtaccgtctccgcggcgaagcacgaaaaacatttgtcgatttgatgagaaggggtgacctgccagtgtggctcgcctacaaggttgctgccgaggggattaattatgcggatcggcgctggtgtttcgacggcactagaaacaatcagatcctggaagagaacgtggaggtcgaaatttggacgaaagagggagaaaggaagaagcttaaacctcggtggctagatgcacgaatctacagcgaccccctggccttgaaggagttcaaagagtttgctgccggcagaaagtcgttaaccctgaacctcataacagaaatggggcgcctgccaactttcatgacccagaaagctagggacgcacttgataatctggccgtgctccatacagctgaggccggaggtaaggcatataaccacgcgttgtctgaactgcctgagaccctagaaactctgctccttctgacgttattggccaccgtaacaggcgggatctttctgttcctcatgtccggacggggcattggtaagatgactctggggatgtgctgcatcattaccgctagcatccttctgtggtacgcccaaatacagccgcactggattgcagcttcaatcatcctcgagtttttcttgattgtgctgttaatccccgagccagaaaaacagcgtacacctcaggacaatcaactaacctatgttataattgccatcctgactgtcgtggcagccacaatggctaacgagatgggctttctcgaaaagacgaaaaaggatcttggactgggcaatattgcgacccagcagcccgagagtaacatcttggacatagatctgagaccagcctctgcatggactctctacgctgtggccacaaccttcatcacccctatgctgaggcattccattgaaaatagctcagtcaacgttagtcttacagccatcgcaaatcaggctactgtgctcatggggctgggaaaaggttggcccttgagcaagatggacattggcgtaccgctgttagccatcgggtgttattcccaagtgaacccaattacgctaaccgcggctctgctccttctggtcgcccactacgcaatcataggacctggcttgcaggccaaggctacacgcgaggcacagaaacgggccgcggctggtattatgaagaatcccactgtggatgggatcaccgttatcgacctggatccaattccctacgaccctaaatttgagaagcagctcggccaagtgatgctgcttgtcttatgcgtaacacaggtgctgatgatgcgaaccacttgggccctctgtgaagcattgacgctggccacaggaccggtttctaccctatgggagggcaaccccgggagattctggaatactaccatagctgtgagcatggccaacatctttaggggatcctatctggcaggcgctggtctccttttctcaattatgaaaaatacaacttctacccgccgggggacaggaaacatcggcgaaacgctgggtgagaagtggaagagtagattgaatgccctgggcaaatcggaatttcagatttacaagaaaagcgggatccaagaggtcgatcgtaccctcgcgaaggagggaataaaaaggggcgaaactgaccatcacgccgtgtcccgggggtctgcaaagctgcgctggttcgtcgagcgaaacttagtgacaccagaaggaaaagttgtggatcttggctgcggtagagggggatggtcatattactgtggcggtctgaagaacgtaagggaggtgaagggcctcaccaaagggggacctggccatgaggaacccatccctatgagcacttatgggtggaatctagtccggctgcagtccggagttgacgtgttctttgtcccacccgagaagtgcgacacattgctgtgtgatattggcgaaagttctcctaacccaaccgtggaggctggtcgcacgctcagagtacttaatctggtggaaaactggttgaataacaatacccagttctgcgttaaagtgctgaacccctacatgccgagcgtcatcgagaggatggagacactccagcgaaagtatgggggagccttagtgcggaatcctctgtcacgtaactccactcacgaaatgtactgggtcagtaatgcaagcggcaacattgtgtcttccgttaatatgatctcaagaatgcttataaaccgctttaccatgaggcacaaaaaggctacatacgagccagacgtagatctgggcagcgggactcggaatattggaatcgaatcggagacccccaacctagacatcattggtaagagaatagaaaaaatcaagcaagagcatgagacatcttggcactatgatcaggaccatccttacaaaacctgggcctatcacggcagttacgaaactaagcagacggggtccgccagctcaatggtgaacggagtcgtgcgcctcctgacaaaaccatgggatgttgtgcccatggtcacccagatggcgatgactgacaccacaccgttcggccaacagagggtgtttaaggagaaggtagatacgcgaacccaggaacctaaagagggtactaagaaattgatgaagattacagctgaatggctgtggaaagagctcgggaagaagaaaaccccccggatgtgtactagagaggaattcacaaagaaagtgaggtccaatgcagcccttggagctatctttaccgacgagaacaagtggaaatctgcccgcgaagcagttgaggatagccgtttctgggagctggtcgacaaggaacggaatttacacctggagggcaaatgcgaaacatgtgtgtataacatgatgggcaagagagagaagaaattgggggaatttggaaaggccaaaggtagtagggctatttggtacatgtggctcggcgcgcgcttcctggagtttgaggccctagggttccttaatgaagaccattggttttcccgagagaacagcctgtctggagtggaaggcgagggtctccacaagctggggtatatcttgcgggaagtctcaaaaaaggagggaggcgcaatgtacgctgatgacactgccggctgggataccagaataacgatcgaggacctgaagaatgaagagatgattaccaaccatatggcaggggaacacaaaaagctcgccgaggctatcttcaaacttacataccagaataaggttgtgagggtacaacgcccaactcctagaggaaccgtgatggatattatcagtcggagggaccagcgtggttccggccaggtcgggacatatggactgaacactttcaccaatatggaagcccaattaattcgacagatggagggcgagggtatatttaaaagcatccagcatctgacggcgtctgaagagattgcagtgcaggattggttggttcgcgtggggagagaacggctctcgaggatggccatctcaggagacgattgcgtcgtgaagcccctggacgatcgcttcgctagagccctaacagcacttaacgacatgggcaaggtacggaaagatatccaacagtgggagccaagcaggggctggaatgactggacccaggttcccttttgctcccaccacttccatgagctgattatgaaggacgggcgaactctcgtggtcccttgtcgtaaccaggatgaactgataggaagagctcgcatcagtcaaggtgccggctggtctttgcgggagacagcttgcttagggaaaagctacgcccagatgtggtccctgatgtattttcacaggagagacctccgccttgcagcgaatgccatttgttcagctgtgccaagtcattgggtgccgacctctcggactacctggagcatccacgcctcccacgaatggatgacaacggaggatatgctgaccgtctggaacaaggtttggattctagaaaacccctggatggaggacaaaactcctgtggagtcatgggaagagatcccatacctgggaaagagggaagatcagtggtgcggcagcctcataggtttgacatctcgagcaacctgggctaagaatatccagactgccattaaccaagtaagatccctgatcgggaatgaggaatatacagactacatgcccagtatgaaacggttcaggcgcgaggaggaagaggcaggagtgctttggtga

SEQ ID NO: 14591 - RNA, 9876 nt, synthetic construct
  misc_feature 1..9876: note = derived and/or modified CDS sequence (opt3) from DENV-2__KF955359__SS-prME
  source 1..9876: mol_type = other RNA
accgcaggagtgatcattatgctgatacccaccgctatggcattccacctcactacgaggaatggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtcgcgctggtgccccatgtcggtatggggcttgagaccagaacagaaacttggatgagtagcgagggagcttggaaacacgtgcagaggatcgagacctggattctgcggcatcctggcttcacaaccatggccgcaatcttggcctacacgattggcactacacactttcagcgcgctctcatcttcattctgctgaccgcagttgccccatccatgactatgagatgcatcgggatatctaacagggattttgtggaaggagtctcgggtggctcatgggtggacattgtactcgagcacgggagctgtgttacaaccatggctaagaataagcccacgttagatttcgaactgatcaaaaccgaggccaagcagcctgcgattcttcggaaatattgcatcgaagcaaagttgacaaacactaccacagagagtcgctgtccaactcaaggagagccctccctgaatgaggaacaggacaaacgatttatctgcaagcattctatggtggatagaggctggggtaacgggtgtggactattcggcaagggcgggattgtaacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagccagtctcgtcctggtgggcatcgttacactttatctgggtgtgatggtccaggctgacaccgggtgtgtggtatcctggaagaataaagaattgaagtgcggaagcggcatattcattactgataacgtgcacacatggaccgagcagtacaagtttcagcccgaatctccatcaaaactcgccagtgcaatccaaaaggcccatgaggaaggtatttgtggcatcaggagcgttactcggctggagaatttaatgtggaaacagataacccccgagctgaaccacatcctatccgaaaatgaggtcaagctcacaattatgacgggggacatcaaaggaattatgcaggctggcaagcgctctctgagacctcagccaaccgaacttaaatattcgtggaagacttgggggaaggccaaaatgttgagcacagagtcccataaccaaaccttcctgatcgatggaccggaaacagcagagtgccccaatactaacagggcgtggaactcactcgaggtggaagactacggctttggtgtgttcagtaccaacatatggctgaagttacgtgagaaacaggacgtcttttgtgattctaagctgatgagcgctgccattaaagacaatcgggcagttcacgccgatatggggtattggatcgaatccgctcttaacgacacgtggaagatggagaaggcctcattcatcgagattaaaagctgccactggcctaagtctcatacattgtggtccaatggagtgctcgaaagtgagatgatcattcccaagaatttcgcaggccccgtgagccagcacaactaccgacctggttatcatacccagactgctggcccatggcacctggggaagctagaaatggattttgacttctgtgagggaaccacagtagtcgtgactgaagattgcggcaatagagggccctctctgaggaccacaacggcctccggaaaactcataaccgagtggtgctgtcgctcatgcactctgccgcctcttcggtacagaggcgaggacggttgttggtacgggatggaaatcaggccattgaaggagaaggaagagaacctggttaatagtttagtgacagcgggacatggccaaattgataactttagcctcggtgtcctgggcatggcccttttcctggaagagatgttgcgcacccgagtggggactaaacacgctatcctcctggttgcagtgtcgtttgtaacactaattaccggaaatatgtccttccgggacctgggccgtgtcatggtgatggtgggggccacgatgactgatgacatcggaatgggcgtcacctatctcgctctgcttgccgcatttaaggttagacccacattcgcggccggtttgctgttaaggaaactcacctctaaggagctgatgatggctactatagggatcgcccttctgagccagtcaacaattcctgaaaccatcctagagctcacagatgcactggctttgggaatgatggtgctgaaaattgtacgcaacatggaaaagtaccagttagccgtgactatcatggcaataagttgcgtccccaatgccgtgattctccaaaacgcttggaaggtttcctgtaccatcctggcggccgtgtctgtcagcccacttctgttgacgtcctcacagcagaaagcagactggatccctctcgctctgacaattaagggcctaaatcccaccgccatatttctgactacccttagccggacaagtaaaaagagatcttggccactcaacgaggccgtgatggctgttggcatggtgtccatcctggcaagctcgttgctgaaaaatgacattccgatgactgggcctttagtcgccggaggtctcctgaccgtatgctatgtgcttacgggcaggtcagcggatctggaattggagaaggctgccgacgttaaatgggaggatcaggcagaaatctctgggagttcccccattctcagcatcacaatatctgaggacggaagcatgtccatcaagaacgaagaggaggaacacaccctgactattctaatccgaacaggcctgcttgtgatttcaggtgtcttcccagtgagtatccccataaccgccgctgcatggtacctctgggaggtaaagaaacaacgcgccggggtgctgtgggatgtccctagcccaccccctgttggaaaggcggaattggaggacggcgcttatcggattaaacagagaggcatctttgggtactctcagatcggagccggtgtgtataaggaaggcactttccatacaatgtggcacgtgaccagaggggcagtcttaatgcatcgtggaaaacgcattgagccgtcctgggccgatgtgaagaaggacctgatctcatacggcggtgggtggaaactcgagggagaatggaaggagggcgaagaggttcaggtactggctcttgaaccaggcaaaaatccccgggccgtgcaaacgaagcctgggctgtttaaaactaacaccggaacaataggtgcagtcagtttggatttcagcccaggcacctccgggtctcccattgtggacagaaagggaaaggttgtgggcctatacggtaatggggtcgtgacaaggtcgggagcttatgtaagcgccatcgcgcagactgagaaatcaattgaggataaccctgaaatcgaggacgatatattccgaaagaaacggctgaccattatggacctccacccgggcgccggcaagacgaaacgctacctgcccgcaatcgtcagagaagctatcaagagggggcttcggacattaattctggccccaactcgagtggttgctgcagagatggaagaggccctcagaggattgcctatccgctatcagacccccgccattagggctgagcatacaggtcgtgaaatagtggacctgatgtgtcacgcgacctttactatgcggctcctgtccccagtcagagtgcctaactacaatcttatcattatggatgaggcacacttcaccgaccccgccagtatcgctgccaggggctatatctctacacgcgttgaaatgggggaggcagccggaatttttatgacggctactccaccgggcagccgagatcctttcccccagtccaacgcgccaataatggacgaggaaagagagatccccgaacggtcatggaactctggtcatgagtgggtgaccgattttaaggggaaaacagtctggttcgtgcctagcattaaggccggaaacgacatcgcagcttgcctgaggaaaaatggcaagaaagtaattcaattgagtcgcaagacctttgattccgaatacgtgaagactcgtgccaacgactgggatttcgttgtcacaaccgacatcagcgagatgggcgcaaattttagagccgagcgggtgatagatccaaggcgctgtatgaaacccgtgatcctaacggacggggaagaacgagtcattctggctggacctatgccggtaactcactcttcagccgcgcagagacggggtaggatcggccgcaacccaaagaatgaaaacgaccagtatatttacatgggggagcccctcgaaaatgatgaggactgcgcacattggaaagaggccaagatgttactggataacatcaatacacctgaaggaataattccctccatgttcgagccagaaagagagaaagtggacgctatcgatggcgaatacaggcttcggggtgaggcccgtaagacctttgttgacctgatgcgccgaggggatctccctgtgtggttggcttatagagtcgcagccgagggcattaactacgctgacaggcggtggtgtttcgatggaatcaaaaataaccaaatactggaagagaacgtggaagttgagatctggaccaaggagggcgaacgcaagaaactcaagcccagatggctggacgccaggatttatagtgatccacttgcactaaaagagttcaaggaatttgcggccgggcggaaaagcctgactttgaatttaatcacagagatgggacgactgcctaccttcatgacacagaaggctagagacgccctcgataacctggcagtgcttcacactgctgaagtcggtggccgcgcctacaatcacgcactgtcggagctcccggagacgttggaaaccctgctactgctcacacttctggccactgtgaccgggggaatatttttattcttgatgtctggcaagggtatcgggaaaatgacactgggcatgtgctgcataattaccgcttccatcctcctgtggtatgcgcagatccagccccattggattgccgcaagcatcatacttgagtttttcctgattgtactcttgatcccagaacctgagaagcaaaggactccccaggacaaccagctgacgtacgtggttattgctatcttaaccgtcgtggccgccacaatggcaaatgaaatgggatttctagagaaaactaagaaagacctgggcctcgggtcaataaccacacaggagagtgaatctaacatccttgatattgacctgcggccagcttccgcctggaccttgtatgcggtggctactacattcgtcacgcctatgctgcgtcacagcatcgaaaattcaagtgttaacgtgagcctcaccgccattgcaaatcaagccactgtactgatgggacttggtagaggctggcccctctccaagatggatatcggggtgccgctgttggctattggatgttactctcaggtcaacccaatcacactgaccgcagccttactactgctcgtggcgcattacgctataattggccctggtcttcaggccaaggcaaccagggaagcccagaaacgcacagctgccgggatcatgaagaatcccactgttgacggcatcacggtgattgatctggagccaataccctatgaccctaaatttgaaaagcaattgggacaggtcatgctgctcgtactgtgcgtgacccaggttcttatgatgcggacaacttgggcattatgtgaggctctgaccctcgccacaggcccgatcagcaccttgtgggaggggaaccccggacgattctggaatactacgattgcggtgtccatggccaacatctttagaggctcatacctggccggtgctgggctactgttctctattatgaaaaatacaaccaacactaggcgcggaaccggcaatatcggtgaaacactcggcgagaagtggaagagtcggcttaacgccctggggaaatcggaatttcagatatataagaaaagcggaatccaagaggtcgatagaactttggcaaaggagggcattaaacgtggggaaaccgaccaccatgctgtgtccaggggatctgccaagctgcggtggttcgtcgagcgcaacatggtgacaccagaaggcaaagttgtggatctcggttgcgggcgaggaggctggtcatactattgtggtggcctgaagaatgtaagagaggtgaaggggttaacgaaaggaggccctgggcacgaagaaccaatccctatgagcacctacggatggaaccttgtcaggctgcagtccggcgttgacgtgttctttactccacccgagaagtgcgatacactcctatgtgacattggtgaaagttctcctaatccaaccatcgaggccgggcggactctgcgcgtcttgaacctggtggaaaattggctcaacaataacacacagttctgcgtaaaagtgcttaatccctatatgccgagcgttatagagaagatggaaaccctgcaaagaaaatacggaggcgcgttggtgaggaaccctctgtcacgaaattccacgcacgagatgtactgggtcagtaacgctaccggcaatattgtgagctctgtcaacatgatctcccggatgctcatcaatcgttttacaatgaagcataagaaagcaacttatgagccagatgtggacttagggtcaggaaccagaaacattggtatagaaaacgagatccccaatctggacattatcggcaagcgcattgagaagatcaagcaggagcacgaaacaagctggcattacgatcaggaccacccttataaaacttgggcctaccacgggtcgtatgagaccaagcagacaggatctgctagttccatggttaacggcgtagtgaaacttctgaccaaaccatgggatgtcgtgcccatggttactcaaatggccatgacggacacaaccccgttcggtcagcagagggtgtttaaggagaaagtcgatactcggacccaggaacctaaggaggggacgaaaaagctaatgagaataacagcagaatggctctggaaggagctgggcaaaaagaaaacaccccgcatgtgtactagggaggagttcacacgaaaggtgcggagcaatgccgctttgggcgcgatctttaccgacgagaacaaatggaagtcagccagagaagcagtagaggattccaggttctgggaactggtggaccgcgagcgtaatctccatcttgagggcaaatgcgaaacttgtgtttacaacatgatggggaagcgggagaagaaactgggagaatttggtaaggctaaaggctctagagccatttggtatatgtggttaggggcaaggttcctggagtttgaagccttgggattcctcaatgaggatcactggtttagccgcggcaacagtctgtccggtgtcgagggggaaggactacataaacttggctacatcctgcgagacgtgagcaaaaaggagggcggggctatgtacgccgatgacacagcgggatgggacacccggattacactcgaagatctgaagaatgaggaaatggtgactaaccacatgaaaggtgagcataagaaattggcagaggccatcttcaagctgacctatcaaaataaagtcgttagagtgcagaggccaacgcctcgcggcaccgtaatggacattatatctagaaaggatcagcgggggtcaggacaggtgggcacatacggtctcaacactttcaccaatatggaagctcaacttatcaggcagatggagggggaaggaatttttaagagtatccagcgtctgacagtcactgaggagatcgccgtgcaaaactggttagcacgagttggccgcgaaagactgtcccggatggctattagcggcgacgattgcgtggtcaaacccttggacgataggttcgcctctgctctcaccgccctgaatgacatggggaaggtgcgcaaagatatacagcagtgggagccatcgagaggatggaacgactggacgcaggtacccttttgctcacaccacttccatgagctagttatgaaggatggtcggatgcttgtggtcccttgtaggaaccaagacgagctgatcggccgagcacgtattagccagggggcgggatggtccctcaaagaaacagcctgcctgggcaagagttatgctcagatgtggaccttgatgtactttcacagacgcgatttacggctggccgcaaatgctatctgttctgccgtgccaagccattgggtgccgacttccaggacaacctggtcaattcacgcaaagcacgagtggatgactaccgaggacatgctcgccgtctggaacagagtttggatccaggaaaatccctggatggaggacaaaacacctgtggaaagttgggaggaagtaccatatcttggtaagcgcgaggatcaatggtgcgggtctctgataggactaacgagccgggcgacctgggctaaaaacatccagactgccattaatcaggtgaggtccctgatcggcaacgaggaatacacagactatatgccctcaatgaagcgattcagaaaagaggaagaggaagcaggcgtcctctggtga

SEQ ID NO: 14592 - RNA, 9876 nt, synthetic construct
  misc_feature 1..9876: note = derived and/or modified CDS sequence (opt3) from DENV-2__KF955360__SS-prME
  source 1..9876: mol_type = other RNA
accgccggcgtgataattatgctgatacccacagctatggcattccacctcactacgaggaacggggagcctcatatgatcgtagggaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtgcgaccacgggcgagcaccgccgagaaaagcgttcagtagctctggtgccccatgtcggtatggggcttgagactagaaccgaaacatggatgagtagcgagggagcctggaaacacgtgcagaggatcgagacttggatactgcggcatcctggcttcaccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgtactcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaagaacaggacaaacgatttatctgcaagcattctatggtggatagaggctggggtaacgggtgtggactattcggcaagggcgggattgtcacttgcgctatgtttacctgcaaaaagaatatggaaggaaaagtggtgctccctgagaacctggaatacacaatagtcatcaccccacacagcggtgaggagcatgccgttggcaatgacactgggaagcacggaaaagaaattaagatcacgccgcagtcctcaataacagaggcagaacttaccggctatggtactgtgaccatggagtgtagtcccaggacagggctggatttcaacgaaatggtattgctccagatggaggacaaggcttggctggtgcaccggcaatggtttttagatctgcctctcccatggcttcccggcgccgacacccagggaagcaattggattcagaaggagactctggtcacattcaagaaccctcatgcgaaaaagcaggacgtggttgtgttgggctctcaagaaggggccatgcacacggcactaaccggagctactgagatccagatgtcctcaggtaatctgctctttacaggccatctgaaatgccgtcttcgcatggataagctgcagttgaaagggatgagctacagtatgtgtaccggaaagttcaagatcgtcaaagaaattgccgagacacaacacggcactatcgtgattagagtacagtatgagggtgacgggtctccatgcaagatacccttcgaaatcatggatctcgagaaaaggcatgttctgggccggttaattaccgtgaacccgatcgtcacggaaaaggactcccctgtgaacatcgaggctgaacccccatttggagatagctacattataatcggcgtcgagcctgggcagctgaaactaaattggttcaagaagggatcgtctattggtcagatgtttgagaccacaatgcgaggcgccaaacgcatggcaatcctcggggacactgcctgggatttcggatccctgggcggtgtgtttacctcaattgggaaggcacttcaccaagttttcggcgcgatctacggagcagcctttagtggcgtgagctggacaatgaaaatattgatcggggtaattatcacttggattggaatgaactccagatctaccagcctgtcagtcagtctcgtgctggttggcgtggtcacgctttatctgggtgtgatggtacaggctgactccgggtgtgtggttagctggaagaataaagaattgaagtgcggatctggcatcttcataacagataacgtccacacctggactgagcagtacaagtttcagcccgaatcaccaagtaaactcgccagcgcaattcaaaaggcccatgaggaaggtatctgtggcattaggtccgtgacacggctggagaatttaatgtggaaacagatcacccccgagctgaaccacatactatctgaaaatgaggtgaagctcactatcatgaccggggacattaaaggaatcatgcaggctggcaagcgctcgctgagacctcagccaacagaacttaaatatagctggaagacgtgggggaaggccaaaatgttgtccaccgagtcacataaccaaactttcctgattgatggaccggaaacagcagagtgccccaataccaacagggcgtggaatagtctcgaggtcgaagactacggctttggtgttttctctacaaacatctggctgaagttacgtgagaaacaggacgtgttttgtgatagcaagctgatgtccgctgccataaaagacaatcgggcagtgcacgccgatatggggtattggattgaatcagctcttaacgacacttggaagatggagaaggccagcttcatcgagatcaaatcttgccactggcctaagtcccataccttgtggagtaatggagtactcgaaagcgagatgattatccccaagaacttcgcaggccccgtctctcagcacaactaccgacctggttatcatacgcagacagctggcccatggcacctggggaagctagaaatggattttgacttctgtgagggaaccactgtggttgtgaccgaagattgcggcaatagagggccctccctgaggacaactaccgcctcaggaaaactcattacagagtggtgctgtcgcagttgcacgctgccgcctcttcggtacagaggcgaggacggttgttggtacgggatggaaataaggccattgaaggagaaggaagagaacctggtcaatagcttagtgaccgcgggacatggccaaatcgataacttttcgctcggtgttctgggcatggcccttttcctggaagagatgttgcgcactcgagtggggacaaaacacgctattctcctggtagcagtctcctttgtgaccctaatcactggaaatatgtctttccgggacctgggccgtgtgatggtcatggttggggccacaatgaccgatgacattggaatgggcgtgacgtatctcgctctgcttgccgcatttaaggtaagacccactttcgcggccggtttgctgttaaggaaactcaccagcaaggagctgatgatggctacaatcgggatagcccttctgtcacagagtaccatccctgaaactattctagagctcacagatgcactggctttgggaatgatggtgctgaaaatcgtccgcaacatggaaaagtaccagttagccgtgaccattatggcaatctcctgcgttcccaatgccgtgatactccaaaacgcttggaaggtctcttgtacaattctggcggccgtgagcgtttccccacttctgttgacttcaagccagcagaaagcagactggatccctctcgctctgaccatcaagggcctaaatcccacggccatttttctgacaacccttagtcggacttctaaaaagagatcctggccactcaacgaggccgtgatggctgtcggcatggtaagcatactggcatcgtcattgctgaaaaatgacatcccgatgaccgggcctttagtggccggaggtctcctgacagtttgctatgtgcttactggcaggtctgcggatctggaattggagcgagctgccgacgtcaagtgggaggatcaggcagaaattagtgggtccagccccatcctctctattaccatcagcgaggacggatccatgtcaatcaaaaacgaagaggaggaacacacgctgacaatcctaattcgcaccggcctgcttgtgatcagtggtgtattcccagtgagcattcccatcactgccgctgcatggtacctctgggaggtcaagaagcaacgggccggggttctgtgggatgtgccttctccaccccctgtgggaaaagcggaattggaggacggcgcttatagaataaagcagaggggcatttttgggtactcccagatcggagccggtgtctataaagaaggcacattccataccatgtggcacgtgactcgtggggcagttttaatgcatcgcggaaagcggatcgagccgtcatgggccgatgtcaagaaagacctgattagttacggcggtgggtggaaactcgagggagaatggaaagagggcgaagaggtgcaggtcctggctcttgaaccaggcaagaatcccagagccgtgcaaacaaaacctgggctgtttaagaccaacacgggaactatcggtgcagttagcttggatttctccccaggcacctctgggtcgcccatagtggacaggaaaggaaaggtcgtgggcctatacggtaatggggtagtcacacgaagcggagcttatgtgtcagccattgcgcagaccgagaagtccatcgaggataaccctgaaattgaggacgatatcttccggaaaaagcgcctgacaataatggacctccacccgggcgccggcaaaactaagagatacctgcccgcaattgttagggaagctatcaaacgggggcttcgaaccttaatcctggccccaacgagagtggtcgctgcagagatggaagaggccctccgcggattgcctattaggtatcagacacccgccatccgtgctgagcatactggtcgggaaattgtggacctgatgtgtcacgcgacctttacaatgagactcctgagtccagttagggtgcctaactacaatcttataatcatggatgaggcacacttcaccgaccccgcctctattgctgcccgcggctatatcagcactcgagtcgaaatgggggaggcagccggaatctttatgaccgctacaccaccgggctccagagatcctttcccccagtcaaacgcgccaattatggacgaggaacgggagatacccgaaaggtcttggaatagcggtcatgagtgggtgacggattttaaggggaagactgtatggttcgtgcctagtatcaaagccggaaacgacattgcagcttgcctgcgcaagaatggcaaaaaggttatccaattgtcccgtaaaacctttgatagcgaatacgtcaagacaagagccaacgactgggatttcgtggtgaccactgacatttctgagatgggcgcaaattttcgggccgagagggtcatcgatccacgccgatgtatgaagcccgtaatactaacagacggggaagagagagtgatcctggctggacctatgccggttacccactcatccgccgcgcagcggaggggtcgcattggcagaaaccccaaaaatgaaaacgaccagtatatctacatgggggagccactcgaaaatgatgaggactgcgcacattggaaggaggccaaaatgttactggataacattaatacgcctgaaggaatcatacccagtatgttcgagccagaaagggagaaggtggacgctattgatggcgaataccggcttcgtggtgaggcccgcaaaacttttgtcgacctgatgcgaagaggggatctccctgtgtggttggcttatagggttgcagccgagggcatcaactacgctgaccggcgctggtgtttcgatggaattaagaataaccaaatcctggaagagaacgtggaagtcgagatatggacaaaagagggcgaaagaaagaagctcaaacccaggtggctggacgcccggatctatagcgatccacttgcactaaaggagttcaaagaatttgcggccgggcgaaagtcgctgaccttgaatttaattaccgagatgggaagactgcctactttcatgacacagaaagctcgcgacgccctcgataacctggcagtgcttcacaccgctgaagtaggtggcagggcctacaatcacgcactgtctgagctcccggagacattggaaactctgctactgctcacgcttctggccaccgtgacagggggaatctttttattcttgatgtccggcaagggtattgggaagatgactctgggcatgtgctgcatcataaccgctagcattctcctgtggtatgcgcagatccagccccattggatcgccgcatcaattatccttgagtttttcctgatagttctcttgattccagaacctgagaaacaacggacaccccaggacaaccagctgacctacgtcgtgatcgctattttaactgtggtcgccgccacgatggcaaatgaaatgggatttctagagaagaccaaaaaggacctgggcctcgggagtatcacaactcaggagtctgaatccaacatacttgatatcgacctgcgtccagctagcgcctggaccttgtatgcggttgctacaaccttcgtgactcctatgctgagacactcaattgagaatagtagcgtaaacgtgtccctcacagccatcgcaaatcaagccacggtcctgatgggacttggtaggggctggcccctctctaaaatggatattggggtgccgctgttggctatcggatgttacagccaggttaacccaattaccctgactgcagccttactactgctcgtggcgcattacgctatcataggccctggtcttcaggccaaggcaacacgcgaagcccagaagcggaccgctgccgggattatgaaaaatcccaccgtcgacggcatcacagtaatcgatctggagccaattccctatgaccctaagtttgaaaaacaattgggacaggtgatgctgctcgttctgtgcgtgactcaggtccttatgatgcgaacgacctgggcattatgtgaggctctgacactcgccactggcccgatatccaccttgtgggaggggaaccccggaagattctggaatacaaccatcgcggtgtcaatggccaacatttttaggggctcttacctggctggtgctgggctactgttcagtatcatgaagaatactacgaacacacgccggggaaccggcaatattggtgaaactctcggcgagaaatggaagtcgagacttaacgccctgggaaagagcgaatttcagatctataaaaagtccggaatacaagaggtcgatcgtaccttggcaaaagagggcatcaagagaggggaaacagaccaccatgctgtgtctcggggatcagccaaactgcgctggttcgttgagcgaaacatggtgactccagaaggcaaggtagtggatctcggttgcgggagaggaggctggagctactattgtggtggcctgaaaaatgtcagggaggttaaggggttaaccaagggaggccctgggcacgaagaaccaattcctatgtccacatacggatggaaccttgtgcggctgcagagtggcgtcgacgtgttctttacgccacccgagaaatgcgataccctcctatgtgacatcggtgaatctagccctaatccaactattgaggccgggcgcacactgagagtattgaacctggtggaaaattggctcaacaataacacccagttctgcatcaaggttcttaatccctatatgccgtcagtgatagagaaaatggaaactctgcaaaggaagtacggaggcgcgttggtccgaaaccctctgtcccggaatagtacacacgagatgtactgggtgagcaacgctaccggcaatattgtctcttccgtgaacatgatctcacgtatgctcatcaatagatttacgatgaaacataagaaggcaacctatgagccagatgttgacttagggagcggaacacgcaacattggtatagaaaacgagatccccaatctggacattatcggcaaaaggattgaaaagatcaaacaggagcacgaaacttcgtggcattacgatcaggaccacccttataagacctgggcctaccacgggtcttatgagacaaaacagactggaagtgcttccagcatggtaaacggcgtggtcaaacttctgaccaagccatgggatgtggttcccatggtgacacaaatggccatgaccgacactacgccgttcggtcagcagcgggtctttaaagagaaggtggatacaagaacccaggaacctaaagaggggactaagaaactaatgcgcataaccgcagaatggctctggaaggagctgggaaagaaaaagacacccaggatgtgtacgcgagaggagttcacccggaaagtaagatcaaatgccgctttgggcgcgatctttactgacgagaacaagtggaaatccgccagggaagcagtggaggattctcgcttctgggaactggttgaccgtgagcggaatctccatcttgagggcaagtgcgaaacatgtgtctacaacatgatggggaaaagagagaagaagctgggagaatttggtaaagctaagggcagcagggccatttggtatatgtggttaggggcacgcttcctggagtttgaagccttgggattcctcaatgaggatcactggtttagtcgaggcaactccctgagcggtgtggagggggaaggactacataaacttggctacatcctgcgggacgtgtctaagaaagagggcggggctatgtacgccgatgacaccgcgggatgggacactagaattacactcgaagatctgaagaatgaggaaatggtcaccaaccacatgaagggtgagcataaaaagttggcagaggccatcttcaaactgacatatcaaaataaggttgtgagggtacagcgcccaactcctagaggcaccgtgatggacattatatcacggaaagatcagagggggagtggacaggtcggcacgtacggtctcaacaccttcacaaatatggaagctcaacttatccgtcagatggagggggaaggaatttttaagtccatccagcgactgactgtgaccgaggagatcgccgttcaaaactggttagcacgcgtgggcagagaacggctgagcaggatggctatttctggcgacgattgcgtcgtgaagcccttggacgatcgcttcgcctcggctctcacagccctgaatgacatggggaaagtaagaaaggatatacagcagtgggagccatcacggggatggaacgactggactcaggttcccttttgcagccaccacttccatgagctagtgatgaaagatggtagggtccttgtggtgccttgtcgaaaccaagacgagctgatcggccgtgcaagaatttcccagggggcgggatggagtctcaaggaaaccgcctgcctgggcaaatcttatgctcagatgtggacgttgatgtactttcaccgccgggatttaaggctggccgcaaatgctatctgtagcgccgtcccatcccattgggttccgacatcaagaaccacttggagtattcacgcaaagcacgagtggatgacaaccgaggacatgctcgccgtgtggaaccgcgtatggatccaggaaaatccctggatggaggacaagactcctgtggaatcttgggaggaagtcccatatcttggtaaacgggaggatcaatggtgcgggagcctgataggactaacctccagggcgacatgggctaagaacatccagacggccattaatcaggtgcgatcactgatcggcaacgaggaatacaccgactatatgcccagcatgaaaagattccggaaggaggaagaggaagcaggcgttctctggtga

SEQ ID NO: 14593 - RNA, 9876 nt, synthetic construct
  misc_feature 1..9876: note = derived and/or modified CDS sequence (opt3) from DENV-2__KF955363__SS-prME
  source 1..9876: mol_type = other RNA
accgccggagtgatcattatgctgatacccacagctatggcattccacctcactacgcggaacggggaacctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttctatgcaagcattctatggtggatagaggctggggtaacgggtgtggactcttcggcaagggcgggatcgtaacctgcgccatgtttacatgcaaaaagaatatggaaggaaaagtggtgcagcctgagaacctggaatacaccattgtcataactccacacagcggtgaggagcatgctgttggcaatgacacggggaagcacggaaaagaaatcaagattacaccgcagtcctcaatcaccgaggccgaacttactggctatggtaccgtgacaatggagtgtagtcccaggaccgggctggatttcaacgaaatggtattgctccaaatggaggacaaagcatggctggtgcaccggcagtggtttttagatctgcctctcccatggcttcccggcgctgacactcagggaagcaattggatacagaaggagacactggtcacgttcaagaaccctcatgccaaaaagcaagacgtggttgtgttgggctctcaggaaggggcgatgcacaccgccctaactggagcaacagagattcagatgtcctcaggtaatctgctctttaccggccatctgaaatgccgtcttcgcatggataagctgcaattgaaagggatgagctacagtatgtgtacaggaaagttcaagatcgtcaaagaaatcgctgagactcagcacggcaccattgtgatcagagtacagtatgagggtgacgggtctccatgcaagattcccttcgaaataatggatctcgagaaaaggcatgttctgggccggttaatcacggtgaacccgattgtcaccgaaaaggactcccctgtgaacatcgaggccgaacccccatttggagatagctacatcattataggcgtcgagcctgggcagctgaaactaaattggttcaagaagggatcgtctatcggtcaaatgtttgagacaactatgcgaggcgctaaacgcatggccattctcggggacaccgcatgggatttcggatccctgggcggtgtgtttacatcaatcgggaaggcccttcaccaggttttcggcgctatttacggagcggcatttagtggcgtgagctggactatgaaaatcttgataggggtaatcattacctggatcggaatgaactccagatctacgagcctgtcagtcagtctcgtgctggttggcgtggtcacactttatctgggtgccatggtgcaggctgactccgggtgtgtagtgagctggaagaataaagaattgaagtgcggatctggcattttcatcaccgataacgttcacacttggacagagcagtacaagtttcaacccgaatcaccaagtaaactcgccagcgcaatacagaaggcccatgaggaaggtatttgtggcatcaggtccgtcacccggctggagaatttaatgtggaaacaggtgactcccgagctgaaccacattctatctgaaaatgaggtgaagctcaccatcatgacaggggacataaaaggaatcatgcaggctggcaagcgctcgctgagacctcaaccaacggaacttaaatatagctggaagacctgggggaaggccaaaatgttgtccactgagtcacataaccagacattcctgattgatggaccggaaaccgcagagtgccccaatacaaacagggcgtggaatagtctcgaggtcgaagactacggctttggtgttttcactaccaacatctggctgaagttacgtgagaaacaggacgtgttttgtgattctaagctgatgagcgctgccattaaagacaatcgggcagtgcacgccgatatggggtattggatcgaatccgctcttaacgacacgtggaagatggagaaggcctcattcatagaggtaaaaagctgccactggcctaagtctcatacattgtggtccaatggagtcctcgaaagtgagatgattatccccaaaaatttcgcaggccccgtgagccagcacaactaccgacctggttatcatacccaaactgctggcccatggcacctggggaagctagaaatggattttgacttctgtgagggaaccacagttgtggtcactgaagattgcggcaatagagggccctctctgaggaccacaacggcctccggaaaactcatcaccgagtggtgctgtcgctcatgcactctgccgcctcttcggtacagaggcgaggacggttgttggtacgggatggaaattaggccattgaaggagaaggaagagaacctggtgaatagtttagttacagcgggacatggccagatcgataactttagcctcggtgtgctgggcatggcccttttcctggaagagatgttgcgcacccgagtagggactaaacacgctattctcctggtcgcagtgtcgtttgtgacactaataaccggaaatatgtccttccgggacctgggccgtgtcatggttatggtgggggccacgatgactgatgacatcggaatgggcgtaacctatctcgctctgcttgccgcatttaaggtgagacccacattcgcggccggtttgctgttaaggaaactcacctctaaggagctgatgatggctactattgggatcgcccttctgagccagtcaacaattcctgaaaccatcctagagctcacagatgcactggctttgggaatgatggtcctgaaaatagtgcgcaacatggaaaagtaccaattagccgttactatcatggcaattagttgcgtgcccaatgccgtcatcctccagaacgcttggaaggtgtcctgtaccattctggcggccgtttctgtgagcccacttctgttgacgtcctcacagcagaaagcagactggatccctctcgctctgacaataaagggcctaaatcccaccgccatttttctgactacccttagccggacaagtaaaaagagatcttggccactcaacgaggccatcatggctgtcggcatggtatccatcctggcaagctcgttgctgaaaaatgacattccgatgactgggcctttagtggccggaggtctcctgaccgtttgctatgtgcttacgggcaggtcagcggatctggaattggagcgagctgccgacgtcaagtgggaggatcaagcagaaatatctgggagttcccccatcctcagcattacaatctctgaggacggaagcatgtccattaaaaacgaagaggaggaacagaccctgactatcctaatacgcacaggcctgcttgtgatctcaggtgtattcccagtgagtattcccatcaccgccgctgcatggtacctctgggaggtcaagaagcagcgggccggggttctgtgggatgtgcctagcccaccccctgtgggaaaagcggaattggaggacggcgcttatagaattaagcagaggggcatcttagggtactctcaaataggagccggtgtctataaagaaggcacttttcacacaatgtggcatgtgacccgtggggcagttctgatgcaccgcggaaagcggattgagccgtcctgggccgatgtcaagaaagacctcatctcatacggcggtgggtggaaactggagggagaatggaaagagggcgaagaggtgcaggtccttgctctggaaccaggcaagaatcccagagccgtgcagacgaaacctgggttgttcaagactaacaccggaacaatcggtgcagttagtctagattttagcccaggcacctccgggtctcccattgtggacaggaaaggaaaggtcgtgggcctgtacggtaatggggtagtcacacgatcgggagcttatgtgagcgccatcgcgcagactgagaagtcaatagaggataaccctgaaattgaggacgatatcttccggaaaaagcgcctcaccattatggacctgcatccgggcgccggcaaaacgaagagataccttcccgcaatcgttagggaagctataaaacgggggttacgaacactgattctcgccccaactagagtggtcgctgcagagatggaagaggccttgcgcggactgcctatcaggtatcaaacccccgccatccgtgctgagcacacaggtcgggaaattgtggacctcatgtgtcatgcgaccttcactatgagactgctttccccagttagggtgcctaactacaatctgatcattatggatgaggcacactttaccgaccccgccagtatagctgcccgcggctatatctctacacgagtcgaaatgggggaggcagccggaattttcatgacggctactccaccgggcagcagagatccttttccccagtccaacgcgccaatcatggacgaggaacgggagatccccgaaaggtcatggaactctggtcacgagtgggtgaccgatttcaaggggaagacagtatggtttgtgcctagcattaaagccggaaacgacatagcagcttgcttgcgcaagaatggcaaaaaggttatccagctaagtcgtaaaaccttcgattccgaatacgtcaagactagagccaacgactgggattttgtggtgacaaccgacattagcgagatgggcgcaaatttcaaggccgagcgggtcatcgatccaaggcgctgtatgaaacccgtaattctgacggacggggaagaacgagtgatcctcgctggacctatgccggttactcattcttcagccgcgcaaagacggggtaggataggccgcaacccaaagaatgaaaacgaccagtatatctacatgggggagcccttagaaaatgatgaggactgcgcacactggaaagaggccaagatgctgcttgataacattaatacacctgaaggaatcattccctccatgtttgagccagaaagagagaaagtggacgctatcgatggcgaatacaggctgcggggtgaggcccgtaagaccttcgtcgacctcatgcgccgaggggatttgcctgtgtggctggcttatagagttgcagccgagggcataaactacgctgacaggcggtggtgttttgatggaattaaaaataaccagatcctcgaagagaacgtggaagtcgagatttggaccaaggagggcgaacgcaagaaactgaagcccagatggcttgacgccaggatctatagtgatccactagcactgaaagagttcaaggagttcgcggccgggcgaaagagcttgactttaaatctgataacagagatgggacggctccctacctttatgacacagaaggctagagacgccctggataaccttgcagtgctgcatactgctgaagccggtggcaaggcatacaatcacgccctctcggagttgccggagacgctggaaaccctactgctccttacactgttagctactgtaaccgggggaatcttcttgtttctgatgtctggcaaaggtattgggaagatgacactcggcatgtgctgcatcattaccgcgtccatcctgctttggtatgcccaaatacagccccactggattgcagctagcatcatcctggagttctttctcattgtgttgctgatcccagaacctgagaaacagcgcactccccaggacaaccaattaacgtacgttgtcatagccattctaaccgtggtggccgcaacaatggctaatgaaatgggattcctggagaagactaaaaaggacctcggccttgggtcaatcaccacacaggagagtgaatctaacattctggatatcgacttgaggccagcctccgcgtggaccctgtatgctgtcgccactacatttgttacgcctatgctccggcatagcatagaaaattcaagtgtgaacgtaagcctgaccgcaatcgccaatcaggctactgtgcttatgggactcggtaagggctggcccctgtccaaaatggatattggggtcccgttgctggcaatcggatgttactctcaggtgaacccaattacattaaccgccgcgctactgctccttgttgctcactacgccatcattggccctggtctgcaagcaaaggccacccgtgaagctcagaaaagagccgcagctgggatcatgaagaatcccacagtggacggcataactgtcattgatttggagccaatcccctatgaccctaaattcgaaaagcagctgggacaggtaatgctcctgatcctttgcgtgacgcaagttttaatgatgaggaccacatgggccctgtgtgaggcgctcactttggccaccggcccgattagcacactgtgggaggggaaccccggacgcttttggaataccactatagcagtgtccatggctaacatcttccggggctcatacctagccggtgcagggctgctcttttctattatgaagaatacgacaaacacccgaagaggaactggcaatatcggtgaaacccttggcgagaaatggaagagtaggctgaacgctttggggaaatcggagttccagatttataagaaaagcggaatccaggaggtcgatcgcacactggccaaggagggcataaaaagaggggaaactgaccatcacgccgtgtccagaggatctgcgaagctccgttggtttgtcgagaggaacatggtgaccccagaaggcaaggttgtggatctgggttgcgggcggggaggctggtcatactattgtggtggccttaaaaatgtacgcgaggtgaaggggctaacaaaaggaggccctgggcatgaagaaccaatccctatgagcacgtacggatggaacctggtccgactccaatccggcgttgacgtgttcttcaccccacccgagaagtgcgatactctactgtgtgacattggtgaaagttctcctaatccaacaatcgaggctgggagaaccttgagggtcctgaacctcgtggaaaattggcttaacaataacactcagttttgcattaaagtactgaatccctatatgccgagcgtgatcgagaagatggaaacattgcagcggaagtacggaggcgcactggttcgcaaccctctctcaagaaattccacccacgagatgtactgggtgagtaacgccacgggcaatatagtcagctctgtgaacatgatttccaggatgttaatcaatcgattcaccatgaaacacaagaaagctacatatgagccagatgtcgacctggggtcaggaactcggaacatcggtattgaaagcgagatacccaaccttgacatcattggcaagcgtatcgagaaaattaagcaggagcatgaaacctcgtggcactacgatcaagaccatccttataagacatgggcctaccacgggtcttatgagactaaacagaccggaagtgcatccagcatggtgaatggcgttgtaagactgctaacaaagccatgggatgtggtccccatggtgacccagatggccatgactgacacgacaccgtttggtcagcaacgcgttttcaaagagaaggtggataccaggactcaggaacctaaagaggggaccaagaagctcatgaaaatcacagctgaatggctgtggaaggagttgggcaaaaagaaaacgccccggatgtgtaccagagaggaatttactcgcaaggtcaggtcaaacgcggccctgggcgcaatattcacagacgagaataaatggaagtccgctcgagaagccgtggaggattctcggttttgggaactcgtagacagagagaggaaccttcacctggagggcaagtgcgaaacctgtgtgtacaatatgatggggaaacgcgagaagaaattaggagagttcggtaaggcaaaaggcagccgtgccatctggtatatgtggctgggggctcggtttttggagttcgaagccctcggatttctgaacgaggatcattggttcagtagaggcaattccctaagcggtgttgagggggaaggacttcacaggctgggctacattctccgcgacgtctctaagaaggagggcggggcgatgtacgcagatgacactgccggatgggacacacgaatcaccctggaagatttgaaaaacgaggaaatggtgacaaatcatatgaagggtgagcacaaaaagctggctgaggccatttttaaactcacttatcagaacaaggtggtccgggttcagagaccaacccctaggggcacggtgatggacatcatttcacgcagagatcaacgggggagtggacaggtaggcacctacggtcttaatacattcactaacatggaagcacagctgataaggcaaatggagggggaaggaatcttcaagtccattcagcatttaaccgtgacagaggagatcgctgtccagaattggctggcccgtgtgggccgagaacgcttgagcagaatggttatctctggcgacgattgcgtggtcaaacccctcgacgatcggtttgcttcggccctgactgcactaaacgacatggggaaggtgaggaaagatattcagcaatgggagccatcacgcggatggaatgactggacccaggtacccttctgcagccaccactttcatgaacttgttatgaaggatggtagagtgctggtcgtgccttgtcggaaccaggacgagctcataggcagggcgcgaatctcccagggggccggatggagtctgaaagaaacggcttgcttgggcaagtcttatgcccaaatgtggacattaatgtacttccaccgtagagatctgcgcctcgcagctaacgccatttgtagcgcagtgccatcccattgggtcccgacctcacggactacatggagtatccacgccaagcacgagtggatgaccactgaggacatgcttgcggtttggaatagggtgtggattcaggaaaacccctggatggaggacaaaacccctgtagaatcttgggaggaagtgccatatctgggtaagagagaggatcagtggtgcgggagcctaatcggactgacatcccgcgctacgtgggccaaaaatatacagaccgcaatcaaccaagtccggtcactcattggcaatgaggaatacactgactatatgcccagcatgaagaggtttcgaagagaggaagaggaagccggcgtgttgtggtga

SEQ ID NO: 14594 - RNA, 9876 nt, synthetic construct
  misc_feature 1..9876: note = derived and/or modified CDS sequence (opt3) from DENV-2__EU726767__SS-prME
  source 1..9876: mol_type = other RNA
agcgccggaatgatcattatgctgatacccaccgtgatggctttccacctcacaactagaaacggggagcctcatatgatcgtctccaggcaggaaaagggaaaatctcttctgtttaagacggaggacggtgttaatatgtgcaccttgatggcaatggatttaggcgaactgtgtgaggacacaattacttacaaatgcccactactccggcaaaacgaaccggaggatatcgactgttggtgcaattcaaccagtacatgggtgacctatgggacttgtgccacaaccggagagcaccgccgagaaaagcgtagcgtagcgctggtgccccatgtcggcatgggtcttgagacgagaactgaaacctggatgtcctctgagggggcttggaaacacgcccagaggattgagacatggatcctgcggcatcctggattcactataatggcagccatcttggcttacaccattggcacaacccactttcagcgcgcactcatcttcattctgctgacggccgtggctccatcgatgactatgagatgcatcggcatatcaaacagggattttgttgaaggggtgagcggaggtagttgggtcgacattgtgctcgagcacggctcctgtgtaacaaccatggccaagaataagcccactttagatttcgaactgatcaaaacagaggcgaagcagcctgcaacccttcggaaatattgcattgaagccaagttgacgaacaccacaactgagtctcgctgtccaacccaaggggagcccagcctgaaagaagaacaggacaagcgatttgtttgcaagcattccatggtggatagaggatggggcaatggttgtgggctattcggaaaaggcggcatcgtcacatgcgctatgtttacttgcaagaaaaacatggaagggaagatcgtgcagcctgagaatctcgaatacaccattgtggtcacaccacactcaggagaggagcatgccgttggtaacgacaccggcaaacacgggaaggaaataaaagtgactccgcagagtagcatcacggaggcagaactgacaggatatggcaccgtaactatggagtgttctcccaggaccggtcttgatttcaatgaaatggtgctgttgcaaatggagaacaaggcttggctcgtccaccggcagtggtttctggacttacctctgccatggctccccggggccgatacacagggctccaattggattcagaaggagacccttgtgactttcaaaaaccctcatgcgaagaaacaagacgttgtggtcctgggatcacaggaaggcgccatgcacacagcattgacgggggctaccgagatccagatgagcagtggaaatctactgtttactggtcatctcaagtgccgtctgcgcatggacaaacttcaactgaagggcatgtcttactccatgtgtacagggaagttcaaagtggtaaaggaaatagccgagacccagcacggaacaattgttatcagagtgcagtatgagggcgatggtagcccatgcaaaatccccttcgaaattatggacttggagaagaggtacgtcctcgggcggctgatcactgtgaacccgattgtcaccgaaaaagattcgcctgtgaacatagaggctgaacccccatttggcgactcttacatcattatcggagttgagcctggccagttaaagctgaattggttcaagaaagggtcctcaatcggacaaatgtttgagacgaccatgcgaggtgccaagcgcatggcaattctaggcgatacagcctgggacttcgggagtctcggaggcgtgtttactagcataggtaaagctctgcatcaggtattcggggcgatctatggcgcagccttttccggagtctcttggaccatgaagattcttatcggcgtgattatcacatggatagggatgaacagcagatcaacaagtttgtccgttagcctggtgctcgtcggaatcgtgaccctgtaccttggcgtaatggtgcaggctgattctggttgtgttgtctcatggaaaaataaggaactgaagtgcgggagtggaattttcatcacggacaacgtgcacacatggaccgagcagtataaatttcaacccgaaagcccatccaagttggcctctgcaattcagaaagcccaggaggaaggcatctgtggtataaggtcggtgactcggctcgagaatctgatgtggaagcagattacacccgagttaaaccacatcctggctgaaaatgaggtcaaactaaccattatgactggcgatgttaaggggatcatgcaagccggaaaacgcagcctcagacctcagccaaccgaactgaagtactcctggaagacatggggcaaagcaaagatgctttcaacggagagtcataaccagaccttcttgatagacgggccggaaactgcggagtgccccaatacaaacagggcttggaactctctggaggtggaagattatggatttggcgtgttcaccacaaacatctggctcaaactgaaggagaaacaggacgccttttgtgacagcaagttaatgtccgcagccattaaggataatcgtgctgtacacgccgacatgggttactggatcgaatcagcactgaacgatacttggaaaattgagaaggctagcttcatcgaggtcaaaaattgccattggcctaagtctcacaccctttggtccaacggggtgttggaaagtgagatgataattcccaagaatctcgccggacccgttagccaacacaattatcggcctggctaccatacgcagatcgcgggtccatggcacctgggcaagctagaaatggacttcgatttttgtgaggggacaaccgtggtcgtgactgaagactgcggaaaccgaggcccctctctgagaaccacaactgcctccgggaagctcatcaccgagtggtgctgtaggtcatgcacactgccgcctcttcgctaccggggagaggatggctgttggtatggtatggaaattagaccattgaaagagaaggaagagaatctggttaacagtttagtgacggctgggcatggacaggtagacaatttcagcctcggcgtcctgggtatggcactttttctggaagagatgttgaggacccgcgtgggcactaaacacgccatcctcctggtggctgtctcgttcatgacactaattaccgggaacatgtcctttaaggatctgggacgagttgtggtaatggtgggcgccgcaatgactgacgatatagggatgggagtcacatacctcgcgctgcttgccgctttcaaagtgcggcccacctttgccgcaggcttgctgttacgtaagctcacgtctaaggagctgatgatgactaccatcggtattgcacttctgagccaatcaacaatccctgaaaccattctagagctcactgacgccctggcattggggatgatggttctgaaaatggtgagaaatatggaaaagtatcagttagccgtcacaatcatggctatactctgcgtgcccaacgcggttatcctgcagaatgcctggaaagtgagttgtaccattcttgcagtcgtatccgtgtctccactgttgctcacaagctcccagcaaaagactgattggatccctctggctctaaccattaaaggactgaaccccacggccatcttccttacaaccctctcaaggactagcaagaaacgcagttggccactgaatgaggccataatggctgttggcatggtgtctattttggcatccagcctgttaaagaacgacatcccgatgaccggccctctcgtcgccgggggactgcttacagtgtgctacgtactgactggtcggtcggcggacttggaactcgagagagctaccgatgtgaagtgggaggaccaggccgaaatctcaggctctagtcccattctgtccataacgatcagcgaggatgggtctatgagcattaaaaatgaagaggaggaacagacactaaccatcctgattaggactggacttctcgtcatctccggcctgtttccagtttcaatacccatcacagcagccgcttggtatttgtgggaggtgaagaaacagcgagctggtgtgttatgggacgtccctagtccaccccctatggggaaggccgaactggaggatggagcgtaccgcattaaacaaaagggcatcctcggctatagccagattggggctggagtgtacaaggaaggtaccttccatactatgtggcacgttacacggggcgccgtactgatgcacaaagggaagagaatcgagccgtcttgggcagacgtgaaaaaggatcttatatcctacggaggcggttggaaactggagggggaatggaaggagggagaagaggtccaggtgttggccctagaaccaggcaagaaccccagggctgttcagaccaaacctggcctgtttaagacgaatgccgggactattggagcagtgtcactcgacttcagtccaggtaccagcggctcccccatcatcgataaaaaggggaaagtcgtgggactgtatggcaacggtgtagtcacacgttctggggcttacgtgtcggccattgcgcaaaccgaaaagagcatcgaggacaaccctgaaatagaggatgacatttttcgcaagcggagacttacaatcatggatttacatccgggagccggcaaaactaagaggtatctgcccgcaattgttcgagaagctatcaaacggggcctccgcaccttgatactggccccaacgagagtggtcgctgcagagatggaagaggccctcagggggctgcctattcggtaccagacacccgccatccgagctgagcacactggaagagaaatcgtggaccttatgtgtcatgcgaccttcacaatgcgcctgttgtcaccagttagggtgcctaattataacctaattatcatggacgaggcacacttcaccgatcccgcctccattgctgcccgtggttacataagtactcgggtcgaaatgggcgaggcagccgggatctttatgaccgctacaccaccgggatctagagaccctttcccccagagcaatgcgccaattatcgatgaggaaagggagatccccgaacgctcctggaactcaggccatgagtgggtgacggactttaagggtaaaactgtatggttcgtgccttctattaaggccgggaatgatatagcagcttgcctgcgaaagaacggcaaaaaggttatccaactcagcagaaaaacctttgacagtgaatatgtcaagacacggaccaatgattgggacttcgtggtgactacagatatttccgagatgggcgccaactttaaagcagagagggtcatcgacccacgccgttgtatgaagcccgtaattttaaccgatggcgaagagagagtgatcctggccgggcctatgccggttacgcacagctctgctgcccagcggaggggacgcataggtcgaaatcccaaaaacgaaaatgaccagtacatctacatgggcgagccccttgaaaacgacgaggattgcgcgcactggaaggaggcaaagatgctgctcgacaatattaacactcctgaagggatcattccctcaatgttcgagccagaaagagagaaagtggatgccatcgacggagaatatcggttgaggggcgaggctcgcaagacatttgtcgatctgatgagaaggggtgacctccctgtgtggctggcctacaaagttgctgcagaggggataaattatgccgatcggcgttggtgtttcgacggcattaagaacaaccagatccttgaagagaatgtggaagtcgagatttggaccaaagagggagaacgcaagaagctaaaaccccgatggctggatgctagaatctactccgacccattggccttaaaggagtttaaagagttcgcagcgggcaggaagagtctgaccctcaacctgataactgagatggggcggcttcctacattcatgacccagaaaactcgcgatgccctggacaatctcgctgtgttgcatactgccgaagcaggaggtagagcttataaccacgccctgagcgagctaccggagacgctggaaaccctccttctgttaacattgctggcaactgtaaccggcgggatctttctcttcctgatgtcgggaaggggcattggtaagatgacacttgggatgtgctgcatcattaccgcctctatcctgctctggtacgctcaaatacagccccattggattgcggcctccatcatcttggagtttttcctgattgtgttactaatcccagaacctgagaagcagcggactccccaagataatcagctgacgtatgttgtcatagcaattctcaccgtggtggctgccacaatggccaacgaaatgggctttcttgagaaaactaagaaagacctgggattgggcagcatcgtcacccagcagccagagtcaaatattctggacatcgatctccgacctgcaagtgcttggacactgtacgccgttgcgaccactttcgtgacacccatgcttagacactctatagaaaactccagcgtaaatgtgtcactcacggctatcgccaaccaagcaaccgtcctgatggggttgggaaagggttggccgctgagtaaaatggacattggcgtgccattactagccatcgggtgttacagccaggttaatcctattactctgacagctgcactccttctgttggtggcccactatgcgatcattggacccggcctgcaggctaaggccacccgcgaggcacagaagagggccgctgccggtatcatgaaaaacccaaccgtcgatgggataacagtaattgacctcgatcccatcccttacgacccgaagtttgaaaaacaactgggccaggtgatgcttttagttctgtgcgtgactcaggtcctcatgatgcggacgacctgggcattgtgtgaggctctgacactagccactggacccatctccaccctgtgggaaggcaatccagggcgtttctggaacacaaccattgcggtgtctatggccaatatatttagaggaagctatctcgcaggcgctggtcttctgttctccatcatgaagaacactacgaatacaaggcgcgggaccggaaacattggcgagactttgggtgagaaatggaagtcacggctgaacgccctcggcaaatctgaatttcaaatctacaagaagagtgggattcaggaggtcgatcgaaccctggcaaaagaaggaatcaagagaggcgagacagaccatcacgctgtgtcgagggggagcgccaaattacgctggttcgttgagcggaatatggtgactcctgaaggaaaggtagtggatcttggctgcggtagagggggatggtcctattactgtggcggtctgaaaaacgtccgtgaggttaagggcctcaccaaagggggacccggccatgaggaacctataccaatgtctacatatgggtggaatctagtgaggctgcagtcaggagtcgacgtgtttttcatcccacctgaaaaatgcgatacgttgctgtgtgacattggcgagagctccccaaaccccaccgtagaggccggtcggactctccgcgtgcttaatctggttgaaaactggttgaataacaatacacagttctgcatcaaggtgctgaacccgtacatgcctagtgtcattgagaaaatggaagcgctccaacgaaagtacgggggagctttagtgagaaatccactgtctaggaacagcacccacgagatgtattgggtctcaaatgcatccggcaacatcgtgagtagcgttaatatgatatctcggatgcttattaaccgctttactatgagacataaaaaggccacatacgaacccgatgtagacctgggctccgggaccaggaacatcggaatcgagtcagagattcctaatctagacataatcggtaagcgaattgagaaaatcaagcaggagcacgaaacgagctggcactatgatcaggaccatccatacaaaacctgggcttatcacggctcgtacgagacaaagcagactgggtctgccagttccatggtgaacggagtcgtgcggctcctgaccaaaccctgggatgttttgccgacagtgactcaaatggcaatgaccgacacaacccctttcggccagcagcgtgtctttaaggaaaaggtggatactagaacgcaggagcccaaagagggtacaaagaaactgatgaagattaccgccgaatggctctggaaagagcttgggaagaaaaagactccacgcatgtgtaccagggaagagttcacacggaaggtaagaagcaatgctgcgctgggagccgtgtttacggacgagaacaaatggaagtcagcacgcgaagctgttgaggattccaggttctgggaattagtcgacaaagagcgatctctgcatttggaaggcaagtgcgagacctgtgtgtataatatgatgggcaaacgggagaagaagctcggggaatttggaaaagccaagggtagcagagcaatctggtacatgtggctgggcgccaggttcctagagtttgaagctcttgggttcctgaacgaggatcactggtttagtcgcgaaaattccctcagcggagtggagggcgagggtctgcacaaattggggtacatactgcgtgacgtctctaagaaagaaggaggcgccatgtatgcggatgacactgcaggctgggacacacggatcaccctcgaggatcttaagaacgaagagatggttactaatcatatggaaggggagcacaagaaactggccgaggctattttcaagttaacataccaaaacaaagtggtaagagtgcagaggcctaccccacgcggaacagtcatggacatcatttcacgacgggatcagagaggtagtggccaagtggggacttatggactgaatacctttacgaacatggaagcccagttgatcaggcagatggagggcgaaggtgttttcaagaatattcagcatctcaccgtgacagaggagatagcagtccaaaactggctggctcgcgtggggagagaacggctatccaggatggccatcagcggagacgattgcgtagttaaaccacttgacgatcgtttcgcttctgccctgactgcactcaatgacatgggcaagattcgaaaggatatccagcagtgggagccctcgcgcggctggaacgactggacccaggtgcctttttgctcacaccatttccacgaactgatcatgaaagatgggagagtcttggtggtgccatgtcggaaccaagacgagttaattggaagggcgcgcataagccagggtgccggctggtccctgagagaaacagcttgcctcgggaagagttacgcccagatgtggtctcttatgtattttcaccggagggatctgcgactagcagctaatgccatctgtagcgcagtcccgtcccattgggttcccacttcacgtaccacgtggagtattcacgccaaacatgagtggatgacaaccgaggacatgctgactgtgtggaacagagtatggatccaggaaaatccttggatggaggacaagacaccagtggaatcttgggaggaaattccctacctcggaaaacgcgaggatcaatggtgcggcagcttgatcggtctgacctcccgggcgacttgggctaagaacatacaggccgcaatcaatcaggtcaggtcacttattgggaacgaggaatataccgactacatgcctagcatgaagagattccgccgggaggaagaggaagccggagtgctgtggtga

SEQ ID NO: 14595 - RNA, 9876 nt, synthetic construct
  misc_feature 1..9876: note = derived and/or modified CDS sequence (opt3) from DENV-2__EU687246__SS-prME
  source 1..9876: mol_type = other RNA
agcgcaggaatgatcattatgctgataccaaccgtgatggctttccacctcacaactagaaatggggagcctcatatgatcgtatccattcaggaaaagggaaaatctcttctgtttaagacggaggacggtgttaatatgtgcaccttgatggcaatggatttaggcgaactgtgtgaggacacaatcacttacaaatgcccactactcaggcaaaacgaaccggaggatattgactgttggtgcaattcaaccagtacatgggtgacctatgggacttgtacaaccacgggagagcaccggcgcgaaaagcgaagcgtagcactggtgccccatgtcggcatgggtcttgagactcgtaccgaaacatggatgtcctctgagggggcgtggaaacacgctcagagaatcgagacttggatactgaggcatcctggattcaccatcatggccgcaattttggcctacacaatcggcaccacgcactttcagcgggctctcattttcatcctgctgactgcagtggccccatcgatgacaatgcgctgcataggcatttcaaacagagattttgttgaaggggtgagcggaggtagttgggtcgacatcgtgctcgagcacggctcctgtgtaaccactatggctaagaataagcccacattagatttcgaactgattaaaaccgaggccaagcagcctgcgacgcttaggaaatattgcatcgaagcaaagttgaccaacacaactaccgagtctcggtgtccaacacaaggggagcccagcctgaaagaggaacaagacaagcgctttgtttgcaagcattccatggtggatcgaggatggggcaatggttgtgggctattcggaaaaggcggcatcgtcacttgcgccatgtttacctgcaagaaaaacatggaagggaagattgtgcagcctgagaatctcgaatacacaatagtggtcaccccacactcaggagaggagcatgctgttggtaacgacactggcaaacacgggaaggaaatcaaagtgacgccgcagagtagcattacagaggccgaactgaccggatatggcactgtaaccatggagtgttctcccagaacaggtcttgatttcaatgaaatggtgctgttgcaaatggagaacaaggcatggctcgtccacaggcagtggtttctggacttacctctgccatggctccccggggctgatacccagggctccaattggatccagaaggagactcttgtgacattcaaaaaccctcatgccaagaaacaagacgttgtggtcctgggatcacaggaaggcgcgatgcacacggccttgaccggggcaactgagatacagatgagcagtggaaatctactgtttacaggtcatctcaagtgccggctgcgtatggacaaacttcaactgaagggcatgtcttactccatgtgtaccgggaagttcaaagtggtaaaggaaattgctgagacacagcacggaactatcgttatccgcgtgcagtatgagggcgatggtagcccatgcaaaattcccttcgaaatcatggacttggagaagagatacgtcctcgggaggctgattaccgtgaacccgatagtcacggaaaaagattcgcctgtgaacatcgaggccgaacccccatttggcgactcttacattatcatcggagttgagcctggccagttaaagctgaattggttcaagaaagggtcctcaattggacaaatgtttgagaccacaatgcggggtgctaagcgaatggccatactaggcgatactgcatgggacttcgggagtctcggaggcgtgtttaccagcatcggtaaagccctgcatcaggtattcggggctatttatggcgcggcattttccggagtctcttggacaatgaagatccttattggcgtgatcataacttggatcgggatgaacagccgctcaaccagtttgtccgttagcctggtgctcgtcggaattgtgacgctgtaccttggcgtaatggtgcaggccgattctggttgtgttgtctcatggaaaaataaggaactgaagtgcgggagtggaatcttcattacagacaacgtgcacacctggactgagcagtataaatttcaacccgaaagcccatccaagttggcttctgccatccagaaagcacaggaggaaggcatatgtggtattagatcggtgacaaggctcgagaatctgatgtggaagcagatcacccccgagttaaaccacattctggccgaaaatgaggtcaaactaactatcatgaccggcgatataaaggggatcatgcaagctggaaaacggagcctccgccctcagccaacagaactgaagtactcctggaagacgtggggcaaagccaagatgctttcaaccgagagtcataaccagactttcttgattgacgggccggaaacagcagagtgccccaataccaacagagcgtggaactctctggaggttgaagattatggatttggcgtgttcacaactaacatctggctcaaactgaaggagaaacaggacgctttttgtgacagcaagttaatgtccgccgcaattaaggataatagggccgtgcacgctgacatgggttactggatcgaatcagccctgaacgatacctggaaaatagagaaggccagcttcattgaggtcaagaattgccattggcctaagtctcacacgctttggtccaacggggtcttggaaagtgagatgatcatccccaagaatctcgctggacccgtgagccaacacaattatcgtcctggctaccatacacagattgccggtccatggcacctgggcaagctagaaatggacttcgatttttgtgacgggaccactgttgtggtcaccgaggattgcggaaaccggggcccctctctgcgaacaactaccgcgtccgggaagctcatcacagaatggtgctgtagatcatgcacgctgccgcctcttaggtaccgcggagaggacggctgttggtatggtatggagattcggccattgaaagaaaaggaggaaaatctggtgaacagtttagttaccgccgggcatggacaggtggataatttcagcctcggcgtactgggtatggctctttttctggaggaaatgttgagaactagggtcggcacaaaacacgcaatactcctggtggccctatcgttcgtgaccctgatcactgggaacatgtcctttaaggacctcggacgcgtcgttgtgatggtaggcgctacaatgaccgatgacattgggatgggagtgacgtacctggcccttttggcagcgttcaaagtccgacccacttttgccgctggcctgttactccggaagctgacctctaaggagcttatgatgacaaccatcggtattgtgctgctaagccaatcaaatatccctgagactatactcgaactgacagatgccttggcactggggatgatggttttaaaaatcgtgcgtgacatggagaagtatcagctcgctgtcaccattatggccatcctgtgcgtgcccaacgcagttattcttcagaatgcctggaaagtgagttgtacaatcctggctgtcgtatccgtgtctccattgctcctgactagctcccagcaaaagaccgactggatacctctagcgctgacgattaaaggacttaaccccacagccatcttcctcaccactctgtcaagaaccaataagaaaaggagctggccattgaacgaagcaatcatggctgttggcatggtgagtattctggcctcttccttactcaagaatgatataccgatgacaggccctctggtcgccgggggacttctgactgtgtgctacgtattgaccggtcgcagcgctgacctcgagctggaacgggcaacggatgtgaagtgggaggaccaggccgagatctcgggctcatctcccattctaagtatcacaatttccgaagatgggagcatgtctatcaaaaacgaggaagaggagcagaccctgactatacttatcagaacaggactcctggtcattagcggcttgtttccagtttccatccccattaccgcggctgcctggtatttatgggaagtgaagaaacagagggccggtgtgctgtgggacgtcccttcaccaccccctatggggaaggccgagctcgaagatggagcttaccgaatcaaacaaaagggcatactgggctatagtcagattggggcaggagtgtacaaggagggtactttccatacaatgtggcacgttacccgcggcgccgtacttatgcacaaagggaagcggatcgaaccgagctgggcggacgtgaaaaaggatctgatctcttacggaggcggttggaaattggagggggagtggaaggaaggagaggaagtccaggtgctagctctggagccaggcaagaatcccagagccgttcagacgaaacctggcctctttaagactaacaccgggacaattggagcagtgtccctggacttctcaccaggtaccagtggcagccccatcatagataaaaaggggaaagtcgtgggactttatggcaacggtgtagtcacaaggtccggggcctacgtgtctgctattgcccaaactgaaaagtcgatcgaggacaatcctgatattgaggacgacatctttcgtaagcgccggttaaccataatggatctgcatccgggagcaggcaaaacgaagagatatctccccgctattgttagggaagccatcaaacgaggcttgcggacactgatcctcgcgccaactcgcgtggtcgccgcagagatggaagaggctctgagagggcttcctattaggtaccagacccccgccatccgggctgaacacacaggacgagagattgtggacctgatgtgtcatgcaaccttcactatgagattgctaagcccagttcgcgtgcctaactataatctgataatcatggatgaggcccacttcaccgaccccgcctcaattgctgcgaggggttacatctccacacgtgtcgaaatgggcgaggcagccgggatctttatgacggctactccaccgggaagtcgggatcctttcccccagtctaacgccccaattatagacgaagagagagagatccccgaaaggagctggaactccggccatgagtgggtgaccgattttaagggtaaaacagtatggttcgtgccttcaattaaggcagggaacgacatcgccgcttgcctccgcaagaatggcaaaaaggttattcaattatctcgaaaaacctttgatagcgaatatatcaagactagaacaaacgactgggatttcgtcgtgaccacggacataagtgagatgggcgcgaattttaaagccgaacgggtgatcgacccaaggcgctgtatgaagcccgtcattctgactgatggcgaggagcgtgtaatccttgcagggcctatgccggtgacacactccagcgctgcccagagacggggaaggattggtcgcaaccccaaaaatgaaaacgaccagtacatctacatgggcgagcccctggaaaatgatgaggactgcgcacactggaaggaagccaagatgctcttggataacataaatacccctgaggggattatcccctctatgttcgagccagaacgagagaaagttgacgctattgatggagaatatagactgcggggcgaggccaggaagacctttgtggacctcatgcgcagaggtgatctgcctgtctggcttgcgtacaaagtggcagccgaagggatcaactatgctgacaggcggtggtgtttcgatggcataaagaacaatcagatcctagaggagaacgttgaagtggagatttggactaaagaaggagagcgtaagaagctgaaaccccgctggttggacgcccgaatctactcagatccattagctctgaaggagtttaaagagttcgcagccggcagaaagtccctcacactgaatcttattaccgagatggggaggctgcctacattcatgactcagaaaacgcgggacgctctcgacaacttggccgtcctgcataccgcagaagcgggaggtcgcgcctataatcacgctctaagtgagctgccggaaacactcgagactcttctgttattgaccctgctcgccacagtgaccggcgggatctttctgttccttatgagcggaagaggcataggtaagatgactctggggatgtgctgcattatcacggcatcgatcctcttgtggtacgctcagattcagccccattggatcgccgcatctataattctggagtttttcttaatcgtactactgattccagaacctgagaagcagaggaccccacaagataaccagctcacatatgtggttatcgccatacttactgtcgtggctgcgaccatggccaatgaaatgggctttctggagaaaacaaagaaagacttgggactgggctccatcgcaacccagcagccagaaagcaacattctcgatatcgacctgcggcctgcttcagcctggactctttacgccgtggcaacaacgttcattacccccatgctccgacacagtatcgaaaattcttccgtcaacgttagcctgactgctattgccaatcaagcgacagtgttgatggggctgggaaagggttggccgttatcaaaaatggatatcggcgtaccactactggctatagggtgttacagtcaggtgaaccctattaccctcaccgccgcacttctgttgctgatcgcccactatgctatcattggacccggcctccaggcaaaggccacaagagaggcgcagaagcgcgctgccgcaggtataatgaaaaatccaactgtcgacgggatcacggtgattgatctggaccccatcccttacgatccgaagtttgaaaaacaacttggccaggttatgttactggtgctctgcgtcacccaggtattgatgatgaggacaacttgggccctgtgtgaggctctaaccctggccacaggacccattagcaccctctgggaaggcaacccagggcggttctggaatactacgatcgcagtgtccatggctaacatatttcgtggatcttatcttgccggcgcgggtctgttgttcagcatcatgaagaatacaaccaacactagaagggggaccggaaacattggcgagacactgggtgaaaaatggaagtcccgcctcaatgccctgggcaaatcagagtttcaaatctacaagaagtctgggattcaggaggttgaccggactttagcaaaagaaggaatcaagcgaggcgagaccgatcatcacgctgtgagtagagggtcggccaaacttaggtggttcgtcgaacgcaacatggtgacacctgagggaaaggtcgtggacctgggctgcggtagagggggatggagctattactgtggcggtctcaaaaatgttcgggaggtgaagggcctaacgaaaggcgggcccgggcatgaggaacctataccaatgtccacctatgggtggaacctggtacgtttgcagtctggagtggatgtctttttcattccccctgaaaaatgcgacactctgctctgtgacatcggcgagtcaagcccaaatcccacagttgaagcaggtaggacccttcgggtgctgaacttggtcgagaattggctgaacaataacactcagttctgcatcaaggtgctcaatccgtacatgccttccgtaattgagaaaatggaaacattacaacgcaagtacgggggagctctggtgcgaaacccacttagtagaaattctacccacgagatgtattgggttagcaacgcctcaggcaatatagtgtccagtgtcaacatgatcagcaggatgctgattaaccggtttacgatgcgccataaaaaggccacctacgaacccgatgtggacctaggctctgggacaagaaatatcggaattgagtccgaaatccctaacctcgatataatcggtaagaggattgagaaaatcaagcaggagcacgaaacttcatggcactatgaccaggatcatccatacaaaacctgggcgtatcacggcagctacgagacaaagcagactgggtcggcttctagtatggtcaatggagtggttcgactgttgaccaaaccctgggacgtactgccgacagtgacccaaatggcaatgactgatacgacacctttcggccagcagcgggtctttaaggaaaaggtggacacccgtactcaggagcccaaagaaggtaccaagaaactcatgaagattacagccgagtggctttggaaagagctggggaagaaaaagacgccaagaatgtgtacccgcgaagagttcactaggaaggttcggtccaacgctgccttaggagcaatctttacagatgaaaataaatggaaaagcgccagagaggctgtggaggactcacgcttctgggaactggtcgataaagagaggaacttgcatctcgaaggcaagtgcgagacctgtgtgtataatatgatgggcaaacgagaaaagaagctgggggagtttggaaaagcgaagggttcccgggccatttggtacatgtggctaggcgcaagattccttgagtttgaagctctggggttcctcaacgaggaccactggttttctagggaaaatagcctgagtggagtagagggcgaaggtttgcacaaactggggtacatactccgcgacgtgtccaagaaagagggaggcgccatgtatgcagatgacactgccggctgggatacacgtatcacccttgaggacctgaagaacgaagagatggttacaaatcatatggaaggggagcacaagaaattagctgaagccattttcaagctgacttaccaaaacaaagtcgtgcgggtgcagagacctacccccaggggaacggtcatggatatcatcagccgccgagaccagcggggttctggccaagttgggacctatggattgaatacatttactaacatggaggcgcagctcattagacagatggagggcgaaggtgtgttcaagaatatacagcatctgaccgtaacagaggaaatcgcagtgcaaaactggctagccagggtcgggcgcgagagactttcacggatggctattagtggagatgactgcgtggttaaaccactggatgacaggttcgcctccgcactcactgctctgaacgatatgggcaagatccgtaaggacattcagcagtgggagcccagccgaggctggaatgattggacccaggtgcctttttgctctcaccatttccacgaattgatcatgaaagacgggcgcgtcttagtggtaccatgtagaaaccaagacgagctgataggacgggccaggatctcgcagggtgctggctggtcactccgcgaaacggcctgccttggaaagagctacgcacagatgtggtccctgatgtattttcacagacgggatctaaggctggcggccaatgctatttgtagtgccgttccgtctcattgggtgcccacaagccgaaccacttggtccatccacgcaaaacatgagtggatgacaaccgaagacatgctcactgtctggaaccgtgtgtggattcaggagaatccttggatggaggataagaccccagtggaatcatgggaggaaatcccctacttgggaaaaagagaggaccaatggtgcggcagtctgataggtcttacatctcgcgctacgtgggccaagaacattcaggcagccatcaatcaggtccggagcctgattgggtccgaagagtataccgattacatgccttcaatgaagaggttcagacgcgaggaagaggaagcgggagttctctggtga

SEQ ID NO: 14596 - RNA, 9876 nt, synthetic construct
  misc_feature 1..9876: note = derived and/or modified CDS sequence (opt3) from DENV-2__FJ639828__SS-prME
  source 1..9876: mol_type = other RNA
agcgtgggcatgatcattatgctgatacccaccgtcatggccttccacctcacaactagaaacggggagcctcatatgatcgtttccattcaggaaaagggaaaatctcttctgtttaagacggaggacggtgtgaatatgtgcaccttgatggctatggatttaggcgaactgtgtgaggacacaatcacttacaaatgcccactactcaggcaaaacgaaccggaggatattgactgttggtgcaattcaaccagtacatgggtaacctatgggacttgtacaaccacgggagagcaccggcgcgaaaagcgaagcgtggcactggtcccccatgtgggcatgggtcttgagactcgtaccgaaacatggatgtcctctgagggggcctggaaacacgcgcagagaatcgagacttggatactgaggcatcctggattcaccatcatggctgccattttggcatacacaatcggcaccacgcactttcagcggactctcattttcatcctgctgacagccgttgctccatcgatgaccatgcgctgcataggcatttcaaacagagattttgtggaaggggtcagcggaggtagttgggtggacatcgtactcgagcacggctcctgtgttactacaatggcaaagaataagcccaccttagatttcgaactgattaaaacggaggccaagcagcctgctacccttaggaaatattgcatcgaagccaagttgacaaacactaccacagagtctcggtgtccaactcaaggggagcccagcctgaaagaagagcaggacaagcgctttgtgtgcaagcattccatggtcgatcgaggatggggcaatggttgtgggctattcggaaaaggcggcatcgtgacctgcgcgatgtttacatgcaagaaaaacatggaagggaagattgtgcagcctgagaatctcgaatacaccatagtcgttactccacactcaggagaggagcatgcagtgggtaacgacacgggcaaacacgggaaggaaatcaaagtaacaccgcagagtagcattaccgaggccgaactgactggatatggcaccgtgacaatggagtgttctcccagaaccggtcttgatttcaatgaaatggtcctgttgcaaatggagaacaaggcttggctcgtgcacaggcagtggtttctggacttacctctgccatggctccccggggccgatactcagggctccaattggatccagaaggagacacttgttacgttcaaaaaccctcatgcaaagaaacaagacgtggtcgtgctgggatcacaggaaggcgctatgcacaccgccttgactggggcgacagagatacagatgagcagtggaaatctactgtttaccggtcatctcaagtgccggctgcgtatggacaaacttcaactgaagggcatgtcttactccatgtgtacagggaagttcaaagtagttaaggaaattgccgagactcagcacggaaccatcgtgatccgcgtccagtatgagggcgatggtagcccatgcaaaattcccttcgaaatcatggacttggagaagagatacgtgctcgggaggctgattacggtcaacccgatagcaaccgaaaaagattcgcctgtgaacatcgaggctgaacccccatttggcgactcttacattatcatcggagttgagcctggccagttaaagctgaattggttcaagaaagggtcctcaattggacaaatgtttgagacaactatgcggggtgccaagcgaatggctatactaggcgataccgcctgggacttcgggagtctcggaggcgtgtttacaagcatcggtaaagcactgcatcaggtattcggggccatttatggcgctgcgttttccggagtctcttggactatgaagatccttattggcgtgatcataacctggatcgggatgaacagccgctcaacgagtttgtccgttagcctggtgctcgtcggagtggtaacactgtaccttggcgtgatggttcaggcagattctggttgtgtcgtgtcatggaaaaataaggaactgaagtgcgggagtggaattttcatcaccgacaacgtgcacacttggacagagcagtataaatttcaacccgaaagcccatccaagttggcctctgctattcagaaagcccaggaggaaggcatctgtggtataagatcggtcaccaggctcgagaatctgatgtggaagcagattactcccgagttaaaccacatcctggcagaaaatgaggttaaactaaccattatgacaggcgatatcaaggggataatgcaagccggaaaacggagcctccgccctcagccaacggaactgaagtactcctggaagacctggggcaaagctaagatgctttcaactgagagtcataaccagacattcttgatcgacgggccggaaaccgccgagtgccccaatacaaacagagcatggaattctctggaggtggaagattatggatttggcgtgttcactaccaacatttggctcaaactgaaggagaaacaggacgcgttttgtgacagcaagttaatgtccgctgccatcaaggataatagggcagtacacgccgacatgggttactggattgaatcagctctgaacgatacgtggaaaatcgagaaggccagcttcatagaggtcaaaaattgccattggcctaagtctcacacactttggtccaacggggtgttggaaagtgagatgattatcccaaaaaacctcgcaggacccgttagccaacacaattatcgtcctggctaccatacccagatcgctggtccatggcacctgggcaagctagaaatggacttcgatttttgtgacgggactaccgtggtcgtgacagaggattgcggaaaccggggcccctctctgcgaactaccacagcctccgggaagctcattacggaatggtgctgtagatcatgcaccctgccgcctcttaggtaccgcggagaggacggctgttggtatggtatggagatccggccattgaaagaaaaggaggaaaatctggttaacagtttagtgactgcggggcatggacaggtagataatttcagcctcggcgtcctgggtatggccctttttctggaggaaatgttgagaacaagggtgggcaccaaacacgctattctcctggtggcagtctcgttcgttactctaataacagggaacatgtcctttaaggacctgggacgcgtggtagtgatggtcggcgccaccatgacggatgacatcgggatgggagtgacttacctcgctctgcttgccgcattcaaagttcgacccacctttgcggccggcttgttcctgcggaagttaacatctaaggagctcatgatgaccactattggtatcgtgctgcttagccaatcaacactgcctgagaccattctagaactcacagatgctctggccttggggatgatggtcctgaaaatggtgcgtgacatggagaagtatcagttagcagttactatcatggctatactctgcgtgcccaatgccgtcatcctgcagaacgcatggaaagtaagttgtaccattcttgccgtggtttccgtgtctccactgttgctcacgagctcccagcaaaagacagactggatccctctggctctaaccattaaaggactgaatcccactgcgatctttcttaccacactctcaagaactaacaagaaaaggagctggccactgaatgaagccataatggcagtcggcatggtgagtattttggcttcttccctgttaaagaacgatatcccgatgaccggccctctcgtagccgggggactgcttacggtgtgctacgtcctgacaggtcgcagcgccgacttggagctcgaacgggctaccgatgttaagtgggaggaccaggcagagatctcgggctcatctcccattctgagtataactatctccgaagatgggagcatgtctattaaaaatgaggaagaggagcagacactaaccatcctgattagaactggacttctcgtgatcagcggcctgttcccagtgtccatacccatcacagccgcggcttggtatttgtgggaagtcaagaaacagagggccggtgtgttatgggacgttccttcaccaccccctatggggaaggcagagctggaagatggagcctaccgaattaaacaacgcggcatcctcggctatagtcagattggggctggagtatacaaggagggtacctttcatacgatgtggcacgtgactcggggcgcagtcctgacccacaaggggaaaagaatcgaaccgagctgggccgacgtgaagaaagatcttatatcttacggaggcggttggaagctggagggggagtggaaagaaggagaggaagttcaggtgttggcgctagagccaggcaagaaccccagggctgtccagacaaagcctggcctgttcaaaaccaatacagggactattggagccgtgtccctcgacttttcaccaggtaccagtggcagccccatcatcgataagaaagggaaggtagtcggactgtatggcaacggtgtggttacgcgttccggggcatacgtgtctgccattgctcaaacagaaaaatcgatcgaggacaaccctgatatagaggacgacattttccgcaagcggagacttactatcatggatttacatccgggagccggcaagaccaaaaggtatctgcccgcaattgtccgagaagctatcaagcggggcctccgcacattgatactggccccaaccagagtggttgcggccgagatggaagaggcactcagggggctgcctattcggtaccagactcccgctatccgagccgaacacaccggaagagagatcgtggaccttatgtgtcatgctacattcacgatgcgcctgttgagcccagtcagggtgcctaattataacctaattatcatggatgaggcacactttactgaccccgcctcaattgccgctcgtggttacatatccacccgggtagaaatgggcgaggcggcagggatcttcatgacagccaccccaccgggaagtagagatccttttccccagtctaatgctccaattatcgacgaagagagggagatccccgaacgcagctggaactccggccatgagtgggtgactgatttcaaaggtaagacagtttggtttgtcccttcaattaaagccgggaatgacatagcagcctgcctgcgaaagaacggaaagaaagtgatccaactctctagaaagaccttcgatagcgaatatgtgaaaacgcggactaatgactgggattttgtcgtaacaaccgacattagtgagatgggcgctaacttcaaggcggaaagggtgatcgacccacgccgttgtatgaaacccgttattttaaccgatggcgaggagagagtgatcctggccgggcctatgccggtcactcactccagcgcagctcagcggaggggacgcataggtcgaaatccaaagaacgaaaatgaccagtacatctacatgggcgagccccttgaaaacgatgaggactgcgcccactggaaagaagcaaagatgctgctcgataatattaacacacctgaggggatcattccctctatgtttgagccagaaagagagaaggtggacgccatcgatggagaatatcggttgaggggcgaggctcgcaaaaccttcgttgacctgatgagaaggggtgatctccctgtgtggctggcctacaaggtcgcggcagaagggataaattatgccgaccggcgttggtgttttgatggcattaaaaacaaccagatccttgaggagaatgtggaagtagagatttggacaaaggaaggagagcgcaaaaagctaaagccccgatggctggacgctagaatctactcagatccattggccttaaaagagttcaaggaattcgctgcaggcaggaaatccctgactctcaacctgataacggagatggggcggcttcctacctttatgacacaaaagactcgcgacgccctggacaatctcgctgtgttgcataccgccgaagcaggaggtagagcgtataaccacgccctgagtgagctaccggaaacactggagaccctccttctgttaactttgctggctacggttaccggcgggatcttcctctttctgatgagcggaaggggcattggtaaaatgacacttgggatgtgctgcatcgtcactgcctcgattctgctctggtacgcacagatccagccccattggatagctgcctctattatcttggagttctttctgatcgtgttactaattccagaacctgagaagcagcggaccccccaagataatcagctgacatatgtggtcatcgcaatactcaccgttgtggccgctactatggcgaacgaaatgggcttccttgagaagacaaaaaaggacctgggattgggctccattgccacgcagcagccagaaagcaatatcctggatattgacctccgacctgcatcagcttggaccctgtacgccgtagccactacatttgtgacccccatgcttagacacagtatcgagaactcttccgtcaatgtgagcctcaccgcaatagctaaccaagccacagttctgatggggttgggaaaaggttggccgctgtcaaagatggatatcggcgcgccattactagctattgggtgttacagtcaggtgaatcctatcactctgacggccgcactccttctgttggtcgcccactatgctattatcggacccggcctgcaggcaaaagccacccgcgaggcgcagaagagggctgccgcaggtattatgaagaacccaacagtagacgggatcactgtgatagatctcgaccccattccttacgatccgaaattcgaaaagcaactgggccaggttatgcttttagtgctgtgcgtcacccaggtgctcatgatgcggacaacctgggccttgtgtgaggctctgactctagccacgggacccatcagcacactgtgggaaggcaatccagggcgtttttggaacaccactatcgcagtctccatggctaatattttcagaggatcttatctcgccggcgcgggtcttctgtttagcataatgaaaaacaccacaaattccaggcgcgggactggaaacatcggcgagaccttgggtgaaaagtggaaatcacggctgaacgccctcggcaagtctgagttccaaatttacaaaaagagtgggatccaggaggtggaccgaacactggcaaaggaaggaattaaaagaggcgagacggatcatcacgctgtttcgagggggagcgccaagttacgctggtttgtggaacggaatatggtaacccctgagggaaaagtggtcgaccttggctgcggtagagggggatggtcctattactgtggcggtctgaagaacgttcgtgaggtgaaaggcctcactaaggggggacccggccatgaagagcctatcccaatgtctacatatgggtggaatctagtcaggctgcagtcaggagtggatgtattcttcataccccctgaaaagtgcgacaccttgctgtgtgacatcggcgagagctccccaaaccccactgtggaagcaggtcggacactccgcgttcttaatctggtggagaactggttgaataacaatacccagttttgcattaaagtcctgaacccgtacatgcctagtgtgatcgagaagatggaaacgctccaacgaaaatacgggggagctttagtcagaaatccactgtctaggaacagcacccacgagatgtattgggtgtcaaatgcctccggcaacattgttagtagcgtaaatatgatctctcggatgcttataaaccgcttcacaatgagacataagaaagccacttacgaacccgatgtggacctgggctccgggaccaggaacattggaatcgagtcagaaatccctaatctagatattataggtaagcgaatcgagaagattaaacaggagcacgaaacaagctggcactatgaccaggatcatccatacaagacttgggcgtatcacggctcgtacgagaccaaacagacagggtctgctagttccatggtcaacggagtggttcggctcctgaccaagccctgggacgtgttgccgactgtcacgcaaatggcaatgacagataccactccttttggccagcagcgtgtgttcaaagaaaaggtagacaccagaacacaggagcccaaggaaggtacgaaaaagctgatgaaaatcaccgccgagtggctctggaaggagcttgggaaaaagaaaactccacgcatgtgtacaagggaagagtttacccggaaggtgagaagcaatgctgccctgggagcaattttcactgatgaaaacaagtggaaatcagcccgcgaggctgttgaggactccaggttttgggaattagtcgataaggagcgaaatctgcatttggaaggcaaatgcgagacatgtgtgtataacatgatgggcaagcgggaaaaaaagctcggggagttcggaaaggcgaaaggttctagagccatctggtacatgtggctgggcgcaaggtttctagagttcgaagctcttgggtttctgaatgaggaccactggttcagccgcgaaaacagtctctccggagtggagggcgaaggtctgcaccgtttggggtacatactgcgggacgtcagcaagaaagagggaggcgccatgtatgcagatgacaccgccggctgggatacaagaatcactctcgaggaccttaagaatgaagagatggttaccaaccatatggaaggggagcacaaaaagctggctgaagccatttttaagttaacgtaccaaaataaagtggtaagggtgcagcgccctaccccccgaggaacagtcatggatatcatttctcggagagaccagaggggttcaggccaagtggggacttatggactgaacaccttcacaaatatggaggcgcagttgatccgccagatggagggcgaaggtgttttcaagaacattcagcatctcactgtgaccgaggaaatagcagtccaaaattggctggccagagtggggcgggagaggctaagtcgtatggctatctccggagatgactgcgtagttaaaccacttgatgaccgatttgccagcgcactgacggctctcaacgatatgggcaagattcgcaaagacatccagcagtgggagccctctagaggctggaacgattggacacaggtgcctttctgctcgcaccattttcacgaactgatcatgaaggacgggcgggtcttggtggtgccatgtaggaatcaagacgagttaattggacgcgccagaatatcacagggtgctggctggagcctgcgggaaaccgcctgcctcgggaagtcctacgcacagatgtggagtcttatgtatttccacaggcgagatctgcgtctagcggccaacgctatctgttctgccgtcccgagccattgggttcccacttccagaacaacctggtcaattcacgcaaaacatgagtggatgactaccgaagacatgctgacagtgtggaatcgcgtatggatccaggagaacccttggatggaggataagacgccagtggaaagttgggaggaaattccctacctcggaaaacgggaggaccaatggtgcggctctttgatcggtctgaccagcagggctacttgggccaagaatatacaggcagccatcaaccaggtcagatcccttattgggaatgaagagtatacagattacatgccttcaatgaaacgctttcggagggaggaagaggaagcgggagtgctgtggtga

SEQ ID NO: 14597 - RNA, 9876 nt, synthetic construct
  misc_feature 1..9876: note = derived and/or modified CDS sequence (opt3) from DENV-2__FJ639829__SS-prME
  source 1..9876: mol_type = other RNA
agcgtgggcatgatcattatgctgatccccaccgtcatggccttccacctcaccactagaaacggggagcctcatatgatcgtttccattcaggaaaagggaaagtctcttctgtttaagacggaggacggtgtgaatatgtgcaccttgatggctatggatttaggcgaactgtgtgaggacacaatcacttacaaatgcccactactcaggcaaaacgaaccggaggatattgactgttggtgcaattcaaccagtacatgggtaacctatgggacttgtacaaccacgggagagcaccggcgcgaaaagcgaagcgtggcactggtcccccatgtgggcatgggtcttgagactcgtaccgaaacatggatgtcctctgagggggcctggaaacacgcgcagagaatcgagacttggatactgaggcatcctggattcaccatcatggctgccattttggcatacacaatcggcaccacgcactttcagcggactctcattttcatcctgctgacagccgttgctccatcgatgaccatgcgctgcataggcatttcaaacagagattttgtggaaggggtcagcggaggtagttgggtggacatcgtactcgagcacggctcctgtgttactacaatggcaaagaataagcccaccttagatttcgaactgattaaaacggaggccaagcagcctgctacccttaggaaatattgcatcgaagccaagttgacaaacactaccacagagtctcggtgtccaactcaaggggagcccagcctgaaagaagaacaggacaagcgctttgtgtgcaagcattccatggtcgatcgaggatggggcaatggttgtgggctattcggaaaaggcggcatcgtgacctgcgcgatgtttacatgcaagaaaaacatggaagggaagattgtgcagcctgagaatctcgaatacaccatagtcgttactccacactcaggagaggagcatgcagtgggtaacgacacgggcaaacacgggaaggaaatcaaagtaacaccgcagagtagcattaccgaggccgaactgactggatatggcaccgtgacaatggagtgttctcccagaaccggtcttgatttcaatgaaatggtcctgttgcaaatggagaacaaggcttggctcgtgcacaggcagtggtttctggacttacctctgccatggctccccggggccgatactcagggctccaattggatccagaaggagacacttgttacgttcaaaaaccctcatgcaaagaaacaagacgtggtcgtgctgggatcacaggaaggcgctatgcacaccgccttgactggggcgacagagatacagatgagcagtggaaatctactgtttaccggtcatctcaagtgccggctgcgtatggacaaacttcaactgaagggcatgtcttactccatgtgtacagggaagttcaaagtagttaaggaaattgccgagactcagcacggaaccatcgtgatccgcgtccagtatgagggcgatggtagcccatgcaaaattcccttcgaaatcatggacttggagaagagatacgtgctcgggaggctgattacggtcaacccgatagtgaccgaaaaagattcgcctgttaacatcgaggcagaacccccatttggcgactcttacattatcatcggagtggagcctggccagttaaagctgaattggttcaagaaagggtcctcaattggacaaatgtttgagacaactatgcggggtgctaagcgaatggccatactaggcgataccgcttgggacttcgggagtctcggaggcgtatttacaagcatcggtaaagccctgcatcaggtcttcggggcaatttatggcgccgctttttccggagtgtcttggactatgaagatccttattggcgttatcataacctggatcgggatgaacagccgctcaacgagtttgtccgtgagcctggtcctcgtgggagtagtgacactgtaccttggcgttatggtccaggcggattctggttgtgtggtgtcatggaaaaataaggaactgaagtgcgggagtggaattttcatcaccgacaacgtccacacttggacagagcagtataaatttcaacccgaaagcccatccaagttggcatctgccattcagaaagctcaggaggaaggcatctgtggtataagatcggttaccaggctcgagaatctgatgtggaagcagattactcccgagttaaaccacatcctggccgaaaatgaggtgaaactaaccattatgacaggcgatatcaaggggataatgcaagcaggaaaacggagcctccgccctcagccaacggaactgaagtactcctggaagacctggggcaaagccaagatgctttcaactgagagtcataaccagacattcttgatcgacgggccggaaaccgctgagtgccccaatacaaacagagcctggaactctctggaggtggaagattatggatttggcgtattcactaccaacatttggctcaaactgaaggagaaacaggacgcattttgtgacagcaagttaatgtccgcggctatcaaggataatagggccgtccacgcagacatgggttactggattgaatcagccctgaacgatacgtggaaaatcgagaaggctagcttcatagaggtgaaaaattgccattggcctaagtctcacacactttggtccaacggggttttggaaagtgagatgattatccccaagaatctcgccggacccgtgagccaacacaattatcgtcctggctaccatacccagatcgcaggtccatggcacctgggcaagctagaaatggacttcgatttttgtgacgggactaccgtcgtggttacagaggattgcggaaaccggggcccctctctgcgaactaccacagcttccgggaagctcattacggaatggtgctgtagatcatgcaccctgccgcctcttaggtaccgcggagaggacggctgttggtatggtatggagatccggccattgaaagaaaaggaggaaaatctggtgaacagtttagtaactgccgggcatggacaggtcgataatttcagcctcggcgtgctgggtatggcgctttttctggaggaaatgttgagaacaagggtgggcaccaaacacgccattctcctggtcgctgtttcgttcgtgactctaataacagggaacatgtcctttaaggacctgggacgcgtagtggtcatggtgggcgcaaccatgacggatgacatcgggatgggagttacttacctcgccctgcttgctgccttcaaagtgcgacccacctttgcagcgggcttgttcctgcggaagttaacatctaaggagctcatgatgaccactattggtatcgtcctgcttagccaatcaacaattcctgagaccatcctggaactaacagatgccctcgctctggggatgatggtgttgaaaatggttcgtgacatggagaagtatcagctggccgtgactataatggcaatcttatgcgtccccaatgctgtaattctccagaacgcctggaaagtgagttgtaccatcctggcagttgtgtccgtctctccacttctgttgacgagctcccagcaaaagacagactggattcctctcgccctgaccatcaaaggactaaatcccactgctatatttctgaccacactttcaagaactaacaagaaaaggagctggccactcaatgaagcgattatggccgtgggcatggtaagtatcctggcatcttccttgctgaagaacgatatcccgatgaccggccctttagtggctgggggactcctgacggtctgctacgttcttacaggtcgcagcgccgacctggagttggaacgggccaccgatgtgaagtgggaggaccaggctgagatttcgggctcatctcccatactcagtatcactatttccgaagatgggagcatgtctatcaaaaatgaggaagaggagcagacactgaccattctaatcagaactggactgcttgtgataagcggcctcttcccagtctccatccccattacagcagccgcgtggtatctgtgggaagtgaagaaacagagggctggtgttttgtgggacgtaccttcaccaccccctatggggaaggccgagttagaagatggagcataccgaatcaaacaacgcggcattctgggctatagtcagatcggggccggagtgtacaaggagggtacctttcatacgatgtggcacgtcactcggggcgctgtgctcacccacaaggggaaaagaatagaaccgagctgggcagacgttaagaaagatctgatttcttacggaggcggttggaaacttgagggggagtggaaagaaggagaggaagtgcaggtcctggccttggagccaggcaagaaccccagggcggtgcagacaaagcctggcctattcaaaaccaatacagggactatcggagctgtatccctggacttttcaccaggtaccagtggcagccccatcattgataagaaagggaaggtcgtgggactctatggcaacggtgttgtgacgcgttccggggcctacgtctctgcaatcgcccaaacagaaaaatcgatagaggacaaccctgatattgaggacgacatcttccgcaagcggagactgactattatggatcttcatccgggagctggcaagaccaaaaggtatttacccgccatcgtgcgagaagcaataaagcggggcctgcgcacactcattttggctccaaccagagttgtggccgcggagatggaagaggccctgagggggctccctatccggtaccagactcccgcaatccgagctgaacacaccggaagagagattgtcgacctgatgtgtcatgccacattcacgatgcgccttctgagcccagtgagggtacctaattataacttgatcattatggatgaggctcactttactgaccccgcatcaatagccgcccgtggttacatctccacccgggtggaaatgggcgaggctgcggggattttcatgacagcaaccccaccgggaagtagagatccttttccccagtctaatgccccaatcatcgacgaagagagggagattcccgaacgcagctggaactccggccatgagtgggttactgatttcaaaggtaagacagtctggtttgtgccttcaataaaagctgggaatgacatcgccgcatgcctacgaaagaacggaaagaaagtgattcaactgtctagaaagaccttcgatagcgaatatgtcaaaacgcggactaatgactgggattttgtagtgacaaccgacatcagtgagatgggcgccaacttcaaggctgaaagggttattgacccacgccgttgtatgaaacccgtgatcctcaccgatggcgaggagagagtcatattagcggggcctatgccggtgactcactccagcgccgcacagcggaggggacgcatcggtcgaaatccaaagaacgaaaatgaccagtacatttacatgggcgagcccctggaaaacgatgaggactgcgctcactggaaagaagccaagatgcttctggataatatcaacacacctgaggggattatcccctctatgtttgagccagaaagagagaaggttgacgcaatagatggagaatatcggctcaggggcgaggcccgcaaaaccttcgtggacttgatgagaaggggtgatctgcctgtctggctcgcttacaaggtggccgcggaagggattaattatgcagaccggcgttggtgttttgatggcatcaaaaacaaccagattctggaggagaatgtagaagtggagatctggacaaaggaaggagagcgcaagaaacttaaaccccgatggctagacgccagaatatactcagatccactggctttgaaagagttcaaggagttcgccgctggcaggaaatccttaactctgaacctcatcacggagatggggcggctgcctacctttatgacacaaaagactcgcgacgcacttgacaatctggccgttctccataccgctgaagccggaggtagagcatataaccacgcgttgagtgagctgccggaaacactagagaccctgctccttctgactttattggccacggtcaccggcgggattttcctgtttctcatgagcggaaggggcatcggtaaaatgacactggggatgtgctgcattgtgactgcttcgatccttctgtggtacgcccagatacagccccattggattgcagcttctatcatcctcgagttctttttgattgtgctgttaatcccagaacctgagaagcagcggacaccacaagataatcagctaacatatgtcgttatagccattctgaccgtggtagcagccactatggctaacgaaatgggcttcctcgagaagaccaagaaggaccttggactgggctccatcgcgacgcagcagccagaaagcaatattttggatatcgacctgcgacctgcctcagcatggaccctctacgctgtggccactacatttgtcacccccatgctgagacacagtatagagaactcttccgtgaatgttagccttaccgccatcgcaaaccaagctacagtgctcatggggctgggaaaaggttggccgttgtcaaagatggatattggcgccccactgttagcgatcgggtgttacagtcaggtcaatcctattactctaacggctgccctgctccttctggtagcacactatgccatcattggacccggcttgcaggctaaagcaacccgcgaggcccagaagagggcggctgccggtatcatgaagaacccaacagtggacgggataactgttattgatctggaccccatcccttacgatccgaaattcgaaaagcaactcggccaggtgatgctgcttgtcttatgcgtgacccaggtcctgatgatgcggacaacctgggcactctgtgaggccttgactctggctacgggacccatcagcacactatgggaaggcaatccagggcgtttttggaacaccactattgccgtgtccatggcaaatatattcagaggatcttatctggctggcgccggtctcctttttagcatcatgaaaaacaccacaaattccaggcgcgggactggaaacattggcgagaccctgggtgaaaagtggaaatcacggttgaacgcgctgggcaagtctgagttccaaatctacaaaaagagtgggattcaggaggttgaccgaacactcgccaaggaaggaatcaaaagaggcgagacggatcatcacgcagtgtcgagggggagcgctaagctgcgctggtttgtagaacggaatatggtgacccctgagggaaaagtcgttgacttaggctgcggtagagggggatggtcctattactgtggcggtcttaagaacgtgcgtgaggtcaaaggcctgactaaagggggacccggccatgaagaacctataccaatgtctacatatgggtggaatctcgtgaggctacagtcaggagtagatgtgttcttcataccccctgaaaagtgcgacaccctgttgtgtgacattggcgagagctccccaaaccccactgttgaagccggtcggacactgcgcgtgctcaatcttgtcgagaactggctgaataacaatacccagttttgcatcaaagtgttgaacccgtacatgcctagtgtcattgagaagatggaaacgctgcaacgaaaatacgggggagcactcgtgagaaatccattatctaggaacagcacccacgagatgtattgggtttcaaatgcttccggcaacatcgtaagtagcgtgaatatgatatctcggatgctgattaaccgcttcacaatgagacataagaaagccacttacgaacccgatgtcgaccttggctccgggaccaggaacatcggaatcgagtcagaaattcctaatctggatataatcggtaagcgaattgagaagatcaaacaggagcacgaaacaagctggcactatgaccaggatcatccatacaagacttgggcctatcacggctcgtacgagaccaaacagacagggtctgcgagttccatggtgaacggagttgtgcggctactcaccaagccctgggacgtcctgccgactgtgacgcaaatggctatgacagataccactccttttggccagcagcgtgtattcaaagaaaaggtggacaccagaacacaggagcccaaggaaggtacgaaaaagttgatgaaaattaccgcagagtggctgtggaaggagctcgggaaaaagaaaactccacgcatgtgtacaagggaagagtttacccggaaggttagaagcaatgccgctcttggagccatcttcactgatgaaaacaagtggaaatcagcacgcgaggccgtcgaggactccaggttttgggaactggtggataaggagcgaaatttacatctggaaggcaaatgcgagacatgtgtgtataacatgatgggcaagcgggagaagaagttgggggagttcggaaaggctaaaggttctagagcgatatggtacatgtggctcggcgccaggtttctggagttcgaagcactagggtttcttaatgaggaccactggttcagccgcgaaaacagtctgtccggagtcgagggcgaaggtctccaccgtctggggtacatcttgcgggacgttagcaagaaagagggaggcgctatgtatgccgatgacaccgcaggctgggatacaagaattactctggaggacctcaagaatgaagagatggtgaccaaccatatggaaggggagcacaagaaacttgccgaagctatctttaaactgacgtaccaaaataaagtagtgagggtccagcgccctacaccccgaggaacagtgatggatattatctctcggagagaccagaggggttcaggccaagttgggacttatggattaaacaccttcacaaatatggaggcccagctgattcgccagatggagggcgaaggtgtgttcaagaacatacagcatttgactgtcaccgaggaaatcgcggtgcaaaattggctcgcaagagtagggcgggagaggctgagtcgtatggccatttccggagatgactgcgttgtgaaaccactagatgaccgatttgctagcgcccttacggcactgaacgatatgggcaagatccgcaaagacatccagcagtgggagccctctagaggctggaacgattggacacaggtccctttctgctcgcaccattttcacgaactcattatgaaggacgggcgggtgctggtggtcccatgtaggaatcaagacgagttgataggacgcgctagaatctcacagggtgccggctggagcttacgggaaaccgcttgcctggggaagtcctacgcccagatgtggagtctcatgtatttccacaggcgagatcttcgtctggcagcgaacgccatttgttctgctgttccgagccattgggtgcccacttccagaacaacctggtcaatccacgccaaacatgagtggatgactaccgaagacatgctaacagtatggaatcgcgtgtggattcaggagaacccttggatggaggataagacgccagtcgaaagttgggaggaaatcccctacctgggaaaacgggaggaccaatggtgcggctctctcataggtttgaccagcagggcaacttgggctaagaatatccaggtggccattaaccaggttagatccctgatcgggaatgaagagtatacagattacatgccttcaatgaaacgctttcggagggaggaagaggaagcaggagtgctttggtga

SEQ ID NO: 14598 - RNA, 9876 nt, synthetic construct
  misc_feature 1..9876: note = derived and/or modified CDS sequence (opt3) from DENV-2__FJ639831__SS-prME
  source 1..9876: mol_type = other RNA
agcgcaggaatgataattatgctgataccaaccgtgatggctttccacctcacaactagaaacggggagcctcatatgatcgtctccattcaggaaaagggaaaatctcttctgtttaagacggaggacggtgttaatatgtgcaccttgatggcaatggatttaggcgaactgtgtgaggacacaatcacttacaaatgcccactactcaggcaaaacgaaccggaggatattgactgttggtgcaattcaaccagtacatgggtgacctatgggacttgtacaaccacgggagagcaccggcgcgaaaagcgaagcgtagccctggtgccacatgtcggcatgggtcttgagactcgtaccgaaacatggatgtcctctgagggggcgtggaaacacgctcagagaatcgagacttggatactgaggcatcctggattcaccatcatggccgcaattttggcctacacaatcggcaccacgcactttcagcgggctctcattttcatcctgctgactgcagtggccccatcgatgacaatgcgctgcataggcatttcaaacagagattttgttgaaggggtgagcggaggtagttgggtcgacatcgtgctcgagcacggctcctgtgtaaccactatggctaagaataagcccacattagatttcgaactgattaaaaccgaggccaagcagcctgcgacgcttaggaaatattgcatcgaagcaaagttgaccaacacaactaccgagtctcggtgtccaacacaaggggagcccagcctgaaagaagaacaagacaagcgctttgtttgcaagcattccatcgtggatcgaggatggggcaatggttgtgggctattcggaaaaggcggcattgtcacttgcgccatgtttacctgcaagaaaaacatggaagggaagatagtgcagcctgagaatctcgaatacacaatcgtggtcaccccacactcaggagaggagcatgctgttggtaacgacactggcaaacacgggaaggaaattaaagtgacgccgcagagtagcgtaacagaggccgaactgaccggatatggcactgtgaccatggagtgttctcccagaacaggtcttgatttcaatgaaatggtcctgttgcaaatggagaacaaggcatggctcgtgcacaggcagtggtttctggacttacctctgccatggctccccggggctgatacccagggctccaattggatccagaaggagactcttgttacattcaaaaaccctcatgccaagaaacaagacgtggtcgtgctgggatcacaggaaggcgcgatgcacacggccttgaccggggcaactgagatacagatgagcagtggaaatctactgtttacaggtcatctcaagtgccggctgcgtatggacaaacttcaactgaagggcatgtcttactccatgtgtaccgggaagttcaaagtagttaaggaaattgctgagacacagcacggaactatcgtgatccgcgtccagtatgagggcgatggtagcccatgcaaaattcccttcgaaatcatggacttggagaagagatacgtgctcgggaggctgattaccgtcaacccgatagtgacggaaaaagattcgcctgttaacatcgaggccgaacccccatttggcgactcttacattatcatcggagtggagcctggccagttaaagctgaattggttcaagaaagggtcctcaattggacaaatgtttgagaccacaatgcggggtgctaagcgaatggccatactaggcgatactgcatgggacttcgggagtctcggaggcgtatttaccagcatcggtaaagccctgcatcaggtcttcggggctatttatggcgcggcattttccggagtgtcttggacaatgaagatccttattggcgttatcataacttggatcgggatgaacagccgctcaaccagtttgtccgtgagcctggtcctcgtgggaattgtaacgctgtaccttggcgtgatggttcaggccgattctggttgtgtcgtgtcatggaaaaataaggaactgaagtgcgggagtggaatcttcattacagacaacgtgcacacctggactgagcagtataaatttcaacccgaaagcccatccaagttggcttctgccatccagaaagcacaggaggaaggcatatgtggtattagatcggtcacaaggctcgagaatctgatgtggaagcagatcacccccgagttaaaccacattctggccgaaaatgaggttaaactaactatcatgaccggcgatataaaggggatcatgcaagctggaaaacggagcctccgccctcagccaacagaactgaagtactcctggaagacgtggggcaaagccaagatgctttcaaccgagagtcataaccagactttcttgattgacgggccggaaacagcagagtgccccaataccaacagagcgtggaactctctggaggtggaagattatggatttggcgtgttcacaactaacatctggctcaaactgaaggagaaacaggacgctttttgtgacagcaagttaatgtccgccgcaattaaggataatagggccgtacacgctgacatgggttactggatcgaatcagccctgaacgatacctggaaaatagagaaggccagcttcattgaggtcaaaaattgccattggcctaagtctcacacgctttggtccaacggggtgttggaaagtgagatgatcatccccaagaatctcgctggacccgttagccaacacaattatcgtcctggctaccatacacagattgccggtccatggcacctgggcaagctagaaatggacttcgatttttgtgacgggaccactgtggtcgtgaccgaggattgcggaaaccggggcccctctctgcgaacaactaccgcgtccgggaagctcatcacagaatggtgctgtagatcatgcacgctgccgcctcttaggtaccgcggagaggacggctgttggtatggtatggagattcggccattgaaagaaaaggaggaaaatctggttaacagtttagtgaccgccgggcatggacagatagataatttcagcctcggcgtactgggtatggctctttttctggaggaaatgttgagaactagggtcggcacaaaacacgcaatcctcctggtggccgtgtcgttcgtcaccctaattactgggaacatgtcctttaaggacctgggacgcgttgtggtaatggtgggcgctacaatgaccgatgacatcgggatgggagtcacgtacctcgccctgcttgcagcgttcaaagtgcgacccacttttgttgccggcttgctgttacggaagctcacctctaaggagctgatgatgacaaccattggtatcgtgcttctgagccaatcaactatacctgagacaatcctagaactcaccgatgctctggccttggggatgatggtcctgaaaattgtgcgtgacatggagaagtatcagttagcagttacaatcatggctattctctgcgtgcccaatgccgtcatcctgcagaacgcatggaaagtaagttgtactatacttgccgtggtttccgtgtctccactgttgctcaccagctcccagcaaaagacggactggattcctctggctctaacaatcaaaggactgaatcccaccgcgatcttccttactaccctctcaagaacaaacaagaaaaggagctggccactgaatgaagccattatggcagtcggcatggtgagtatattggcttcttccctgttaaagaacgatatcccgatgactggccctctcgtagccgggggactgcttaccgtgtgctacgtcctgacgggtcgcagcgccgacttggagctcgaacgggctacagatgttaagtgggaggaccaggcagagatttcgggctcatctcccatcctgagtattaccatctccgaagatgggagcatgtctatcaagaatgaggaagaggagcagactctaacaatcctgattagaaccggacttctcgtgatcagcggcctgtttccagtgtccattcccatcactgccgcggcttggtatttgtgggaagtcaagaaacagagggccggtgtgttatgggacgttccttcaccaccccctatggggaaggcagagctggaagatggagcctaccgaataaaacaaaagggcgtactcggctatagtcagattggggctggagtgtacaaggagggtacattccataccatgtggcacgtcacgcgcggcgcagtgctgatgcacaaagggaagcggatcgaaccgagctgggccgacgttaaaaaggatcttatctcttacggaggcggttggaaactggagggggagtggaaggaaggagaggaagtgcaggtcttggcgctagagccaggcaagaaccccagagctgtgcagactaaacctggcctgtttaagaccaatacagggaccattggagccgtatccctcgacttctcaccaggtacaagtggcagccccatcatagataaaaaggggaaagtcgtgggactgtatggcaacggtgttgtgactaggtccggggcatacgtctctgccattgctcaaaccgaaaagtcgatcgaggacaaccctgatattgaggacgacatctttcgtaagcgccggcttacgataatggatttacatccgggagccggcaaaacaaagagatatctgcccgcaattgtgagggaagctatcaaacgaggcctccggactttgatcctggccccaacccgcgttgtggcggccgagatggaagaggcactcagagggctgcctattaggtaccagacacccgctatccgggccgaacacaccggacgagagattgtcgaccttatgtgtcatgctactttcaccatgagactgttgagcccagtgcgcgtacctaattataacctaataatcatggatgaggcacacttcacagaccccgcctcaattgccgctaggggttacatctccacgcgtgtggaaatgggcgaggcggcagggatctttatgactgccaccccaccgggaagtcgggatcctttcccccagtctaatgctccaattatagacgaagagagagagatccccgaaaggagctggaactccggccatgagtgggttacagattttaagggtaaaaccgtctggttcgtgccttcaattaaggccgggaatgacatcgcagcctgcctgcgcaagaacggcaagaaggtgattcaactctctcgaaaaacttttgatagcgaatatgtcaagacaagaaccaatgactgggatttcgtagtgacgactgacatcagtgagatgggcgctaactttaaagcggaacgggttatagacccaaggcgctgtatgaagcccgtgatcttaacagatggcgaggagcgtgtcattctggccgggcctatgccggtgacccactccagcgcagctcagagacggggaaggatcggtcgcaatcccaaaaacgaaaatgaccagtacatttacatgggcgagccccttgaaaacgatgaggactgcgcccactggaaggaagcaaagatgctgctcgataatatcaacacccctgaggggataattccctctatgttcgagccagaacgagagaaagttgacgccatcgatggagaatatagattgcggggcgaggctaggaagacttttgtggacctgatgcgcagaggtgatctccctgtctggctggcctacaaagtggcggcagaagggattaattatgccgacaggcggtggtgtttcgatggcatcaagaacaaccagatacttgaggagaatgtagaagtggagatctggacaaaagaaggagagcgtaagaagctaaaaccccgctggctggacgctcgaatttactcagatccattggccttaaaggagtttaaagagttcgctgcaggcagaaagtccctgaccctcaacctgatcacagagatggggaggcttcctactttcatgacgcagaaaacccgggacgccctggacaatctcgctgttttgcatacagccgaagcaggaggtcgcgcgtataaccacgccctgagtgagctaccggaaactctggagaccctccttctgttaacattgctggctaccgtcactggcgggatttttctcttcctgatgagcggaagaggcatcggtaagatgacgcttgggatgtgctgcataattaccgcctcgatcctgctctggtacgcacagatccagccccattggattgctgcctctatcatattggagtttttcctgattgtgttactaatcccagaacctgagaagcagaggacaccccaagataatcagctgacttatgtggtcattgcaatcctcaccgttgtggccgctacaatggcgaacgaaatgggctttcttgagaaaaccaagaaagacctgggattgggctccataactacacagcagccagaaagcaatatcctggatattgacctccggcctgcctcagcatggacgctgtacgctgtagccaccactttcgtgacacccatgcttcgacacagtatcgagaactcttccgtcaatgtgagcctcaccgccattgcaaaccaagctaccgttctgatggggttgggaaagggttggccgctgtcaaaaatggatatcggcgtgccattactagccattgggtgttacagtcaggtcaatcctatcacactgactgcggctctccttctgttggtagcccactatgcaataattggacccggcctgcaggccaaggctacgagagaggcacagaagcgcgccgcggctggtatcatgaaaaacccaaccgtggacgggatcacagttattgatctcgaccccataccttacgatccgaagtttgaaaaacaactgggccaggtgatgcttttagtcctgtgcgtgactcaggtcctcatgatgaggaccacatgggccatgtgtgaggcattgaccctggccactggacccatcagcacgctatgggaaggcaatccagggcggttctggaacacaaccattgctgtgtccatggccaatatctttcgtggatcttatctggcaggcgctggtctccttttcagcattatgaagaacactaccaatacaagaagggggactggaaacatcggcgagaccctgggtgaaaaatggaagtcccgcttgaacgccctgggcaaatcagagtttcaaatatacaagaagtctgggatccaggaggttgaccggacactcgcgaaagaaggaattaagcgaggcgagacggatcatcacgccgtgagtagagggtcggcaaaactgaggtggttcgtagaacgcaatatggtgacccctgagggaaaggtcgttgacttaggctgcggtagagggggatggagctattactgtggcggtcttaaaaacgtgcgggaggtcaagggcctgactaaagggggacccggccatgaggaacctatcccaatgtccacatatgggtggaatctcgtgcgtctacagtctggagtagatgtgtttttcattccccctgaaaaatgcgacaccctgttgtgtgacatcggcgagtcaagcccaaaccccactgttgaagctggtaggacactgcgggtgctcaatcttgtcgagaactggctgaataacaatacccagttctgcataaaggtgttgaacccgtacatgccttccgtcattgagaaaatggaaacgctgcaacgcaagtacgggggagccctcgtgcgaaatccattaagtagaaactctacccacgagatgtattgggttagcaatgcatcaggcaacatcgtatccagtgtgaatatgatcagcaggatgctgattaaccggtttacaatgcgccataaaaagactacctacgaacccgatgtcgaccttggctctgggacaagaaacataggaatcgagtccgaaattcctaatctggatatcattggtaagaggatcgagaaaataaagcaggagcacgaaacttcatggcactatgaccaggatcatccatacaaaacctgggcttatcacggcagctacgagacaaagcagaccgggtcggcctctagtatggtgaacggagttgtgcgactactcactaaaccctgggacgtcctgccgacggtgacacaaatggccatgaccgatactacccctttcggccagcagcgggtatttaaggaaaaggtggacacacgtacgcaggagcccaaagaaggtaccaagaaattgatgaagatcactgcggagtggctgtggaaagagctcgggaagaaaaagacaccaagaatgtgtacccgcgaagagttcactaggaaggttcggtccaatgctgcacttggagccatttttacagatgaaaacaaatggaaaagcgctagagaggccgtcgaggactcacgcttctgggaactggtggataaagagaggaagttacatctggaaggcaaatgcgagacctgtgtgtataatatgatgggcaagcgagaaaagaaattgggggagtttggaaaggcaaaaggttcccgggccatctggtacatgtggctcggcgctagattcctggagtttgaagcgctagggttccttaacgaggaccactggttttctagggaaaatagcctgagtggagtcgagggcgaaggtctccacaagctggggtacattttgcgcgacgtttccaaaaaggagggaggcgccatgtatgcagatgacacagctggctgggatactcgtatcaccctggaggacctcaagaacgaagagatggtgacgaatcatatggaaggggagcacaagaaacttgccgaagcaattttcaaactgacctaccaaaacaaagtagtgcgggtccagagacctacacccaggggaactgtgatggatataatcagccgccgagaccagcggggttctggccaagttgggacctatggattaaatacatttactaacatggaggcccagctgattagacagatggagggcgaaggtgtgttcaaaaatatccagcatttgaccgtcacggaggaaatcgctgtgcaaaactggctcgccagggtagggcgcgagagactgtcacggatggcgattagtggagatgactgcgttgtgaagccactagatgacaggttcgcatccgcccttacagctctgaatgatatgggcaagatacgtaaagacatccagcagtgggagcccagccgaggctggaacgattggacccaggtccctttttgctctcaccatttccacgaactcattatgaaggacgggcgcgtgctggtggtcccatgtagaaaccaagacgagttgatcggacgggccaggatttcgcagggtgcaggctggtcattacgcgaaactgcttgcctggggaaaagctacgcccagatgtggtccctcatctattttcacagacgggatcttaggctggctgccaatgcaatatgtagtgcggttccgtctcattgggtgcccacaagccgaaccacttggtccatccacgccaagcatgagtggatgaccacagaagacatgctaacggtatggaaccgtgtgtggattcaggagaatccttggatggaggataaaaccccagtcgaatcatgggaggaaatcccctacctgggaaagagagaggaccaatggtgcggcagtctcattggtttgacttctcgcgctacatgggccaagaacatccagaccgcaataaatcaggtgcggagcctgattgggaacgaagagtatactgattacatgccttccatgaaaaggttcagacgcgaggaagaggaagctggagttctttggtga

SEQ ID NO: 14599 - RNA, 9876 nt, synthetic construct
  misc_feature 1..9876: note = derived and/or modified CDS sequence (opt3) from DENV-2__FJ639832__SS-prME
  source 1..9876: mol_type = other RNA
agcgcaggcatgataattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaataccagttagctgttacaattatggccatcctctgcgtgcccaacgcagtcattctgcagaatgcctggaaggtatcatgtaccatccttgctgtggttagtgtgtccccactgttgctcacatctagccagcagaaaactgactggatacctctggcgctaaccattaagggactgaaccccacggccatcttccttacaaccctctccagaactaataaaaagaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaaatgggaggatcaggccgaaatcagcggctcgtcacccattctgtctatcacgattagtgaggacgggtccatgagcatcaagaacgaagaggaggaacagacactaaccatactgatcagaactggacttctcgtgatttctggcctgtttccaatcagcattcccatcacagcggctgcctggtacttgtgggaggtgaaaaagcagagggccggtgtcttatgggatgtgccttccccaccccctatggggaaagccgaactggaggacggagcttatcgaataaagcaaaagggcattctcggctactcacagatcggggcaggagtttacaaagaaggtaccttccacactatgtggcatgtaacacgcggcgccgtgctgatgcacaaggggaaacggatcgagccgagttgggcggatgtcaagaaagaccttattagctatggaggcggttggaagctggagggggaatggaaggagggagaagaggtgcaggttttggctctagaaccaggcaaaaatcccagagccgtgcagaccaagcctggcctgtttaaaacgaacactgggaccatcggagcagtctctctcgatttctccccaggtacatcaggcagtcccataattgacaagaaagggaaggtggtaggactgtacggcaacggtgtcgtgaccaggagcggggcctatgtttccgctatcgcccaaacagagaagtctattgaggataatcctgaaatcgaggacgatatatttcgtaaacgccggcttactattatggacttacacccgggagcaggcaagaccaaaagatacctgcccgctatcgtgagggaagccatcaagcgaggcctccggacgttgattctggcgccaacacgcgtcgtggccgcagagatggaagaggctctcagagggctgcctatcaggtatcagactcccgccattcgggctgagcataccggacgagaaatagttgaccttatgtgtcacgcaacattcaccatgagactgttgtcgccagtgcgcgtccctaactacaatctaatcattatggatgaggcccatttcactgaccccgccagcatcgctgcgaggggttatatctcaacccgtgtggaaatgggcgaggcagccgggatttttatgacagctacgccaccgggatcccgggatcctttcccccagagtaacgccccaataatcgacgaggaaagagagattcccgaaaggtcttggaatagcggccacgagtgggtaactgattttaaaggtaagaccgtgtggttcgttccttccatcaaggcagggaacgacattgccgcttgcctgcgcaaaaatggaaagaaagtcatccaactctcacgaaagacatttgattctgaatacgtgaaaaccagaactaacgactgggatttcgtggtcacaaccgacataagcgagatgggcgcgaattttaaggccgagcgggtaatcgatccaaggcgctgtatgaaacccgtgattttaacggacggcgaagaacgtgttatcctggcagggcctatgccggtgactcatagttccgctgcccagagacggggaaggattggtcgcaacccaaagaatgaaaacgaccagtacatctatatgggcgagccccttgaaaatgatgaggactgcgcacactggaaggaggccaaaatgctgctcgataacataaatacacctgaagggattatccccagcatgttcgagccagaacgagagaaggtcgacgctattgatggagaatacagattgcggggcgaggccaggaaaacctttgtggacctgatgcgcagaggtgatctccctgtttggctggcgtataaggtggcagccgaggggatcaactacgctgacaggcggtggtgtttcgatggcatcaaaaacaatcagatccttgaagagaacgtcgaagtggagatttggaccaaggagggagaacgtaagaaactaaagccccgctggctggacgcccgaatctattctgatccattggctttaaaagagtttaaggagttcgcagccggcagaaaatcactgactctcaatctgattacagagatggggaggcttcctaccttcatgacacaaaagactcgggacgctctggataacctcgccgtattgcacacggcagaagcgggaggtcgcgcctacaatcatgctctgtccgagctaccggagaccctggaaacactccttctgttaactttgctggccaccgtgacaggcgggatctttctcttcctgatgagtggaagaggcataggtaagatgacccttgggatgtgctgcattatcactgcaagcatcctgctctggtatgctcagattcagccccactggatcgccgcatcgataattttggagtttttcctgatcgttttactaattccagaacctgagaaacagaggacgccccaagacaaccagctgacctacgtcgtgatcgccatactcacagtggtcgctgcgactatggccaatgaaatgggctttcttgagaagaccaaaaaggacctgggattgggctctatcgcaacacagcagccagagtccaacattctggatatcgacctccggcctgctagcgcctggaccctgtacgccgttgcaactacattcgtgacgcccatgcttcgacattcaattgaaaatagttctgtaaacgtgtccctcaccgctatcgccaatcaagcgactgtcctgatggggttgggaaaaggttggccgctgagcaagatggatattggcgtgccattactagctatcgggtgttattcacaggttaaccctataacactgaccgccgcactccttctgttggtggcccactacgctattatcggacccggcctgcaggcaaaggccaccagagaggcgcagaaacgcgctgccgcaggtatcatgaagaatccaacagtcgacgggattactgtaatagatctcgaccccatcccttatgatccgaaatttgaaaagcaactgggccaggtgatgcttttaattctgtgcgttacacaggtgctcatgatgaggaccacatgggccttgtgtgaggctctgactctagccaccggacccatcagtacactgtgggaaggcaacccagggcggttctggaataccactattgcagtcagcatggctaacatctttcgtggatcctacctcgccggcgcgggtcttctgttctctataatgaaaaatacgacaaacaccagaagggggactggaaacatcggcgagaccttgggtgagaagtggaaaagccgcctgaatgccctcggcaagtccgaatttcaaatttataagaaatcagggatccaggaggtggaccggacactggcaaaggaaggaattaaacgaggcgagactgatcaccatgctgtctctagagggagtgccaagttaaggtggttcgtggagcgcaacatggttacccctgaaggaaaagtggtagaccttggctgcggtagagggggatggtcgtactattgtggcggtctgaagaatgtgagagaggtcaagggcctcacaaaagggggacccggccacgaggaacctatcccaatgagcacgtacgggtggaacctagttcgtctgcagtccggagtggatgtctttttcataccccctgaaaagtgcgacaccttgctgtgtgatattggcgagtcttcaccaaatcccactgtggaggcaggtaggacactccgggtacttaacctggtggaaaattggttgaacaataacacccagttctgcatcaaagttctgaatccgtacatgcctagcgtgatcgagaagatggaagctctccaacgcaaatatgggggagccttagtccgaaacccactgtccagaaatagtactcatgagatgtactgggtgtctaacgccagcggcaatattgtctcatccgtgaacatgataagtaggatgcttatcaaccggtttacaatgcgccacaagaaggcgacctatgaacccgacgttgacctgggcagcgggacgagaaatattggaatcgagtctgaggtacctaacctagatattatcggtaaaaggatagaaaagatcaaacaggagcatgaaacctcctggcactacgaccaggatcacccatataagacatgggcttaccatggctcatatgagactaaacagaccgggagcgcatcgtctatggtgaatggagtcgtgcgactcctgacaaagccctgggacgttttgccgactgtgacccaaatggccatgacagataccactcctttcggccagcagcgggtctttaaggaaaaagtggacacgcgtacacaggagcccaaggagggtaccaaaaagctgatgaaaattactgctgaatggctctggaaggagcttgggaaaaagaagaccccaagaatgtgtacacgcgaagagttcacgaggaaagtacggagtaacgccgcactgggagccatctttaccgatgagaataagtggaaatccgctagagaagcggtggaggacagccgcttctgggaattagttgataaggagaggaacctgcacttggaaggcaaatgcgagacttgtgtctacaatatgatgggcaagcgagagaagaaactcggggaatttggaaaggccaaaggttcacgggcaatttggtacatgtggctgggcgctagattcctagagtttgaagcccttgggttcctgaacgaggaccattggttttccagggaaaattctctcagcggagtggagggcgagggtctgcacaagttggggtatatcctgcgcgatgtgagtaaaaaggaaggaggcgcaatgtacgccgacgacacagctggctgggatacccgtattactctcgaggaccttaagaacgaagagatggtcacaaatcacatggaaggggagcataaaaagctggccgaggcgatattcaaattaacctatcaaaacaaggttgtgcgggtacagagacctacacccaggggaactgtgatggatatcatttcccgccgagaccagcggggtagcggccaagtcgggacctacggactgaatacgtttaccaacatggaagcacagttgatcagacagatggagggcgaaggtgtgttcaaaaatatccagcacctcacagttactgaggaggtggccgtccaaaactggctggctagggtggggcgcgaaagactatctcggatggccatttcaggagatgactgcgtagttaagccacttgatgacaggttcgcaaacgctctgaccgccctcaatgatatgggcaagatacgtaaagacatccagcagtgggagcccagtaagggctggaacgattggacacaggtgcctttttgctcccatcacttccatgaactgattatgaaagacgggcgagtcttggtggtgccatgtcgcaatcaagatgagttaatcggacgggctcggattagccagggtgccggctggtctctgagggaaactgcatgcctcgggaagtcgtatgcgcagatgtggtcacttatgtactttcaccgcagagacctgcggctagccgctaacgccatctgtagcgcagtcccgtcccactgggttcccaccagtaggacgacatggtctatacatgctaaacacgagtggatgaccactgaggacatgctgacagtgtggaatcgagtatggatccgtgaaaacccttggatggaggataagaccccagtggaaagctgggaggaaattccctatctcggaaagagagaggaccagtggtgcggctccttgatcggtctgacttcacgcgccacctgggccaaaaatattcaagccgcgatcaaccaggtccggagtcttatagggaatgaggaatacacagattacatgccttctatgaagaggttcagacgcgaggaagaggaagctggagtgctgtggtga

SEQ ID NO: 14600 - RNA, 9876 nt, synthetic construct
  misc_feature 1..9876: note = derived and/or modified CDS sequence (opt3) from DENV-2__FJ687434__SS-prME
  source 1..9876: mol_type = other RNA
agcgtgggaatgatcattatgctgatacccaccgtcatggcattccacctcacaactcggaacggggagcctcatatgatcgtttccattcaggaaaaaggaaaatctcttctgtttaagacggaggacggtgtgaatatgtgcaccttgatggctatggatttaggagaactgtgtgaggacacaatcacttacaaatgcccactactcagacaaaacgaaccggaggatattgactgttggtgcaattcaaccagtacatgggtaacctatgggacttgtacaaccacgggagagcaccggcgcgaaaagcgaagcgtggcactggtcccccatgtgggcatgggtcttgagactcgtaccgaaacatggatgtcctctgagggggcctggaaacacgcgcagagaatcgagacttggatactgaggcatcctggattcaccatcatggctgccattttggcatacacaatcggcaccacgcactttcagcggactctcattttcatcctgctgacagccgttgctccatcgatgaccatgcgctgcataggcatttcaaacagagattttgtggaaggggtcagcggaggtagttgggtggacatcgtactcgagcacggctcctgtgttactacaatggcaaagaataagcccaccttagatttcgaactgattaaaacggaggccaagcagcctgctacccttaggaaatattgcatcgaagcccggttgacaaacactaccacagagtctcgctgtccaactcaaggggagcccagcctgaaggaggaacaagacaaacgatttgtgtgcaagcattccatggtcgatagaggatggggcaatggttgtgggctattcggaaagggcggcatcgtgacctgcgcgatgtttacatgcaaaaagaacatggaagggaaaattgtgcagcctgagaatctcgaatacaccatagtcgttactccacactcaggagaggagcatgcagtgggtaacgacacgggcaagcacgggaaagaaatcaaggtaacaccgcagagtagcattaccgaggccgaactgactggatatggcaccgtgacaatggagtgttctcccaggacctcccttgatttcaatgaaatggtcctgttgcaaatggagaacaaggcttggctcgtgcaccggcagtggtttctggacttacctctgccatggctccccggtgccgatactcaggggtcaaattggatccagaaggagacacttgttacgttcaagaaccctcatgccaagaaacaagacgtggtcgtgctgggcagccaggaaggagctatgcacaccgccttgactggcgcgacagagatacagatgagttctgggaatctactgtttaccggacatctcaaatgccgtctgcgcatggacaaacttcaactgaaaggtatgtcctacagcatgtgtacaggcaagttcaaggtagttaaagaaattgccgagactcagcacgggaccatcgtgatcagagtccagtatgagggagatggctcgccatgcaagattcccttcgaaatcatggacttggagaaaaggtacgtgctcggtcggctgattacggtcaacccgatagtgaccgaaaaggattctcctgttaacatcgaggcagaacccccatttggggactcctacattatcatcggcgtggagcctggacagttaaaactgaattggttcaagaagggctcaagtattgggcaaatgtttgagacaactatgcgaggagctaaacgcatggccatactaggtgataccgcttgggacttcggcagcctcgggggagtatttacatccatcggcaaggccctgcatcaggtcttcggtgcaatttatggggccgctttttctggcgtgagctggactatgaaaatccttattggagttatcataacctggatcggcatgaactcaagaagtacgtccttgagcgtgtctctggtcctcgtgggggtagtgacactgtaccttggagttatggtccaggcggattcaggctgtgtggtgagttggaagaataaagaactgaagtgcggtagcgggattttcatcaccgacaacgtccacacttggacagagcagtataagtttcaacccgaatccccatctaaattggcatcggccattcagaaggctcaggaggaaggaatctgtggcataaggagcgttacccggctcgagaatctgatgtggaaacagattactcccgagttaaaccacatcctggccgaaaatgaggtgaagctaaccattatgacaggtgatatcaaaggcataatgcaagcagggaagcgctccctcagacctcagccaacggaactgaaatactcatggaagacctggggaaaggccaaaatgcttagtactgagtctcataaccagacattcttgatcgacggcccggaaaccgctgagtgccccaatacaaacagggcctggaatagcctggaggtggaagattatgggtttggagtattcactaccaacatttggctcaagctgaaagagaagcaggacgcattttgtgactccaaattaatgtcagcggctatcaaggataatcgtgccgtccacgcagacatgggctactggattgaaagcgccctgaacgatacgtggaagatcgagaaggcttctttcatagaggtgaagaattgccattggcctaaatcccacacactttggagtaacggtgttttggaaagcgagatgattatcccaaagaacctcgccgggcccgtgtctcaacacaattatcggcctggataccatacccagatcgcaggcccatggcacctgggtaaactagaaatggacttcgatttttgtgacggcactaccgtcgtggttacagaggattgcgggaaccgaggaccctccctgagaactaccacagcttcaggcaagctcattacggaatggtgctgtaggagttgcaccctgccgcctcttcgctacagaggggaagacggatgttggtatggcatggagatcagaccattgaaggaaaaagaggaaaatctggtgaacagcttagtaactgccggtcatgggcaggtcgataatttctcgctcggagtgctgggcatggcgctttttctggaggaaatgttgaggacacgcgtgggtaccaagcacgccattctcctggtcgctgtttccttcgtgactctaataacaggcaacatgtcttttaaagacctggggcgagtagtggtcatggtgggagcaaccatgacggatgacatcggcatgggggttacttacctcgccctgcttgctgccttcaaggtgcggcccacctttgcagcgggattgctgttacgtaaactcacaagcaaggagctgatgatgaccactattggcatcgtccttctgtcacaaagtacaattcctgagaccatcctagaactcacagatgccctggctttgggtatgatggtgctgaagatggttagagacatggagaaatatcagttagccgtgactataatggcaatcctctgcgtccccaatgctgtaattctgcagaacgcctggaaggtgtcctgtaccatccttgcagttgtgtctgtcagcccactgttgctcacgtcctcacagcagaaaacagactggattcctctggccctaaccatcaaggggctgaatcccactgctatattccttaccacactcagcaggactaacaaaaagcgcagttggccactgaatgaagcgattatggccgtgggaatggtatctatcttggcatccagcctgctcaaaaacgatatcccgatgaccggccctctcgtggctggcgggctgcttacggtctgctacgttctgacaggacggtcggccgacttggagctcgaaagagccaccgatgtgaagtgggaggaccaggctgagatttcaggttctagtcccatactgtccatcactattagcgaagatggctctatgagcatcaagaatgaggaagaggagcagacactaaccattctgatcaggactgggcttctcgtgatatccggactgtttccagtctcaatccccattacagcagccgcgtggtatttgtgggaagtgaaaaagcagcgagctggcgttttatgggacgtacctagtccaccccctatgggtaaagccgagctggaagatggggcataccgcatcaagcaacggggaattttaggctatagccagatcggcgccggggtgtacaaagagggaaccttccatacgatgtggcacgtcactagaggtgctgtgctgatgcacaagggcaagaggatagaaccgtcttgggcagacgttaaaaaggatcttatttcctacgggggaggctggaaactggagggtgagtggaaggaaggggaggaagtgcaggtcttggccctagagccaggcaaaaacccccgtgcggtgcagaccaagcctggcctgtttaagacaaataccggcacaatcggggctgtatcactcgacttcagtccaggaactagcggttcccccatcattgataaaaagggcaaagtcgtggggctgtatggaaacggcgttgtgacccgctctggtgcctacgtctcggcaatcgcccaaacggaaaagagcatagaggacaaccctgatattgaggacgacatctttcggaaaagaaggcttacaattatggatttacatccgggggctggaaagactaagcgatatctgcccgccatcgtgcgggaagcaataaaacgcggcctcagaaccttgattctggctccaacaagggttgtggccgcggagatggaagaggccctccggggcctgcctatccgataccagacccccgcaatcagagctgaacacactgggcgcgagattgtcgaccttatgtgtcatgccaccttcacaatgaggctgttgtcaccagtgcgtgtacctaattataacctaatcattatggatgaggctcacttcacggaccccgcatccatagccgcccggggatacatcagtactagagtggaaatgggtgaggctgcgggcatttttatgaccgcaacaccaccggggtctagggatcctttcccccagagcaatgccccaatcatcgacgaggaacgcgagattcccgaacgatcctggaactcaggacatgagtgggttaccgattttaagggcaaaactgtctggttcgtgccttctataaaggctggtaatgacatcgccgcatgcctgaggaaaaacgggaagaaggtgattcaactcagccggaaaacatttgatagtgaatatgtcaagaccaggacgaatgactgggatttcgtagtgactacagacatctccgagatgggagccaactttaaagctgaacgcgttattgacccacgtagatgtatgaagcccgtgatcttaaccgatggcgaggagcgggtcatactggcgggccctatgccggtgacccacagctctgccgcacagaggcgcgggcgaatcggaagaaatcccaaaaacgaaaatgaccagtacatttacatgggtgagccccttgaaaacgatgaggactgcgctcactggaaggaagccaaaatgctgctcgataatatcaacactcctgagggcattatcccctcaatgttcgagccagaacgggagaaggttgacgcaatagatggggaatataggttgcgcggagaggccagaaagacatttgtggacctgatgaggcggggcgatctccctgtctggctggcttacaaagtggccgcggaaggtattaattatgcagaccgtcgctggtgtttcgatgggatcaagaacaaccagattcttgaggagaatgtagaagtggagatctggaccaaagaaggcgagcgaaagaaactaaagcccagatggctggacgccaggatatactccgatccattggctttaaaggagtttaaagagttcgccgctggacggaagagtctgacactcaacctgatcactgagatgggccgccttcctacgttcatgacccagaaaacaagagacgcactggacaatctcgccgttttgcatactgctgaagccgggggaagggcatataaccacgcgctgagcgagctaccggaaaccctggagacactccttctgttaaccttgctggccactgtcacgggtggcatttttctcttcctgatgtcggggcggggaatcggcaagatgacccttggtatgtgctgcattgtgacagcttctatcctgctctggtacgcccagatacagccccattggattgcagcttccatcatcttggagtttttcctgattgtgttactaatcccagaacctgagaaacagcgaactccccaagataatcagctgacctatgtcgttatagccattctcacagtggtagcagccaccatggctaacgaaatggggtttcttgagaagactaagaaagacctgggcttgggaagcatcgcgacacagcagccagaatcaaatattctggatatcgacctcagacctgccagtgcatggacgctgtacgctgtggccaccactttcgtcacacccatgcttcgccactctatagagaactccagcgtgaatgtttcactcaccgccatcgcaaaccaagctaccgtgctgatgggcttggggaagggatggccgctgagtaaaatggatattggtgccccattactagcgatcggctgttacagccaggtcaatcctattacactgactgctgccctccttctgttggtagcacactatgccatcattgggcccggactgcaggctaaggcaacgagggaggcccagaaacgggcggctgccggcatcatgaagaacccaaccgtggacggtataacagttattgatctcgaccccatcccttacgatccgaagtttgaaaaacaactggggcaggcaatgcttttagtgctgtgcgtcactcaggtgctcatgatgcgtaccacatgggccttgtgtgaggctctgaccctagccactggccccatctccacgctgtgggaaggaaatccaggcagattctggaacacaaccattgcagtctctatggctaatatatttagggggagctatctcgccggagcgggccttctgttctccatcatgaagaacactaccaattcacgccggggtacagggaacattggagagactttgggcgaaaaatggaagtctcgactgaacgccctcggtaaaagtgagtttcaaatctacaagaaatcgggcattcaggaggtggacagaaccctggcaaaggaagggatcaagaggggagagacagatcatcacgctgttagccgcggctccgccaaattacggtggttcgtggaaagaaatatggtaacgcctgaggggaaggtggtcgaccttggatgcggccgtggtgggtggtcttattactgtggaggcctgaaaaacgttagggaggtgaagggtctcaccaaaggcgggcccggacatgaggagcctataccaatgtcaacttatggctggaatctagtccggctgcagagcggggtggatgtatttttcatcccacctgaaaagtgcgacacattgctgtgtgacattggagagtccagtccaaaccccaccgtggaagcaggccgcactctccgagttcttaatctggtggagaactggttgaataacaatacacagttctgcatcaaggtcctgaacccgtacatgccttctgtgattgagaaaatggaaaccctccaaagaaagtacggtggggctttagtcaggaatccactgagccggaactcaacgcacgagatgtattgggtgtccaatgccagtggaaacatcgttagctctgtaaatatgatatcccgcatgcttattaacagatttaccatgaggcataaaaaggccacatacgaacccgatgtggacctgggctcaggcactcgaaacatcgggatcgagagcgaaattcctaatctagatataatcggaaaacggattgagaagatcaagcaggagcacgaaacctcgtggcactatgaccaggatcatccatacaaaacatgggcgtatcacggttcttacgagactaagcagaccggcagtgcttccagcatggtcaacggggtggttcgtctcctgacaaaaccctgggacgtgttgccgaccgtcactcaaatggcaatgacggatacaacccctttcggacagcagagagtgtttaaggaaaaagtagacactcgcacccaggagcccaaggaaggcacaaagaaactgatgaagattacggccgagtggctctggaaagagcttggtaagaaaaagaccccaaggatgtgtactcgggaagagttcacaagaaaagtgcgctcaaatgctgccctgggggcaatctttaccgatgaaaacaagtggaagtccgccagggaggctgttgaggactctcgattctgggaattagtcgataaagagcggaatctgcatttggaaggaaagtgcgagacttgtgtgtataacatgatgggcaaaagagaaaagaaactcggcgagtttgggaaggcgaagggaagcagggccatatggtacatgtggctgggtgcacgcttcctagagtttgaagctcttggcttcctgaatgaggaccactggtttagtcgtgaaaactccctcagcggggtggagggagaaggcctgcacaaattgggttacatcctgcgggacgtctctaagaaagaagggggagccatgtatgcagatgacacagccggctgggataccagaattacactcgaggaccttaagaatgaagagatggttactaaccatatggaaggcgagcacaaaaagctggctgaagccatcttcaagttaacctaccaaaataaagtggtaagggtgcagcgccctacgccccgagggaccgtcatggatattatctcacggagagaccagaggggaagtggtcaagtgggcacatatgggctgaacacttttaccaatatggaggcgcagttgattcgccagatggagggagaaggcgttttcaagaacatacagcatctcacagtgactgaggaaatcgcagtccaaaattggctggccagagtgggtcgggagaggctatcccgtatggctattagcggggatgactgcgtagttaaaccacttgatgaccgattcgcctctgcactgaccgctctcaacgatatgggaaagatccgcaaagacatccagcagtgggagccctcgagaggctggaacgattggacgcaagtgcctttttgctcacaccatttccacgaactgattatgaaggacggccgggtcttggtggtgccatgtaggaatcaagacgagttaatagggcgcgccagaatcagccagggagctggttggtccctgcgggaaacagcctgcctcggcaagagttacgcacagatgtggtctcttatgtattttcacaggcgagatctgcgtctagcggccaacgctatttgtagcgccgtcccgtcccattgggttcccacctcaagaactacatggagtatccacgcaaaacatgagtggatgaccactgaagacatgctgaccgtgtggaatcgcgtatggattcaggagaacccttggatggaggataagacaccagtggaatcttgggaggaaatcccctacctcgggaaacgggaggaccaatggtgcggcagcttgataggcctgacgtccagggctacctgggccaagaatatccaggcagccattaaccaggtcagatcacttatcggtaatgaagagtatactgattacatgcctagcatgaaacgcttccggagggaggaagaggaagcgggggtgctgtggtga

SEQ ID NO: 14601 - RNA, 9876 nt, synthetic construct
  misc_feature 1..9876: note = derived and/or modified CDS sequence (opt3) from DENV-2__FJ687439__SS-prME
  source 1..9876: mol_type = other RNA
agcgccggcatgataattatgctgatacccaccgtgatggctttccacctcactactagaaacggggagcctcatatgatcgtcggtattcaagaaaaaggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgtaaccactatggctaagaataagcccacattagatttcgaactgattaaaaccgaggccaagcagcctgcgacgcttaggaaatattgcatcgaagcaaagttgaccaacacaactaccgagtcccggtgtccaacacaaggagagccctctctgaaagaagaacaggacaagcgctttgtttgcaagcatagcatggtggatcgaggctggggtaatgggtgtggactattcggcaaaggcgggatcgtcacttgcgccatgtttacctgcaagaaaaacatggaaggaaagattgtgcagcctgagaatctcgaatacacaatagtggtcaccccacactccggtgaggagcatgctgttggcaacgacactgggaaacacggaaaggaaatcaaagtgacgccgcagtcaagtattacagaggccgaactgaccggctatggtactgtaaccatggagtgtagccccagaacagggcttgatttcaatgaaatggtgctgttgcaaatggagaacaaggcatggctcgtccacaggcagtggtttctggacttacctctgccatggctccccggcgctgataagcaggagtctaattggatccagaaagaaacccttgtgactttcaagaaccctcatgccaaaaagcaagacgttgtggtcctgggatcccaggagggcgcgatgcacacagccttgacgggggcaaccgaaatacagatgtcaagcggaaatctactgtttactggtcatctcaaatgccggctgcgtatggacaaacttcaactgaagggcatgagttactctatgtgtacagggaaattcaaggtggtaaaagagattgctgagacccagcacggaacaatcgttatccgcgtgcagtatgaaggcgatggttccccatgcaagattcccttcgagatcatggacttggagaagagatacgtcctcgggaggctgattactgtgaacccgatagccaccgagaaggatagccctgtcaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggcaatactaggcgatacagcctgggacttcgggtcactcggaggcgtttttacaagtatcggtaaggctctgcatcaggtgttcggggcgatttatggcgcagcctttagcggagtatcctggaccatgaaaatccttattggcgtcatcataacatggatcgggatgaactctcgcagcacttcattgagtgtgtccctggttctcgtgggaattgtcaccctgtaccttggcgtgatggtacaggctgatagcggttgtgtggtttcttggaagaataaggagctgaaatgcgggtcaggaatcttcattacggacaacgtccacacatggaccgaacagtataagtttcaacccgagagtccaagcaaattggcctccgcaatccagaaggcccaggaagagggcatatgtggtattagatctgtgactaggctcgagaatctgatgtggaaacagatcacacccgaattaaaccacattctggctgagaatgaagtgaagctaaccatcatgactggcgatataaaagggatcatgcaagccggaaagcggtcgctccgccctcagccaaccgagctgaagtacagctggaaaacatggggcaaggcaaaaatgctttccacggaatcatataaccagaccttcttgattgacgggccggagactgcggagtgccccaatacaaacagagcttggaatagtctggaagtcgaggattacggatttggcgttttcaccacaaacatctggctcaagctgaaagaaaagcaggacgccttttgtgactctaagttaatgagcgcagccattaaagataatagggctgtgcatgccgacatgggttattggatcgagtccgcactgaacgatacttggaagatagagaaggcttcattcattgaagtgaagaattgccactggcctaaaagccataccctttggtctaacggggtattggagtccgaaatgatcatcccaaagaacctcgccggacccgtcagtcaacacaattaccgtcctggctaccacacgcagattgcgggtccatggcatctgggcaagctagagatggacttcgatttttgtgacgggacaaccgtgatcgttactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagtcacggctgggcacggacaggtggataatttcagtctcggcgttctgggtatggcactttttctggaagagatgttgagaaccagggtgggcactaagcatgccatcctcctggtagctgtcagcttcgtgacactaattaccgggaacatgtcgtttaaagacctgggacgcgtggtcgttatggtgggcgccactatggcagatgacatcgggatgggagtaacatatctcgcgctgcttgccgctttcaaggtgcgacccacctttgccgcaggcttgctgttacggaagctcacgtccaaagagctgatgatgactaccattggtatcgtccttctgtctcaaagcacaatacctgaaaccatcctagagctcactgatgctctggccttggggatgatggtgctgaagattgttcgtaatatggaaaaataccagttagcagtgacaatcatggccattctctgcgtccccaacgctgtgatcctgcagaatgcgtggaaggtttcatgtaccatacttgccgtggtcagtgtatccccactgttgctcacatctagccagcagaaaactgactggattcctctggcactaaccatcaagggactgaaccccacggctatcttccttacaaccctctccagaactaataaaaagaggtcatggccactgaacgaggccattatggccgtgggcatggttagcatattggctagttctctgttaaagaatgacatcccgatgaccggccctctcgtggcagggggactgcttacagtctgctatgtgctgactggtcgctccgccgatttggaactcgagcgggcgaccgacgtaaaatgggaggatcaggctgaaattagcggctcgtcacccatcctgtctattacgatcagtgaggacgggtccatgagcataaagaacgaagaggaggaacagacactaaccatcctgattagaactggacttctcgtgatctctggcctgtttccaattagcatccccataacagccgcagcctggtacttgtgggaggtcaaaaagcagagggctggtgttttatgggatgtgccttccccaccccctatggggaaagcagaactggaggacggagcctatcgaattaagcaaaagggcatcctcggctactcacagatcggggcgggagtgtacaaagaaggtaccttccacactatgtggcatgtcacacgcggcgctgtgctgatgcacaaggggaaacggattgagccgagttgggccgatgttaagaaagaccttatcagctatggaggcggttggaagctggagggggaatggaaggagggagaagaggtacaggtgttggcactagaaccaggcaaaaatcccagagccgtccagaccaagcctggcctgtttaaaacgaacactgggaccataggagctgtgtctctcgatttctccccaggtacatcaggcagtcccattatcgacaagaaagggaaggttgtgggactgtacggcaacggtgtcgtgaccaggagcggggcctatgtatccgcaattgctcaaacagagaagtctatcgaggataatcctgaaatagaggacgatatttttcgtaaacgccggcttactatcatggacttacacccgggagccggcaagaccaaaagatacctgcccgcgatcgtcagggaagccattaagcgaggcctccggacgttgatcctggcaccaacacgcgtggttgctgccgagatggaagaggctctcagagggctgcctattaggtatcagactcccgcaatacgggccgagcataccggacgagaaatcgtggaccttatgtgtcacgccacattcaccatgagactgttgtcgccagtccgcgtgcctaactacaatctaattgttatggatgaggctcatttcactgaccccgcgagcatcgcagccaggggttatatctcaacccgtgtggaaatgggcgaggctgccgggatttttatgacagcaacgccaccgggatcccgggatcctttcccccagagtaacgccccaataatcgacgaggaaagagagattcccgaaaggtcttggaatagcggccacgagtgggtcactgattttaaaggtaagaccgtgtggttcgtaccttccatcaaggctgggaacgacattgcggcctgcctgcgcaaaaatggaaagaaagtgatccaactctcacgaaagacatttgattctgaatacgttaaaaccagaactaacgactgggatttcgtcgtgacaaccgacataagcgagatgggcgcaaattttaaggctgagcgggtgatcgatccaaggcgctgtatgaaacccgtcattttaacggacggcgaagaacgtgtaatcctggccgggcctatgccggtgactcatagttccgcagcccagagacggggaaggattggtcgcaacccaaagaatgaaaacgaccagtacatctatatgggcgagccccttgaaaatgatgaggactgcgctcactggaaggaggccaaaatgctgctcgataacataaatacacctgaagggattatccccagcatgttcgagccagaacgagagaaggttgacgcgattgatggagaatacagattgcggggcgaggcaaggaaaacctttgtggacctgatgcgcagaggtgatctccctgtctggctggcctataaggtggctgccgaggggatcaactacgctgacaggcggtggtgtttcgatggcatcaaaaacaatcagatccttgaagagaacgttgaagtggagatttggaccaaggagggagaacgtaagaaactaaagccccgctggctggacgcacgaatctattctgatccattggccttaaaagagtttaaggagttcgctgccggcagaaaatcactgactctcaatctgattacagagatggggaggcttcctaccttcatgacacaaaagactcgggacgcactggataacctcgcggtcttgcacacggccgaagctggaggtcgcgcctacaatcatgcactgtccgagctaccggagaccctggaaacactccttctgttaactttgctggctaccgtgacaggcgggatctttctcttcctgatgagtggaagaggcataggtaagatgacccttgggatgtgctgcattatcactgccagcatcctgctctggtatgcacagattcagccccactggatcgccgcttcgataattttggagtttttcctgatcgtattactaattccagaacctgagaaacagaggacgccccaagacaaccagctgacctacgtggttatcgcgatactcacagtcgtggccgcaactatggctaatgaaatgggctttcttgagaagaccaaaaaggacctgggattgggctctatcgccacacagcagccagagtccaacattctggatatcgacctccggcctgccagcgcatggaccctgtacgctgtggccactacattcgtcacgcccatgcttcgacattcaattgaaaatagttctgttaacatctccctcaccgcgattgctaatcaagccactgtgctgatggggttgggaaaaggttggccgctgagcaagatggatatcggcgtaccattactagcaatagggtgttattcacaggtgaaccctattacactgaccgccgctctccttctgttggtcgcacactacgccatcatcggacccggcctgcaggcgaaggctaccagagaggcccagaaacgcgcagccgctggtattatgaagaatccaacagtggacgggataactgttatcgatctcgaccccattccttatgatccgaaatttgaaaagcaactgggccaggtgatgcttttaatcctgtgcgtcacgcaggtactcatgatgaggaccacatgggccttgtgtgaggcactgactctagctaccggacccattagtacactgtgggaaggcaacccagggcggttctggaataccactatcgccgtgagcatggcgaacatatttcgtggatcctacctcgccggcgcaggtcttctgttctctatcatgaaaaatacgacaaacaccagaagggggactggaaacattggcgagaccttgggtgagaagtggaaaagccgcctgaatgctctcggcaagtccgaatttcaaatctataagaaatcagggattcaggaggttgaccggacactggccaaggaaggaatcaaacgaggcgagactgatcaccatgcagtgtctagagggagtgctaagttaaggtggttcgtcgagcgcaacatggtgacccctgaaggaaaagtcgtggaccttggctgcggtagagggggatggtcgtactattgtggcggtctgaagaatgttagagaggtgaagggcctcacaaaagggggacccggccacgaggaacctataccaatgagcacgtacgggtggaacctagtacgtctgcagtccggagtggatgtctttttcattccccctgaaaagtgcgacaccttgctgtgtgatatcggcgagtcttcaccaaatcccactgttgaggccggtaggacactccgggtgcttaacctggtcgaaaattggttgaacaataacacccagttctgcatcaaagtgctgaatccgtacatgcctagcgtaattgagaagatggaagccctccaacgcaaatatgggggagcgttagtgcgaaacccactgtccagaaatagtactcatgagatgtactgggtttctaacgctagcggcaatatagtgtcatccgtcaacatgatcagtaggatgcttattaaccggtttacaatgcgccacaagaaggcaacctatgaacccgacgtggacctgggcagcgggacgagaaatatcggaattgagtctgagatccctaacctagatataatcggtaaaaggattgaaaagatcaaacaggagcatgaaacctcctggcactacgaccaggatcacccatataagacatgggcctaccatggctcatatgagactaaacagaccgggagcgcttcgtctatggtcaatggagtggttcgactcctgacaaagccctgggacgtattgccgactgtgacccaaatggccatgacagataccactcctttcggccagcagcgggtctttaaggaaaaagtggacacgcgtacacaggagcccaaggagggtaccaaaaagctgatgaaaattactgcagaatggctctggaaggagcttgggaaaaagaagaccccaagaatgtgtacacgcgaagagttcacgaggaaagttcggagtaacgccgctctgggagcgatctttaccgatgagaataagtggaaatccgccagagaagcagtggaggacagccgcttctgggaattagtcgataaggagaggaacctgcacttggaaggcaaatgcgagacttgtgtgtacaatatgatgggcaagcgagagaagaaactcggggaatttggaaaggctaaaggttcacgggccatttggtacatgtggctgggcgcaagattcctagagtttgaagcccttgggttcctgaacgaggaccattggttttccagggaaaattctctcagcggagtagagggcgagggtctgcacaagttggggtatatactgcgcgatgtgagtaaaaaggaaggaggcgctatgtacgccgacgacacagcgggctgggatacccgtatcactctcgaggaccttaagaacgaagagatggttacaaatcacatggaaggggagcataaaaagctggcagaggccattttcaaattaacctatcaaaacaaggtcgtgcgggtgcagagacctacacccaggggaactgtcatggatatcatctcccgccgagaccagcggggtagcggccaagttgggacctacggactgaatacgtttaccaacatggaagctcagttgattagacagatggagggcgaaggtgtgttcaaaaatatacagcacctcacagtaactgaggaggtggccgtccaaaactggctggcaagggtggggcgcgaaagactatctcggatggctatctcaggagatgactgcgttgtgaagccacttgatgacaggttcgccaacgctctgaccgccctcaatgatatgggcaagattcgtaaagacatccagcagtgggagcccagtaagggctggaacgattggacacaggtccctttttgctcccatcacttccatgaactgattatgaaagacgggcgagtgttggtagttccatgtcgcaatcaagatgagttaatcggacgggcacggataagccagggtgcgggctggtctctgagggaaactgcctgcctcgggaagtcgtatgctcagatgtggtcacttatgtactttcaccgcagagacctgcggctagccgcaaacgctatctgtagcgccgtgccgtcccactgggtccccaccagtaggacgacatggtctattcatgcaaaacacgagtggatgaccactgaggacatgctgacagtgtggaatcgagtgtggatccgtgaaaacccttggatggaggataagaccccagtcgaaagctgggaggaaattccctatctcggaaagagagaggaccagtggtgcggctccttgatcggtctgacttcacgcgccacctgggcgaaaaatatacaagctgccattaaccaggttcggagtcttatcgggaatgaggaatacacagattacatgccttctatgaagaggttcagacgcgaggaagaggaagcaggagtgctgtggtga

SEQ ID NO: 14602 - RNA, 9876 nt, synthetic construct
  misc_feature 1..9876: note = derived and/or modified CDS sequence (opt3) from DENV-2__FJ687440__SS-prME
  source 1..9876: mol_type = other RNA
agcgccggaatgatcattatgctgataccaaccgtgatggctttccacctcactactagaaacggggaacctcatatgatcgtcggtattcaagaaaagggtaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatggatcacctatggaacttgtacaaccacgggcgagcaccggcgcgaaaagcgaagtgtggccctggtaccccatgtgggtatggggcttgagactcgtaccgaaacatggatgagctccgagggagcgtggaaacacgctcagagaatagagacttggatcctgaggcatcctggcttcaccattatggccgcaatcttggcctacacaattggcaccacgcactttcagcgggctctcatcttcatactgctgactgcagtcgccccatctatgacaatgcgctgcattgggatctcgaacagagattttgtggaaggagtttcaggtggcagctgggtggacattgtcctcgagcacgggagttgtgtgaccactatggctaagaataagcccacattagatttcgaactgatcaaaaccgaggccaagcagcctgcgacgcttaggaaatattgcatcgaagcaaagttgaccaacacaactaccgagtcccggtgtccaacacaaggagagccctctctgaaagaagaacaagacaagcgctttgtttgcaagcatagcatggttgatcgaggctggggtaatgggtgtggactattcggcaaaggcgggattgtgacttgcgccatgtttacctgcaagaaaaacatggaaggaaagatagtccagcctgagaatctcgaatacacaatcgtggtgaccccacactccggtgaggagcatgctgtcggcaacgacactgggaaacacggaaaggaaattaaagttacgccgcagtcaagtatcacagaggccgaactgaccggctatggtactgtgaccatggagtgtagccccagaacagggcttgatttcaatgaaatggtactgttgcaaatggagaacaaggcatggctcgtgcacaggcagtggtttctggacttacctctgccatggctccccggcgctgataagcagggatctaattggatacagaaagagacccttgtcactttcaagaaccctcatgccaaaaagcaagacgtggttgtgctgggctcccaggaaggggcgatgcacacagccttgacgggagcaaccgagattcagatgtcaagcggtaatctactgtttactggccatctcaaatgccggctgcgtatggacaaacttcaactgaaggggatgagttactctatgtgtacaggaaaattcaaggtcgtgaaagaaatcgctgagacccagcacggcacaatcgtaattcgcgttcagtatgagggtgatgggtccccatgcaagatccccttcgaaattatggacttggagaaaagatacgtgctcggcaggctgataactgtcaacccgatcgtgaccgaaaaggatagccctgtcaacattgaggccgaacccccatttggagactcgtacatcatcattggcgtggagcctgggcagttaaagctgaattggttcaaaaagggatcttccataggtcaaatgtttgagacgaccatgcggggcgctaaacgaatggccatcctaggggatacagcatgggacttcggatcactcggcggtgtttttacaagtattgggaaggccctgcatcaggtgttcggcgctatctatggagcggcatttagcggcgtatcctggaccatgaaaattcttatcggggtcataatcacatggattggaatgaactctcgcagcacttcattgagtgtgtccctggttctcgtgggcatcgtcaccctgtaccttggtgtgatggtacaggccgatagcgggtgtgtggtttcttggaagaataaggaactgaaatgcggatcaggcattttcatcacggacaacgtccacacatggaccgagcagtataagtttcaacccgaaagtccaagcaaattggcttccgccatacagaaggcacaggaggaaggtatttgtggcatcagatctgtgactaggctcgagaatctgatgtggaaacagattacacccgagttaaaccacatcctggccgaaaatgaggtgaagctaaccataatgactggggatatcaaaggaattatgcaagctggcaagcggtcgctccgccctcagccaaccgaactgaagtacagctggaaaacatgggggaaggccaaaatgctttccacggagtcacataaccagaccttcttgatcgacggaccggaaactgcagagtgccccaatacaaacagagcgtggaatagtctggaggtcgaagattatggctttggtgttttcaccacaaacatttggctcaagctgaaagagaagcaggacgctttttgtgactctaagttaatgagcgccgcaatcaaagataatagggccgtgcacgctgacatggggtactggatagaatccgccctgaacgatacttggaagattgagaaagcatcattcatcgaggtgaagaattgccattggcctaaaagccacaccctttggtctaacggagtattggaatccgagatgatcattccaaagaacctcgctggccccgtcagtcaacacaattatcgtcctggttaccatacgcagatcgccggcccatggcacctggggaagctagaaatggacttcgatttttgtgacggaacaaccgtgattgttactgaggattgcggcaaccgggggcccagcctgcgaaccacaactgcgtctggaaaactcataaccgaatggtgctgtagatcctgcacactgccgcctcttaggtaccgcggcgaggacggttgttggtatgggatggagatccggccattgaaggaaaaagaggaaaatctggtgaactcattagtcacggccggacatggccaggtggataatttcagtctcggtgttctgggcatggctctttttctggaggaaatgttgagaaccagggtggggactaagcacgcaattctcctggtagccgtcagcttcgtgacactaatcaccggaaacatgtcgtttaaagacctgggccgcgtggtcgttatggtgggggctactatgacagatgacattggaatgggcgtaacctacctcgccctgcttgcagcgttcaaggtgcgacccacgtttgccgctggtttgctgttacggaagctcacttccaaagagctgatgatgaccacaatcgggatagtccttctgtctcaaagcaccatccctgagactattctagaactcacagatgccctggcattgggaatgatggtgctgaagatcgttcgtaatatggagaaatatcagttagctgtgaccattatggccatcctctgcgtccccaacgcagtgatactgcagaatgcctggaaggtttcatgtacaattcttgctgtggtcagtgtatccccactgttgctcacttctagccagcagaagaccgactggatccctctggcgctaacgatcaagggcctgaaccccacagccattttccttaccactctctccagaaccaataaaaagaggtcatggccactgaacgaagcaataatggctgtgggcatggttagcatcttggccagttctctgttaaagaatgacattccgatgacagggcctctcgtggccggaggtctgcttactgtctgctacgtgctgaccggccgctccgctgatttggagctcgaacgggcaacggacgtaaaatgggaggatcaggccgagatcagcgggtcgtcacccattctgtctatcacaataagtgaagacggatccatgagcatcaagaacgaggaagaggagcagaccctaactattctgatcagaacaggccttctcgtgatttctggtctgtttccagtcagcatccccataaccgcggctgcctggtatttgtgggaagttaaaaagcagagggcaggggtgttatgggatgtgccttccccaccccctatgggaaaagccgagctggaagacggcgcttaccgaattaagcaaaagggcatcctcgggtattcacagatcggagcaggagtctacaaagagggcactttccatacaatgtggcacgtgacccgcggggccgttctgatgcacaagggaaaacggattgaaccgagttgggcggatgtaaagaaagaccttatcagctacggcggtgggtggaagctggagggagagtggaaggaaggcgaggaagtgcaggtcttggctctagagccaggcaaaaatcccagagccgtgcagacgaagcctgggctgtttaaaactaacaccggaacaataggtgcagtttctctcgatttctccccaggcacctcagggagtcccattatcgacaagaaaggaaaggtggtcggcctgtatggtaacggggtggtaacaaggagcggagcctacgtctccgctattgcccaaactgaaaagtctatcgaggataatcctgagatagaagacgatatttttcgtaaacgccggcttaccatcatggacttacatccgggcgcaggcaagacgaaaagatatctgcccgctatcgtgagggaggccattaagcgagggctccggacattgatcctggcgccaactcgcgttgtggccgcagaaatggaggaagctctcagaggactgcctattaggtaccagacccccgccatacgggctgagcacacaggtcgagagatcgtcgaccttatgtgtcatgcaaccttcactatgagactgttgtcgccagtgcgcgttcctaactataatctaattatcatggatgaagcccacttcaccgaccccgccagcatcgctgcgaggggctacatttcaacacgtgtggagatgggggaagcagccggaatatttatgacggctactccaccgggctcccgggatcctttcccccagagtaacgccccaatcattgacgaggagagagaaatccccgagaggtcttggaatagcggtcatgaatgggtcaccgattttacagggaaaaccgtgtggttcgtaccttccattaaggcaggaaacgacatcgccgcttgcctgcgcaagaatggcaaaaaggtgatacaactctcacgaaaaacttttgattctgagtatgttaagacaagaaccaacgactgggatttcgtcgtgacgactgacatcagcgaaatgggcgcgaattttaaagccgagcgggtgattgatccaaggcgctgtatgaagcccgtcatcttaacagacggggaggaacgtgtaattctggcaggacctatgccggtgacccacagttccgctgcccagagacggggtaggatcggccgcaaccccaagaatgagaacgaccagtacatatacatgggggaaccccttgagaatgatgaagactgcgcacactggaaggaggccaagatgctgctcgataacattaatacccctgagggaatcattcccagcatgttcgaaccagagcgagaaaaagttgacgctatcgatggcgagtatagattgcggggtgaagccaggaagacttttgtggacctgatgcgcagaggggatctccctgtctggctggcgtacaaagtggcagccgagggcataaactatgctgacaggcggtggtgtttcgatggaatcaagaacaatcagattcttgaggaaaacgttgaggtggaaatctggacaaaagagggcgagcgtaagaagctaaaaccccgctggctggacgcccgaatttactctgatccattggctttaaaggaatttaaagagttcgcagccgggagaaagtcactgaccctcaatctgatcacagaaatgggaaggcttcctactttcatgacgcagaaaacccgggacgctctggataacctcgccgtcttgcatacagcagaggcgggtggccgcgcctataatcacgctctgtccgaactaccggagactctggagaccctccttctgttaacattgctggccaccgtgactgggggaatatttctcttcctgatgagtggcagaggtattgggaagatgacgcttggcatgtgctgcatcatcaccgcaagcattctgctctggtacgctcagatccagccccattggatagccgcatcgattatcttggaatttttcctgattgtattactaatcccagagcctgaaaagcagaggacaccccaagacaaccagctgacttatgtggttatagccatcctcaccgtcgtggctgcgacaatggccaatgagatgggatttcttgagaaaaccaagaaagacctgggcttggggtctattgcaactcagcagccagagtccaacatcctggatattgacctccggcctgctagcgcctggacactgtacgccgtggcaacgaccttcgtcactcccatgcttcgacactcaatcgagaatagttctgttaacgtgtccctcacagctattgccaatcaagcgaccgtactgatgggattgggtaagggctggccgctgagcaaaatggatatcggggtgccattactagctataggatgttactcacaggtcaaccctattaccctgacagccgcactccttctgttggtggcccactatgctatcatcggccccggtctgcaggcaaaggccactagagaagcgcagaagcgcgctgccgcagggattatgaaaaatccaacggttgacggcataaccgtgatcgatctcgaccccattccttacgatccgaagtttgagaaacaactgggacaggtcatgcttttaatcctgtgcgtaacacaggtgctcatgatgaggactacctgggccttgtgtgaagctctgacactagccaccggccccattagtactctgtgggaggggaacccaggacggttctggaatacgacaatcgcagttagcatggctaacatatttcgtggctcctatctcgccggtgcggggcttctgttctctatcatgaagaataccactaacaccagaaggggaacaggcaacattggtgaaactttgggcgagaaatggaaaagccgcctgaatgccctcgggaaatccgagtttcaaatctacaagaagtcaggcattcaggaagtggaccggaccctggcaaaagagggcatcaagcgaggggaaacagatcatcacgctgtctctagaggaagtgccaaattaaggtggttcgtggagcgcaacatggtcacgcctgagggcaaggtggttgaccttggttgcgggcggggaggctggtcgtattactgtggtggcctgaaaaatgtgagagaagtaaaggggctcaccaagggaggccccgggcatgaggaacctataccaatgagcacttatggatggaacctagtgcgtctgcagtccggcgtcgatgtatttttcattccccctgagaaatgcgacacattgctgtgtgatatcggtgaatcttcaccaaatcccaccgtggaggcagggaggactctccgggtccttaacctggtggagaattggttgaacaataacacacagttctgcatcaaggtactgaatccgtacatgcctagcgtgattgagaaaatggaggctctccaacgcaagtacggaggcgccttagttcgaaacccactgtccagaaatagtacccacgaaatgtattgggtgtctaacgccagcggcaatatagtctcatccgtgaacatgatcagtaggatgcttattaaccggtttacgatgcgccataaaaaggcgacctacgagcccgacgtcgacctggggagcggaacaagaaatatcggtattgaatctgagatccctaacctagatataatcggcaagaggattgagaaaatcaagcaggaacacgagacttcctggcactatgaccaggatcatccatacaaaacctgggcttatcacgggtcatacgaaacaaagcagactggaagcgcatcgtctatggtgaatggcgttgtacgactcctgaccaaaccctgggacgtgttgccgacagtcacccaaatggccatgactgatacgacacctttcggtcagcagcgggtgtttaaggagaaggttgacacccgtactcaggaacccaaagaggggaccaagaaactgatgaagattacagctgagtggctctggaaagaacttggaaagaaaaagacgccaagaatgtgtacccgcgaggagttcactaggaaggtgcggagtaacgccgcactgggcgccatctttacagatgagaataaatggaagtccgctagagaggcggtcgaagacagccgcttctgggagttagtggataaagaaaggaacctgcatttggagggcaagtgcgaaacctgtgtatataatatgatggggaaacgagagaagaagctcggagagtttggtaaagccaagggctcacgggcaatttggtacatgtggctgggggctagattcctagaatttgaggcccttggattcctgaacgaagaccactggttttccagggaaaattctctcagcggcgtggaaggtgaggggctgcacaaattgggatacatactgcgcgatgttagtaagaaagagggcggcgcaatgtatgccgacgacactgctgggtgggatacacgtatcaccctcgaagaccttaagaacgaggaaatggtcacaaatcatatggagggagaacacaagaaactggccgaggcgattttcaagttaacttaccaaaacaaagtggtgcgggtccagagacctacccccaggggtacggttatggatatcatctcccgccgagaccagcggggcagcgggcaagtgggaacctatggcctgaatacatttactaacatggaggcacagttgattagacagatggaaggtgagggggtattcaagaatatacagcatctcaccgccacagaagagatcgctgtgcaaaactggctggccagggtcggacgcgagagactatctcggatggcaatttcaggcgatgactgcgtggttaaaccacttgatgacaggttcgctaacgccctgactgctctcaatgatatgggcaagatccgtaaggacattcagcagtgggaacccagtaaagggtggaacgattggacccaggtgcctttttgctcccaccatttccacgagctgatcatgaaggacggacgagtcttggtggtaccatgtcgcaatcaagatgaattaataggtagagcccggatcagccagggcgcagggtggtctctgagggagacggcgtgcctcggaaaatcgtacgcccagatgtggtcacttatgtattttcaccgcagagacctgcggctagctgccaacgcaatttgtagcgctgttccgtcccattgggtgcccacaagtaggaccacttggtctatccacgccaagcatgaatggatgacaaccgaggacatgctgactgtctggaatcgagtgtggattcgtgagaacccttggatggaagataaaaccccagtggagagctgggaagagatcccctacctcggcaagagagaagaccagtggtgcggttccttgatagggctgacatcacgcgcaacgtgggccaagaatattcaagcggctatcaaccaggtccggagtcttattggaaatgaggagtataccgattacatgccttctatgaaaaggttcagacgcgaagaggaagaggccggcgttctgtggtga

SEQ ID NO: 14603 - RNA, 9876 nt, synthetic construct
  misc_feature 1..9876: note = derived and/or modified CDS sequence (opt3) from DENV-2__FJ687441__SS-prME
  source 1..9876: mol_type = other RNA
agcgccggaatgatcattatgctgatacccaccgtgatggctttccacctcaccactagaaacggggagcctcatatgatcgtcggtattcaagaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatggatcacctatggaacttgtacaaccacgggcgagcaccggcgcgaaaagcgaagtgtggccctggtaccccatgtgggtatggggcttgagactcgtaccgaaacatggatgagctccgagggagcgtggaaacacgctcagagaatagagacttggatcctgaggcatcctggcttcaccattatggccgcaatcttggcctacacaattggcaccacgcactttcagcgggctctcatcttcatactgctgactgcagtcgccccatctatgacaatgcgctgcattgggatctcgaacagagattttgtggaaggagtttcaggtggcagctgggtggacattgtcctcgagcacgggagttgtgtgaccactatggctaagaataagcccacattagatttcgaactgatcaaaaccgaggccaagcagcctgcgacgcttaggaaatattgcatcgaagcaaagttgaccaacacaactaccgagtcccggtgtccaacacaaggagagccctctctgaaagaggaacaggacaagcgctttgtttgcaagcatagcatggttgatcgaggctggggtaatgggtgtggactattcggcaaaggcgggattgtgacttgcgccatgtttacctgcaagaaaaacatggaaggaaagatagtccagcctgagaatctcgaatacacaatcgtggtgaccccacactccggtgaggagcatgctgtcggcaacgacactgggaaacacggaaaggaaattaaagttacgccgcagtcaagtatcacagaggccgaactgaccggctatggtactgtgaccatggagtgtagccccagaacagggcttgatttcaatgaaatggtactgttgcaaatggagaacaaggcatggctcgtgcacaggcagtggtttctggacttacctctgccatggctccccggcgctgataagcagggatctaattggatacagaaagagacccttgtcactttcaagaaccctcatgccaaaaagcaagacgtggttgtgctgggctcccaggaaggggcgatgcacacagccttgacgggagcaaccgagattcagatgtcaagcggtaatctactgtttactggccatctcaaatgccggctgcgtatggacaaacttcaactgaaggggatgagttactctatgtgtacaggaaaattcaaggtcgtgaaagaaatcgctgagacccagcacggcacaatcgtaattcgcgttcagtatgagggtgatgggtccccatgcaagatccccttcgaaattatggacttggagaaaagatacgtgctcggcaggctgataactgtcaacccgatcgtgaccgaaaaggatagccctgtcaacattgaggccgaacccccatttggagactcgtacatcatcattggcgtggagcctgggcagttaaagctgaattggttcaaaaagggatcttccataggtcaaatgtttgagacgaccatgcggggcgctaaacgaatggccatcctaggggatacagcatgggacttcggatcactcggcggtgtttttacaagtattgggaaggccctgcatcaggtgttcggcgctatctatggagcggcatttagcggcgtatcctggaccatgaaaattcttatcggggtcataatcacatggattggaatgaactctcgcagcacttcattgagtgtgtccctggttctcgtgggcatcgtcaccctgtaccttggtgtgatggtacaggccgatagcgggtgtgtggtttcttggaagaataaggaactgaaatgcggatcaggcattttcatcacggacaacgtccacacatggaccgagcagtataagtttcaacccgaaagtccaagcaaattggcttccgccatacagaaggcacaggaggaaggtatttgtggcatcagatctgtgactaggctcgagaatctgatgtggaaacagattacacccgagttaaaccacatcctggccgaaaatgaggtgaagctaaccataatgactggggatatcaaaggaattatgcaagctggcaagcggtcgctccgccctcagccaaccgaactgaagtacagctggaaaacatgggggaaggccaaaatgctttccacggagtcacataaccagaccttcttgatcgacggaccggaaactgcagagtgccccaatacaaacagagcgtggaatagtctggaggtcgaagattatggctttggtgttttcaccacaaacatttggctcaagctgaaagagaagcaggacgctttttgtgactctaagttaatgagcgccgcaatcaaagataatagggccgtgcacgctgacatggggtactggatagaatccgccctgaacgatacttggaagattgagaaagcatcattcatcgaggtgaagaattgccattggcctaaaagccacaccctttggtctaacggagtattggaatccgagatgatcattccaaagaacctcgctggccccgtcagtcaacacaattatcgtcctggttaccatacgcagatcgccggcccatggcacctggggaagctagaaatggacttcgatttttgtgacggaacaaccgtgattgttactgaggattgcggcaaccgggggcccagcctgcgaaccacaactgcgtctggaaaactcataaccgaatggtgctgtagatcctgcacactgccgcctcttaggtaccgcggcgaggacggttgttggtatgggatggagatccggccattgaaggaaaaagaggaaaatctggtgaactcattagtcacggccggacatggccaggtggataatttcagtctcggtgttctgggcatggctctttttctggaggaaatgttgagaaccagggtggggactaagcacgcaattctcctggtagccgtcagcttcgtgacactaatcaccggaaacatgtcgtttaaagacctgggccgcgtggtcgttatggtgggggctactatgacagatgacattggaatgggcgtaacctacctcgccctgcttgcagcgttcaaggtgcgacccacgtttgccgctggtttgctgttacggaagctcacttccaaagagctgatgatgaccacaatcgggatagtccttctgtctcaaagcaccatccctgagactattctagaactcacagatgccctggcattgggaatgatggtgctgaagatcgttcgtaatatggagaaatatcagttagctgtgaccattatggccatcctctgcgtccccaacgcagtgatactgcagaatgcctggaaggtttcatgtacaattcttgctgtggtcagtgtatccccactgttgctcacttctagccagcagaagaccgactggatccctctggcgctaacgatcaagggcctgaaccccacagccattttccttaccactctctccagaaccaataaaaagaggtcatggccactgaacgaagcaataatggctgtgggcatggttagcatcttggccagttctctgttaaagaatgacattccgatgacagggcctctcgtggccggaggtctgcttactgtctgctacgtgctgaccggccgctccgctgatttggagctcgaacgggcaacggacgtaaaatgggaggatcaggccgagatcagcgggtcgtcacccattctgtctatcacaataagtgaagacggatccatgagcatcaagaacgaggaagaggagcagaccctaactattctgatcagaacaggccttctcgtgatttctggtctgtttccagtcagcatccccataaccgcggctgcctggtatttgtgggaagttaaaaagcagagggcaggggtgttatgggatgtgccttccccaccccctatgggaaaagccgagctggaagacggcgcttaccgaattaagcaaaagggcatcctcgggtattcacagatcggagcaggagtctacaaagagggcactttccatacaatgtggcacgtgacccgcggggccgttctgatgcacaagggaaaacggattgaaccgagttgggcggatgtaaagaaagaccttatcagctacggcggtgggtggaagctggagggagagtggaaggaaggcgaggaagtgcaggtcttggctctagagccaggcaaaaatcccagagccgtgcagacgaagcctgggctgtttaaaactaacaccggaacaataggtgcagtttctctcgatttctccccaggcacctcagggagtcccattatcgacaagaaaggaaaggtggtcggcctgtatggtaacggggtggtaacaaggagcggagcctacgtctccgctattgcccaaactgaaaagtctatcgaggataatcctgagatagaagacgatatttttcgtaaacgccggcttaccatcatggacttacatccgggcgcaggcaagacgaaaagatatctgcccgctatcgtgagggaggccattaagcgagggctccggacattgatcctggcgccaactcgcgttgtggccgcagaaatggaggaagctctcagaggactgcctattaggtaccagacccccgccatacgggctgagcacacaggtcgagagatcgtcgaccttatgtgtcatgcaaccttcactatgagactgttgtcgccagtgcgcgttcctaactataatctaattatcatggatgaagcccacttcaccgaccccgccagcatcgctgcgaggggctacatttcaacacgtgtggagatgggggaagcagccggaatatttatgacggctactccaccgggctcccgggatcctttcccccagagtaacgccccaatcattgacgaggagagagaaatccccgagaggtcttggaatagcggtcatgaatgggtcaccgattttaaagggaagacagtgtggttcgtaccttccattaaggcaggaaacgacatcgccgcttgcctgcgcaaaaatggcaagaaagtgatacaactctcacgaaagacctttgattctgagtatgttaaaactagaacaaacgactgggatttcgtcgtgaccacggacatcagcgaaatgggcgcgaattttaaggccgagcgggtgattgatccaaggcgctgtatgaaacccgtcatcttaactgacggggaggaacgtgtaattctggcaggacctatgccggtgacacacagttccgctgcccagagacggggtaggatcggccgcaacccaaagaatgagaacgaccagtacatatacatgggggaaccccttgagaatgatgaagactgcgcacactggaaggaggccaaaatgctgctcgataacattaatacccctgagggaatcattcccagcatgttcgaaccagagcgagaaaaggttgacgctatcgatggcgagtatagattgcggggtgaagccaggaaaacctttgtggacctgatgcgcagaggggatctccctgtctggctggcgtacaaggtggcagccgagggcataaactatgctgacaggcggtggtgtttcgatggaatcaaaaacaatcagattcttgaggaaaacgttgaggtggaaatctggactaaggagggcgagcgtaagaaactaaagccccgctggctggacgcccgaatttactctgatccattggctttaaaagaatttaaggagttcgcagccgggagaaaatcactgacactcaatctgatcaccgaaatgggaaggcttcctacattcatgactcaaaagacgcgggacgctctggataacctcgccgtcttgcataccgcagaggcgggtggccgcgcctataatcacgctctgtccgaactaccggagacactggagactctccttctgttaaccttgctggccacagtgaccgggggaatatttctcttcctgatgagtggcagaggtattgggaagatgactcttggcatgtgctgcatcatcacggcaagcattctgctctggtacgctcagatccagccccattggatagccgcatcgattatcttggaatttttcctgattgtattactaatcccagagcctgaaaaacagaggacaccccaagacaaccagctgacatatgtggttatagccatcctcactgtcgtggctgcgaccatggccaatgagatgggatttcttgaaaagactaaaaaggacctgggcttggggtctattgcaacccagcagccagagtccaacatcctggatattgacctccggcctgctagcgcctggactctgtacgccgtggcaacaacgttcgtcacccccatgcttcgacactcaatcgagaatagttctgttaacgtgtccctcactgctattgccaatcaagcgacagtactgatgggattgggtaaaggctggccgctgagcaagatggatatcggggtgccattactagctataggatgttactcacaggtcaaccctattaccctgaccgccgcactccttctgttggtggcccactatgctatcatcggccccggtctgcaggcaaaggccacaagagaagcgcagaaacgcgctgccgcagggattatgaagaatccaactgttgacggcataacggtgatcgatctcgaccccattccttacgatccgaaatttgagaagcaactgggacaggtcatgcttttaatcctgtgcgtaacccaggtgctcatgatgaggacaacttgggccttgtgtgaagctctgaccctagccacaggccccattagtaccctgtgggaggggaacccaggacggttctggaatactacgatcgcagttagcatggctaacatatttcgtggctcctatctcgccggtgcggggcttctgttctctatcatgaaaaatacaaccaacactagaaggggaaccggcaacattggtgaaacattgggcgagaagtggaaaagccgcctgaatgccctcgggaagtccgagtttcaaatctacaagaaatcaggcattcaggaagtggaccggactctggcaaaggagggcatcaaacgaggggaaaccgatcatcacgctgtctctagaggaagtgccaagttaaggtggttcgtggagcgcaacatggtcacacctgagggcaaagtggttgaccttggttgcgggcggggaggctggtcgtattactgtggtggcctgaagaatgtgagagaagtaaaggggctcacgaaaggaggccccgggcatgaggaacctataccaatgagcacctatggatggaacctagtgcgtctgcagtccggcgtcgatgtatttttcattccccctgagaagtgcgacactttgctgtgtgatatcggtgaatcttcaccaaatcccacagtggaggcagggaggaccctccgggtccttaacctggtggagaattggttgaacaataacactcagttctgcatcaaagtactgaatccgtacatgcctagcgtgattgaaaagatggaggctctccaacgcaaatacggaggcgccttagttcgaaacccactgtccagaaatagtacacacgaaatgtattgggtgtctaacgccagcggcaatatagtctcatccgtgaacatgatcagtaggatgcttattaaccggtttaccatgcgccataagaaggcgacgtacgagcccgacgtcgacctggggagcggaaccagaaatatcggtattgaatctgagatccctaacctagatataatcggcaaaaggattgagaagatcaaacaggaacacgagacatcctggcactatgaccaggatcatccatacaagacttgggcttatcacgggtcatacgaaaccaaacagacaggaagcgcatcgtctatggtgaatggcgttgtacgactcctgactaagccctgggacgtgttgccgaccgtcacacaaatggccatgaccgatactacgcctttcggtcagcagcgggtgtttaaggagaaagttgacacacgtacccaggaacccaaggaggggactaaaaagctgatgaaaattaccgctgagtggctctggaaggaacttggcaaaaagaagacaccaagaatgtgtacgcgcgaggagttcaccaggaaagtgcggagtaacgccgcactgggcgccatctttactgatgagaataagtggaaatccgctagagaggcggtcgaagacagccgcttctgggagttagtggataaggaaaggaacctgcatttggagggcaaatgcgaaacatgtgtatataatatgatggggaagcgagagaagaaactcggagagtttggtaaggccaaaggctcacgggcaatttggtacatgtggctgggggctagattcctagaatttgaggcccttggattcctgaacgaagaccactggttttccagggaaaattctctcagcggcgtggaaggtgaggggctgcacaagttgggatacatactgcgcgatgttagtaaaaaggagggcggcgcaatgtatgccgacgacaccgctgggtgggatactcgtatcacactcgaagaccttaagaacgaggaaatggtcaccaatcatatggagggagaacacaaaaagctggccgaggcgattttcaaattaacataccaaaacaaggtggtgcgggtccagagacctactcccaggggtaccgttatggatatcatctcccgccgagaccagcggggcagcgggcaagtgggaacgtatggcctgaatacctttacaaacatggaggcacagttgattagacagatggaaggtgagggggtattcaaaaatatacagcatctcactgccaccgaagagatcgctgtgcaaaactggctggccagggtcggacgcgagagactatctcggatggcaatttcaggcgatgactgcgtggttaagccacttgatgacaggttcgctaacgccctgacagctctcaatgatatgggcaagatccgtaaagacattcagcagtgggaacccagtaaggggtggaacgattggactcaggtgcctttttgctcccaccatttccacgagctgatcatgaaagacggacgagtcttggtggtaccatgtcgcaatcaagatgaattaataggtagagcccggatcagccagggcgcagggtggtctctgagggagaccgcgtgcctcggaaagtcgtacgcccagatgtggtcacttatgtattttcaccgcagagacctgcggctagctgccaacgcaatttgtagcgctgttccgtcccattgggtgcccacgagtaggacaacctggtctatccacgccaaacatgaatggatgactacagaggacatgctgaccgtctggaatcgagtgtggattcgtgagaacccttggatggaagataagactccagtggagagctgggaagagatcccctacctcggcaagagagaagaccagtggtgcggttccttgatagggctgacctcacgcgcaacatgggccaaaaatattcaagcggctatcaaccaggtccggagtcttattggaaatgaggagtatacggattacatgccttctatgaagaggttcagacgcgaagaggaagaggccggcgttctgtggtga

SEQ ID NO: 14604 - RNA, 9876 nt, synthetic construct
  misc_feature 1..9876: note = derived and/or modified CDS sequence (opt3) from DENV-2__FJ687445__SS-prME
  source 1..9876: mol_type = other RNA
agcgtgggcatgatcattatgctgatccccaccgtcatggccttccacctcaccactagaaacggggagcctcatatgatcgtttccattcaggaaaagggaaagtctcttctgtttaagacggaggacggtgtgaatatgtgcaccttgatggctatggatttaggcgaactgtgtgaggacacaatcacttacaaatgcccactactcaggcaaaacgaaccggaggatattgactgttggtgcaattcaaccagtacatgggtaacctatgggacttgtacaaccacgggagagcaccggcgcgaaaagcgaagcgtggcactggtcccccatgtgggcatgggtcttgagactcgtaccgaaacatggatgtcctctgagggggcctggaaacacgcgcagagaatcgagacttggatactgaggcatcctggattcaccatcatggctgccattttggcatacacaatcggcaccacgcactttcagcggactctcattttcatcctgctgacagccgttgctccatcgatgaccatgcgctgcataggcatttcaaacagagattttgtggaaggggtcagcggaggtagttgggtggacatcgtactcgagcacggctcctgtgttactacaatggcaaagaataagcccaccttagatttcgaactgattaaaacggaggccaagcagcctgctacccttaggaaatattgcatcgaagccaagttgacaaacactaccacagagtctcggtgtccaactcaaggggagcccagcctgaaagaagaacaggacaagcgctttgtgtgcaagcattccatggtcgatcgaggatggggcaatggttgtgggctattcggaaaaggcggcatcgtgacctgcgcgatgtttacatgcaagaaaaacatggaagggaagattgtgcagcctgagaatctcgaatacaccatagtcgttactccacactcaggagaggagcatgcagtgggtaacgacacgggcaaacacgggaaggaaatcaaagtaacaccgcagagtagcattaccgaggccgaactgactggatatggcaccgtgacaatggagtgttctcccagaaccggtcttgatttcaatgaaatggtcctgttgcaaatggagaacaaggcttggctcgtgcacaggcagtggtttctggacttacctctgccatggctccccggggccgatactcagggctccaattggatccagaaggagacacttgttacgttcaaaaaccctcatgcaaagaaacaagacgtggtcgtgctgggatcacaggaaggcgctatgcacaccgccttgactggggcgacagagatacagatgagcagtggaaatctactgtttaccggtcatctcaagtgccggctgcgtatggacaaacttcaactgaagggcatgtcttactccatgtgtacagggaagttcaaagtagttaaggaaattgccgagactcagcacggaaccatcgtgatccgcgtccagtatgagggcgatggtagcccatgcaaaattcccttcgaaatcatggacttggagaagagatacgtgctcgggaggctgattacggtcaacccgatagtgaccgaaaaagattcgcctgttaacatcgaggcagaacccccatttggcgactcttacattatcatcggagtggagcctggccagttaaagctgaattggttcaagaaagggtcctcaattggacaaatgtttgagacaactatgcggggtgctaagcgaatggccatactaggcgataccgcttgggacttcgggagtctcggaggcgtatttacaagcatcggtaaagccctgcatcaggtcttcggggcaatttatggcgccgctttttccggagtgtcttggactatgaagatccttattggcgttatcataacctggatcgggatgaacagccgctcaacgagtttgtccgtgagcctggtcctcgtgggagtagtgacactgtaccttggcgttatggtccaggcggattctggttgtgtggtgtcatggaaaaataaggaactgaagtgcgggagtggaattttcatcaccgacaacgtccacacttggacagagcagtataaatttcaacccgaaagcccatccaagttggcatctgccattcagaaagctcaggaggaaggcatctgtggtataagatcggttaccaggctcgagaatctgatgtggaagcagattactcccgagttaaaccacatcctggccgaaaatgaggtgaaactaaccattatgacaggcgatatcaaggggataatgcaagcaggaaaacggagcctccgccctcagccaacggaactgaagtactcctggaagacctggggcaaagccaagatgctttcaactgagagtcataaccagacattcttgatcgacgggccggaaaccgctgagtgccccaatacaaacagagcctggaactctctggaggtggaagattatggatttggcgtattcactaccaacatttggctcaaactgaaggagaaacaggacgcattttgtgacagcaagttaatgtccgcggctatcaaggataatagggccgtccacgcagacatgggttactggattgaatcagccctgaacgatacgtggaaaatcgagaaggctagcttcatagaggtgaaaaattgccattggcctaagtctcacacactttggtccaacggggttttggaaagtgagatgattatccccaagaatctcgccggacccgtgagccaacacaattatcgtcctggctaccatacccagatcgcaggtccatggcacctgggcaagctagaaatggacttcgatttttgtgacgggactaccgtcgtggttacagaggattgcggaaaccggggcccctctctgcgaactaccacagcttccgggaagctcattacggaatggtgctgtagatcatgcaccctgccgcctcttaggtaccgcggagaggacggctgttggtatggtatggagatccggccattgaaagaaaaggaggaaaatctggtgaacagtttagtaactgccgggcatggacaggtcgataatttcagcctcggcgtgctgggtatggcgctttttctggaggaaatgttgagaacaagggtgggcaccaaacacgccattctcctggtcgctgtttcgttcgtgactctaataacagggaacatgtcctttaaggacctgggacgcgtagtggtcatggtgggcgcaaccatgacggatgacatcgggatgggagttacttacctcgccctgcttgctgccttcaaagtgcgacccacctttgcagcgggcttgttcctgcggaagttaacatctaaggagctcatgatgaccactattggtatcgtcctgcttagccaatcaacaattcctgagaccatcctggaactaacagatgccctcgctctggggatgatggtgttgaaaatggttcgtgacatggagaagtatcagctggccgtgactataatggcaatcttatgcgtccccaatgctgtaattctccagaacgcctggaaagtgagttgtaccatcctggcagttgtgtccgtctctccacttctgttgacgagctcccagcaaaagacagactggattcctctcgccctgaccatcaaaggactaaatcccactgctatatttctgaccacactttcaagaactaacaagaaaaggagctggccactcaatgaagcgattatggccgtgggcatggtaagtatcctggcatcttccttgctgaagaacgatatcccgatgaccggccctttagtggctgggggactcctgacggtctgctacgttcttacaggtcgcagcgccgacctggagttggaacgggccaccgatgtgaagtgggaggaccaggctgagatttcgggctcatctcccatactcagtatcactatttccgaagatgggagcatgtctatcaaaaatgaggaagaggagcagacactgaccattctaatcagaactggactgcttgtgataagcggcctcttcccagtctccatccccattacagcagccgcgtggtatctgtgggaagtgaagaaacagagggctggtgttttgtgggacgtaccttcaccaccccctatggggaaggccgagttagaagatggagcataccgaatcaaacaacgcggcattctgggctatagtcagatcggggccggagtgtacaaggagggtacctttcatacgatgtggcacgtcactcggggcgctgtgctcacccacaaggggaaaagaatagaaccgagctgggcagacgttaagaaagatctgatttcttacggaggcggttggaaacttgagggggagtggaaagaaggagaggaagtgcaggtcctggccttggagccaggcaagaaccccagggcggtgcagacaaagcctggcctattcaaaaccaatacagggactatcggagctgtatccctggacttttcaccaggtaccagtggcagccccatcattgataagaaagggaaggtcgtgggactctatggcaacggtgttgtgacgcgttccggggcctacgtctctgcaatcgcccaaacagaaaaatcgatagaggacaaccctgatattgaggacgacatcttccgcaagcggagactgactattatggatcttcatccgggagctggcaagaccaaaaggtatttacccgccatcgtgcgagaagcaataaagcggggcctgcgcacactcattttggctccaaccagagttgtggccgcggagatggaagaggccctgagggggctccctatccggtaccagactcccgcaatccgagctgaacacaccggaagagagattgtcgacctgatgtgtcatgccacattcacgatgcgccttctgagcccagtgagggtacctaattataacttgatcattatggatgaggctcactttactgaccccgcatcaatagccgcccgtggttacatctccacccgggtggaaatgggcgaggctgcggggattttcatgacagcaaccccaccgggaagtagagatccttttccccagtctaatgccccaatcatcgacgaagagagggagattcccgaacgcagctggaactccggccatgagtgggttactgatttcaaaggtaagacagtctggtttgtgccttcaataaaagctgggaatgacatcgccgcatgcctacgaaagaacggaaagaaagtgattcaactgtctagaaagaccttcgatagcgaatatgtcaaaacgcggactaatgactgggattttgtagtgacaaccgacatcagtgagatgggcgccaacttcaaggctgaaagggttattgacccacgccgttgtatgaaacccgtgatcctcaccgatggcgaggagagagtcatattagcggggcctatgccggtgactcactccagcgccgcacagcggaggggacgcatcggtcgaaatccaaagaacgaaaatgaccagtacatttacatgggcgagcccctggaaaacgatgaggactgcgctcactggaaagaagccaagatgcttctggataatatcaacacacctgaggggattatcccctctatgtttgagccagaaagagagaaggttgacgcaatagatggagaatatcggctcaggggcgaggcccgcaaaaccttcgtggacttgatgagaaggggtgatctgcctgtctggctcgcttacaaggtggccgcggaagggattaattatgcagaccggcgttggtgttttgatggcatcaaaaacaaccagattctggaggagaatgtagaagtggagatctggacaaaggaaggagagcgcaagaaacttaaaccccgatggctagacgccagaatatactcagatccactggctttgaaagagttcaaggagttcgccgctggcaggaaatccttaactctgaacctcatcacggagatggggcggctgcctacctttatgacacaaaagactcgcgacgcacttgacaatctggccgttctccataccgctgaagccggaggtagagcatataaccacgcgttgagtgagctgccggaaacactagagaccctgctccttctgactttattggccacggtcaccggcgggattttcctgtttctcatgagcggaaggggcatcggtaaaatgacactggggatgtgctgcattgtgactgcttcgatccttctgtggtacgcccagatacagccccattggattgcagcttctatcatcctcgagttctttttgattgtgctgttaatcccagaacctgagaagcagcggacaccacaagataatcagctaacatatgtcgttatagccattctgaccgtggtagcagccactatggctaacgaaatgggcttcctcgagaagaccaagaaggaccttggactgggctccatcgcgacgcagcagccagaaagcaatattttggatatcgacctgcgacctgcctcagcatggaccctctacgctgtggccactacatttgtcacccccatgctgagacacagtatagagaactcttccgtgaatgttagccttaccgccatcgcaaaccaagctacagtgctcatggggctgggaaaaggttggccgttgtcaaagatggatattggcgccccactgttagcgatcgggtgttacagtcaggtcaatcctattactctaacggctgccctgctccttctggtagcacactatgccatcattggacccggcttgcaggctaaagcaacccgcgaggcccagaagagggcggctgccggtatcatgaagaacccaacagtggacgggataactgttattgatctggaccccatccctcatgatccgaaattcgaaaagcaactcggccaggtgatgctgcttgtcttatgcgtgacccaggtcctgatgatgcggacaacctgggcactctgtgaggccttgactctggctacgggacccatcagcacactatgggaaggcaatccagggcgtttttggaacaccactattgccgtgtccatggcaaatatattcagaggatcttacctggctggcgccggtctcctttttagcatcatgaaaaacaccacaaattccaggcgcgggactggaaacattggcgagaccctgggtgaaaagtggaaatcacggttgaacgcgctgggcaagtctgagttccaaatctataaaaagagtgggattcaggaggttgaccgaacactcgccaaggaaggaatcaaaagaggcgagacggatcaccatgcagtgtcgagggggagcgctaagctgcgctggtttgtagaacggaatatggtgacccctgagggaaaagtcgttgacttaggctgcggtagagggggatggtcctactattgtggcggtcttaagaacgtgcgtgaggtcaaaggcctgactaaagggggacccggccacgaagaacctataccaatgtctacatacgggtggaatctcgtgaggctacagtcaggagtagatgtgttcttcataccccctgaaaagtgcgacaccctgttgtgtgacattggcgagagctccccaaaccccactgttgaagccggtcggacactgcgcgtgctcaatcttgtcgagaactggctgaataacaatacccagttttgcatcaaagtgttgaacccgtatatgcctagtgtcattgagaagatggaaacgctgcaacgaaaatacgggggagcactcgtgagaaatccattatctaggaacagcacccatgagatgtactgggtttcaaatgcttccggcaacatcgtaagtagcgtgaatatgatatctcggatgctgattaaccgcttcacaatgagacacaagaaagccacttatgaacccgatgtcgaccttggctccgggaccaggaacatcggaatcgagtcagaaattcctaatctggatataatcggtaagcgaattgagaagatcaaacaggagcacgaaacaagctggcattacgaccaggatcacccatataagacttgggcctaccatggctcgtatgagaccaaacagacagggtctgcgagttccatggtgaacggagttgtgcggctactcaccaagccctgggacgtcctgccgactgtgacgcaaatggctatgacagataccactccttttggccagcagcgtgtattcaaagaaaaggtggacaccagaacacaggagcccaaggaaggtacgaaaaagttgatgaaaattaccgcagagtggctgtggaaggagctcgggaaaaagaaaactccacgcatgtgtacaagggaagagtttacccggaaggttagaagcaatgccgctcttggagccatcttcactgatgaaaacaagtggaaatcagcacgcgaggccgtcgaggactccaggttttgggaactggtggataaggagcgaaatttacacctggaaggcaaatgcgagacatgtgtgtacaacatgatgggcaagcgggagaagaagttgggggagttcggaaaggctaaaggttctagagcgatatggtatatgtggctcggcgccaggtttctggagttcgaagcactagggtttcttaatgaggaccactggttcagccgcgaaaacagtctgtccggagtcgagggcgaaggtctccatcgtctggggtacatcttgcgggacgttagcaagaaagagggaggcgctatgtacgccgatgacaccgcaggctgggatacaagaattactctggaggacctcaagaatgaagagatggtgaccaaccacatggaaggggagcataagaaacttgccgaagctatctttaaactgacgtatcaaaataaagtagtgagggtccagcgccctacaccccgaggaacagtgatggatattatctctcggagagaccagaggggttcaggccaagttgggacttacggattaaacaccttcacaaatatggaggcccagctgattcgccagatggagggcgaaggtgtgttcaagaacatacagcacttgactgtcaccgaggaaatcgcggtgcaaaattggctcgcaagagtagggcgggagaggctgagtcgtatggccatttccggagatgactgcgttgtgaaaccactagatgaccgatttgctagcgcccttacggcactgaacgatatgggcaagatccgcaaagacatccagcagtgggagccctctagaggctggaacgattggacacaggtccctttctgctcgcatcactttcacgaactcattatgaaggacgggcgggtgctggtggtcccatgtaggaatcaagacgagttgataggacgcgctagaatctcacagggtgccggctggagcttacgggaaaccgcttgcctggggaagtcctatgcccagatgtggagtctcatgtacttccataggcgagatcttcgtctggcagcgaacgccatttgttctgctgttccgagccactgggtgcccacttccagaacaacctggtcaatccatgccaaacacgagtggatgactaccgaagacatgctaacagtatggaatcgcgtgtggattcaggagaacccttggatggaggataagacgccagtcgaaagttgggaggaaatcccctatctgggaaaacgggaggaccaatggtgcggctctctcataggtttgaccagcagggcaacttgggctaagaatatccaggtggccattaaccaggttagatccctgatcgggaatgaagagtacacagattatatgccttcaatgaaacgctttcggagggaggaagaggaagcaggagtgctttggtga

SEQ ID NO: 14605 - RNA, 9876 nt, synthetic construct
  misc_feature 1..9876: note = derived and/or modified CDS sequence (opt3) from DENV-2__FJ687447__SS-prME
  source 1..9876: mol_type = other RNA
agcgcaggaatgatcattatgctgatccccaccgtgatggctttccacctcactactagaaatggggaacctcatatgatcgtcggtattcaagaaaagggaaaatcccttctgtttaagacggaggacggcgttaatatgtgcaccttgatggcaatggatttaggggaactgtgtgaggacactatcacttacaaatgcccactactcaggcaaaatgaaccggaggatattgactgttggtgcaattctacctcaacatgggtgacctatggaacttgtacgaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgtaaccactatggctaagaataagcccacattagatttcgaactgattaaaaccgaggccaagcagcctgcgacgcttaggaaatattgcatcgaagcaaagttgaccaacacaactaccgagtcccggtgtccaacacaaggagagccctctctgaaagaagaacaggacaagcgctttgtttgcaagcatagcatggtggatcgaggctggggtaatgggtgtggactattcggcaaaggcgggatcgtcacttgcgccatgtttacctgcaagaaaaacatggaaggaaagattgtgcagcctgagaatctcgaatacacaatagtggtcaccccacactccggtgaggagcatgctgttggcaacgacactgggaaacacggaaaggaaatcaaagtgacgccgcagtcaagtattacagaggccgaactgaccggctatggtactgtaaccatggagtgtagccccagaacatctcttgatttcaatgaaatggtgctgttgcaaatggagaacaaggcatggctcgtccacaggcagtggtttctggacttacctctgccatggctccccggggctgataagcaggagtccaattggatccagaaagaaacccttgtgactttcaagaaccctcatgccaaaaagcaagacgttgtggtcctgggctcacaggagggagcgatgcacacagccttgacgggcgcaaccgaaatacagatgagcagtgggaatctactgtttactggacatctcaaatgccggctgcgtatggacaaacttcaactgaagggtatgtcttactccatgtgtacaggcaaattcaaggtggtaaaagagattgctgagacccagcacgggacaatcgttatccgcgtgcagtatgaaggagatggcagcccatgcaagattcccttcgagatcatggacttggagaagagatacgtcctcggtaggctgattactgtgaacccgatagtcaccgagaaggattcgcctgtgaacatcgaagccgagcccccatttggggactcttacattatcatcggcgttgagcctggacagttaaagctgaattggttcaaaaagggctcctcaattgggcaaatgtttgaaacgaccatgcggggagctaaacgaatggccatactaggtgatacagcatgggacttcggcagtctcgggggagtgtttactagcatcggcaaggccctgcatcaggtattcggtgctatttatggggcggcattttccggcgtctcttggaccatgaaaatccttattggagtgatcataacatggatcggcatgaacagccgctcaacaagtttgtccgttagcctggtgctcgtcgggattgtgaccctgtaccttggagtaatggtgcaggccgattctggctgtgttgtctcatggaagaataaggagctgaaatgcggtagtgggatcttcattacggacaacgtgcacacatggaccgaacagtataagtttcaacccgagagcccatccaaattggcttctgccatccagaaggcacaggaagagggaatatgtggcattagatcggtgactaggctcgagaatctgatgtggaaacagatcacacccgaattaaaccacattctggccgagaatgaagtcaagctaaccatcatgactggtgatataaaaggcatcatgcaagctgggaagcggagcctccgccctcagccaaccgagctgaagtactcctggaaaacatggggaaaggccaaaatgctttcaacggaaagttataaccagaccttcttgattgacggcccggagactgcagagtgccccaatacaaacagagcgtggaactctctggaagttgaggattacgggtttggagtgttcaccacaaacatctggctcaagctgaaagaaaagcaggacgctttttgtgacagcaagttaatgtccgccgcaattaaagataatagggccgtgcatgctgacatgggctattggatcgagtcagccctgaacgatacttggaagatagagaaagccagcttcattgaagtaaagaattgccactggcctaaatctcataccctttggtccaacggtgtcttggagagtgaaatgatcatcccaaagaacctcgctgggcccgtgagccaacacaattaccgtcctggataccacacgcagattgccggcccatggcatctgggtaagctagagatggacttcgatttttgtgacggcacaaccgttatcgtgactgaagattgcgggaaccggggaccctctctgcgaaccacaactgcgtccggcaaactcattaccgagtggtgctgtagatcatgcacactgccgcctcttaggtatcgcggggaggacggatgttggtacggcatggaaatacggccattgaaggagaaagaagagaatctggtcaacagtttagtgacggccggtcacgggcaggttgataatttcagcctcggagtgctgggcatggctctttttctggaagagatgttgagaaccagggtaggtactaagcatgcaatcctcctggtcgccgtgtcgttcgtgacactaattaccggcaacatgtcctttaaagacctggggcgcgtcgttgtgatggtaggagctactatggccgatgacatcggcatgggggtgacatatctcgcactgcttgcggccttcaaggtccgacccacctttgctgccggattgctgttacggaagctcacgtctaaagagctgatgatgactaccattggcatcgtgcttctgagccaatcaacaatacctgaaaccatcctagagctcactgatgcactggctttgggtatgatggttctgaagattgtgcgtaatatggaaaaataccagttagccgtcacaatcatggcaattctctgcgtgcccaacgccgttatcctgcagaatgcttggaaggtgagttgtaccatacttgcggtcgtatccgtgtctccactgttgctcacaagctcccagcagaaaactgactggattcctctggccctaaccatcaaggggctgaaccccacggcaatcttccttacaaccctctcaagaactaataaaaagaggagctggccactgaacgaggctattatggccgttggaatggtgagtatattggcctcttccctgttaaagaatgacatcccgatgaccggccctctcgtcgctggcgggctgcttacagtgtgctatgtactgactggacgcagcgcagatttggaactcgagcgggccaccgacgtgaaatgggaggatcaggcggaaatttcgggttcatctcccatcctgagtattacgatctccgaggacggcagcatgtctataaagaacgaagaggaggaacagacactaaccatcctgattagaactgggcttctcgtcatcagcggactgtttccaatttccatccccataacagctgccgcatggtacttgtgggaggttaaaaagcagagggccggcgtgttatgggatgtgccttcaccaccccctattggtaaagctgaactggaggacggggcatatcgaatcaagcaaaagggaatcctcggctacagtcagattggcgccggggtctacaaagaaggaaccttccacactatgtggcatgtgacacgcggtgcggttctgatgcacaagggcaaacggatcgagccgagctgggctgatgtaaagaaagaccttatatcttatgggggaggctggaagctggagggtgaatggaaggagggggaagaggtgcaggtcttggccctagaaccaggcaaaaatcccagagcagtgcagaccaagcctggcctgtttaaaacgaacactggcaccattggggccgtttccctcgatttctcaccaggaacaagtggtagccccatcattgacaagaaaggcaaggtggtcgggctgtacggaaacggcgtggtaaccaggtccggtgcttatgtctctgccatcgcacaaacagagaagtcgatagaggataatcctgaaattgaggacgatatctttcgtaaacgccggcttactatcatggacttacacccgggggctggaaagaccaaaagatacctgcccgccattgtgagggaagcgatcaagcgaggcctccggacgttgattctggccccaacacgcgttgtggcagctgagatggaagaggccctcagaggcctgcctataaggtatcagactcccgctatccgggcagagcataccgggcgagaaattgtcgaccttatgtgtcacgccacattcaccatgagactgttgagcccagtgcgcgttcctaactacaatctaatcatcatggatgaggcccatttcactgaccccgcttcaattgcggcaaggggatatatatccacccgtgtggaaatgggtgaggccgctggcatctttatgacagccacgccaccggggagtcgggatcctttcccccagtctaacgcaccaattatcgacgaggaaagagagattcccgaaaggagctggaactccggacacgagtgggtcactgattttaaaggcaagaccgtgtggttcgtaccttcaatcaaggccggtaacgacatagctgcgtgcctgcgcaaaaatgggaagaaagtgatccaactctctcgaaagacatttgatagcgaatacgttaaaaccagaactaacgactgggatttcgtcgtgacaaccgacattagtgagatgggagccaattttaaggcagagcgggtgatcgatccaaggcgctgtatgaaacccgtcattttaacggacggcgaagaacgtgtaatcctggctggccctatgccggtgactcattccagcgccgcacagagacgggggaggataggacgcaacccaaagaatgaaaacgaccagtacatttatatgggtgagccccttgaaaatgatgaggactgcgcccactggaaggaggctaaaatgctgctcgataacatcaatacacctgaaggcattatcccctctatgttcgagccagaacgagagaaggttgacgccatagatggggaatacagattgcggggagaggcgaggaaaacctttgtggacctgatgcgcagaggcgatctccctgtctggctggcattcaaggtggccgctgagggtatcaactatgccgacaggcggtggtgttttgatgggattaaaaacaatcagatccttgaagagaacgttgaagtggagatttggaccaaggagggcgaacgtaagaaactaaagccccgctggctggacgctcgaatctactcagatccattggcattaaaagagttcaaggagttcgccgctggaagaaaatccctgactctcaatctgataacagagatgggcaggcttcctacctttatgacacaaaagactcgggacgccctggataacctcgcagtcttgcacacggcggaagccgggggacgcgcttataatcatgccctgagtgagctaccggagaccctggaaacactccttctgttaactttgctggcaaccgtgacaggtggcattttcctctttctgatgagcgggagaggaatcggcaagatgacccttggtatgtgctgcatcattactgcttcgatcctgctctggtacgcccagatacagccccactggattgcagcctctatcattttggagttctttctgatcgtattactaataccagaacctgagaaacagaggacgccccaagacaaccagctgacctatgtggttatcgctattctcacagtcgtggcggccactatggcaaatgaaatggggttccttgagaagaccaaaaaggacctgggcttgggatccatcgctacacagcagccagagagcaacattctggatatcgacctccggcctgcctcagcctggaccctgtacgcagtggctactacatttgtcacgcccatgcttcgacatagtattgaaaattcttccgttaacgtgagcctcaccgccatcgcgaatcaagctactgtactgatgggcttggggaaaggatggccgctgtcaaagatggatataggtgtgccattactagccattggctgttacagtcaggtcaaccctatcacactgaccgcagccctccttctgttggtggctcactatgcaatcattgggcccggactgcaggccaaggcgaccagagaggctcagaaacgcgccgcagccggcataatgaagaatccaacagttgacggtatcactgtgattgatctcgaccccatcccttacgatccgaaattcgaaaagcaactggggcaggtcatgcttttaattctgtgcgtaacacaggtgctcatgatgaggaccacatgggctttgtgtgaggccctgactctagcaaccggccccatcagcacactgtgggaaggaaacccaggccggttttggaataccactatagctgtttccatggccaacatcttccgtgggtcttatctcgcgggagccggccttctgtttagcattatgaaaaatacgacaaacaccagaaggggtactgggaacatcggagagaccttgggcgagaagtggaaatcccgcctgaatgcactcggtaagtcagagttccaaatttacaagaaatctggcatccaggaggtggaccggacactggctaaggaagggataaaacgaggagagactgatcaccatgccgtcagtagaggctcggcaaagttaaggtggtttgtggagcgcaacatggtcacccctgaagggaaagtggttgaccttggatgcggccggggtgggtggagctattactgtggaggcctgaagaatgtgagagaggtaaagggtctcacaaaaggcgggcccggacacgaagaacctattccaatgtccacgtatggctggaacctagtgcgtctgcagtctggggtcgatgttttcttcataccccctgaaaagtgcgacaccttgctgtgtgatatcggagagtcaagcccaaatcccactgtggaggctggcaggacactccgggtccttaacctggtggaaaattggttgaacaataacacccagttttgcattaaagtactgaatccgtacatgccttccgtgatagagaagatggaagccctccaacgcaaatacggtggggccttagttcgaaacccactgagtagaaattctactcatgagatgtattgggtgagcaacgcgtcaggaaatatcgtctccagtgtgaacatgattagcaggatgcttatcaaccggttcacaatgcgccacaagaaggctacctacgaacccgacgtcgacctgggctctggcacgagaaatattgggatcgagtccgagatacctaacctagatatcattggaaaaaggatcgaaaagattaaacaggagcatgaaacctcatggcactatgaccaggatcacccatacaagacatgggcatatcatggtagctacgagactaaacagaccggctcggcctctagtatggtgaatggggttgtacgactcctgacaaagccctgggacgtgttgccgactgtcacccaaatggctatgacagataccactccttttggacagcagcgggtgttcaaggaaaaagttgacacgcgtacacaggagcccaaggagggcaccaaaaagctgatgaaaatcactgccgaatggctctggaaggagcttggtaaaaagaagaccccaagaatgtgtacacgcgaagagtttacgaggaaagtgcggtccaacgcagccctgggggctattttcaccgatgagaataagtggaaaagcgcgagagaagccgtcgaggactcacgcttttgggaattagtggataaggagaggaacctgcacttggaaggaaaatgcgagacttgtgtatataatatgatgggcaagcgagagaagaaactcggcgagttcgggaaggcaaaaggatcccgggctatatggtacatgtggctgggtgccagatttctagagttcgaagcacttggctttctgaacgaggaccattggttctctagggaaaatagcctcagtggggtggagggagagggcctgcacaagttgggttacatcctgcgcgatgtttccaaaaaggaagggggagccatgtatgctgacgacacagccggctgggatacccgtattactctcgaggaccttaagaacgaagagatggtcacaaatcacatggaaggcgagcataaaaagctggcggaggcaatctttaaattaacctaccaaaacaaggtggtgcgggtccagagacctacacccagggggactgttatggatatcattagccgccgagaccagcggggatctggtcaagtgggcacctatgggctgaatacgttcaccaacatggaagcccagttgataagacagatggagggagaaggcgtattcaaaaatatccagcacctcacagtgactgaggaggtcgctgtgcaaaactggctggccagggttggtcgcgaaagactatcacggatggcaattagtggggatgactgcgtggtcaagccacttgatgacaggtttgctaacgccctgaccgctctcaatgatatgggaaagatccgtaaagacattcagcagtgggagccctccaagggctggaacgattggacacaggtgcctttctgcagccatcactttcatgaactgatcatgaaagacggccgagtattggttgtgccatgtcgcaatcaagatgagttaatagggagagcccggatctctcagggagcaggttggtcgctgagggaaactgcgtgcctcggcaagtcatacgcccagatgtggagccttatgtatttccaccgcagagacctgcggctagctgccaacgcaatttgttccgctgtcccgagtcactgggtgcccacctctaggacgacatggagcatccatgccaaacacgagtggatgaccactgaggacatgctgacagtgtggaatcgagtctggattcgtgaaaacccttggatggaggataagaccccagttgaatcctgggaggaaatcccctacctcgggaagagagaggaccagtggtgcggatcattgataggcctgacaagtcgcgcaacctgggccaaaaatattcaagcggctatcaaccaggtgcggtctcttattggtaatgaggaatatacagattacatgcctagcatgaagaggtttagacgcgaggaagaggaagccggggtactgtggtga

SEQ ID NO: 14606 - RNA, 9876 nt, synthetic construct
  misc_feature 1..9876: note = derived and/or modified CDS sequence (opt3) from DENV-2__FJ810411__SS-prME
  source 1..9876: mol_type = other RNA
agcgcaggaatgatcattatgctgatccccaccgtgatggctttccacctcactactagaaatggggaacctcatatgatcgtcggtattcaagaaaagggaaaatcccttctgtttaagacggaggacggcgttaatatgtgcaccttgatggcaatggatttaggggaactgtgtgaggacactatcacttacaaatgcccactactcaggcaaaatgaaccggaggatattgactgttggtgcaattctacctcaacatgggtgacctatggaacttgtacgaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgtaaccactatggctaagaataagcccacattagatttcgaactgattaaaaccgaggccaagcagcctgcgacgcttaggaaatattgcatcgaagcaaagttgaccaacacaactaccgagtcccggtgtccaacacaaggagagccctctctgaaagaagaacaggacaagcgctttgtttgcaagcatagcatggtggatcgaggctggggtaatgggtgtggactattcggcaaaggcgggatcgtcacttgcgccatgtttacctgcaagaaaaacatggaaggaaagattgtgcagcctgagaatctcgaatacacaatagtggtcaccccacactccggtgaggagcatgctgttggcaacgacactgggaaacacggaaaggaaatcaaagtgacgccgcagtcaagtattacagaggccgaactgaccggctatggtactgtaaccatggagtgtagccccagaacatctcttgatttcaatgaaatggtgctgttgcaaatggagaacaaggcatggctcgtccacaggcagtggtttctggacttacctctgccatggctccccggggctgataagcaggagtccaattggatccagaaagaaacccttgtgactttcaagaaccctcatgccaaaaagcaagacgttgtggtcctgggctcacaggagggagcgatgcacacagccttgacgggcgcaaccgaaatacagatgagcagtgggaatctactgtttactggacatctcaaatgccggctgcgtatggacaaacttcaactgaagggtatgtcttactccatgtgtacaggcaaattcaaggtggtaaaagagattgctgagacccagcacgggacaatcgttatccgcgtgcagtatgaaggagatggcagcccatgcaagattcccttcgagatcatggacttggagaagagatacgtcctcggtaggctgattactgtgaacccgatagtcaccgagaaggattcgcctgtgaacatcgaagccgagcccccatttggggactcttacattatcatcggcgttgagcctggacagttaaagctgaattggttcaaaaagggctcctcaattgggcaaatgtttgaaacgaccatgcggggagctaaacgaatggccatactaggtgatacagcatgggacttcggcagtctcgggggagtgtttactagcatcggcaaggccctgcatcaggtattcggtgctatttatggggcggcattttccggcgtctcttggaccatgaaaatccttattggagtgatcataacatggatcggcatgaacagccgctcaacaagtttgtccgttagcctggtgctcgtcgggattgtgaccctgtaccttggagtaatggtgcaggccgattctggctgtgttgtctcatggaagaataaggagctgaaatgcggtagtgggatcttcattacggacaacgtgcacacatggaccgaacagtataagtttcaacccgagagcccatccaaattggcttctgccatccagaaggcacaggaagagggaatatgtggcattagatcggtgactaggctcgagaatctgatgtggaaacagatcacacccgaattaaaccacattctggccgagaatgaagtcaagctaaccatcatgactggtgatataaaaggcatcatgcaagctgggaagcggagcctccgccctcagccaaccgagctgaagtactcctggaaaacatggggaaaggccaaaatgctttcaacggaaagttataaccagaccttcttgattgacggcccggagactgcagagtgccccaatacaaacagagcgtggaactctctggaagttgaggattacgggtttggagtgttcaccacaaacatctggctcaagctgaaagaaaagcaggacgctttttgtgacagcaagttaatgtccgccgcaattaaagataatagggccgtgcatgctgacatgggctattggatcgagtcagccctgaacgatacttggaagatagagaaagccagcttcattgaagtaaagaattgccactggcctaaatctcataccctttggtccaacggtgtcttggagagtgaaatgatcatcccaaagaacctcgctgggcccgtgagccaacacaattaccgtcctggataccacacgcagattgccggcccatggcatctgggtaagctagagatggacttcgatttttgtgacggcacaaccgttatcgtgactgaagattgcgggaaccggggaccctctctgcgaaccacaactgcgtccggcaaactcattaccgagtggtgctgtagatcatgcacactgccgcctcttaggtatcgcggggaggacggatgttggtacggcatggaaatacggccattgaaggagaaagaagagaatctggtcaacagtttagtgacggccggtcacgggcaggttgataatttcagcctcggagtgctgggcatggctctttttctggaagagatgttgagaaccagggtaggtactaagcatgcaatcctcctggtcgccgtgtcgttcgtgacactaattaccggcaacatgtcctttaaagacctggggcgcgtcgttgtgatggtaggagctactatggccgatgacatcggcatgggggtgacatatctcgcactgcttgcggccttcaaggtccgacccacctttgctgccggattgctgttacggaagctcacgtctaaagagctgatgatgactaccattggcatcgtgcttctgagccaatcaacaatacctgaaaccatcctagagctcactgatgcactggctttgggtatgatggttctgaagattgtgcgtaatatggaaaaataccagttagccgtcacaatcatggcaattctctgcgtgcccaacgccgttatcctgcagaatgcttggaaggtgagttgtaccatacttgcggtcgtatccgtgtctccactgttgctcacaagctcccagcagaagactgactggattcctctggccctaaccatcaaggggctgaaccccacggcaatcttccttacaaccctctcaagaactaataaaaagaggagctggccactgaacgaggctattatggccgttggaatggtgagtatattggcctcttccctgttaaagaatgacatcccgatgaccggccctctcgtcgctggcgggctgcttacagtgtgctatgtactgactggacgcagcgcagatttggaactcgagcgggccaccgacgtgaaatgggaggatcaggcggaaatttcgggttcatctcccatcctgagtattacgatctccgaggacggcagcatgtctataaagaacgaagaggaggaacagacactaaccatcctgattagaactgggcttctcgtcatcagcggactgtttccaatttccatccccataacagctgccgcatggtacttgtgggaggttaaaaagcagagggccggcgtgttatgggatgtgccttcaccaccccctattggtaaagctgaactggaggacggggcatatcgaatcaagcaaaagggaatcctcggctacagtcagattggcgccggggtctacaaagaaggaaccttccacactatgtggcatgtgacacgcggtgcggttctgatgcacaagggcaaacggatcgagccgagctgggctgatgtaaagaaagaccttatatcttatgggggaggctggaagctggagggtgaatggaaggagggggaagaggtgcaggtcttggccctagaaccaggcaaaaatcccagagcagtgcagaccaagcctggcctgtttaaaacgaacactggcaccattggggccgtttccctcgatttctcaccaggaacaagtggtagccccatcattgacaagaaaggcaaggtggtcgggctgtacggaaacggcgtggtaaccaggtccggtgcttatgtctctgccatcgcacaaacagagaagtcgatagaggataatcctgaaattgaggacgatatctttcgtaaacgccggcttactatcatggacttacacccgggggctggaaagaccaaaagatacctgcccgccattgtgagggaagcgatcaagcgaggcctccggacgttgattctggccccaacacgcgttgtggcagctgagatggaagaggccctcagaggcctgcctataaggtatcagactcccgctatccgggcagagcataccgggcgagaaattgtcgaccttatgtgtcacgccacattcaccatgagactgttgagcccagtgcgcgttcctaactacaatctaatcatcatggatgaggcccatttcactgaccccgcttcaattgcggcaaggggatatatatccacccgtgtggaaatgggtgaggccgctggcatctttatgacagccacgccaccggggagtcgggatcctttcccccagtctaacgcaccaattatcgacgaggaaagagagattcccgaaaggagctggaactccggacacgagtgggtcactgattttaaaggcaagaccgtgtggttcgtaccttcaatcaaggccggtaacgacatagctgcgtgcctgcgcaaaaatgggaagaaagtgatccaactctctcgaaagacatttgatagcgaatacgttaaaaccagaactaacgactgggatttcgtcgtgacaaccgacattagtgagatgggagccaattttaaggcagagcgggtgatcgatccaaggcgctgtatgaaacccgtcattttaacggacggcgaagaacgtgtaatcctggctggccctatgccggtgactcattccagcgccgcacagagacgggggaggataggacgcaacccaaagaatgaaaacgaccagtacatttatatgggtgagccccttgaaaatgatgaggactgcgcccactggaaggaggctaaaatgctgctcgataacatcaatacacctgaaggcattatcccctctatgttcgagccagaacgagagaaggttgacgccatagatggggaatacagattgcggggagaggcgaggaaaacctttgtggacctgatgcgcagaggcgatctccctgtctggctggcattcaaggtggccgctgagggtatcaactatgccgacaggcggtggtgttttgatgggattaaaaacaatcagatccttgaagagaacgttgaagtggagatttggaccaaggagggcgaacgtaagaaactaaagccccgctggctggacgctcgaatctactcagatccattggcattaaaagagttcaaggagttcgccgctggaagaaaatccctgactctcaatctgataacagagatgggcaggcttcctacctttatgacacaaaagactcgggacgccctggataacctcgcagtcttgcacacggcggaagccgggggacgcgcttataatcatgccctgagtgagctaccggagaccctggaaacactccttctgttaactttgctggcaaccgtgacaggtggcattttcctctttctgatgagcgggagaggaatcggcaagatgacccttggtatgtgctgcatcattactgcttcgatcctgctctggtacgcccagatacagccccactggattgcagcctctatcattttggagttctttctgatcgtattactaataccagaacctgagaaacagaggacgccccaagacaaccagctgacctatgtggttatcgctattctcacagtcgtggcggccactatggcaaatgaaatggggttccttgagaagaccaaaaaggacctgggcttgggatccatcgctacacagcagccagagagcaacattctggatatcgacctccggcctgcctcagcctggaccctgtacgcagtggctactacatttgtcacgcccatgcttcgacatagtattgaaaattcttccgttaacgtgagcctcaccgccatcgcgaatcaagctactgtactgatgggcttggggaaaggatggccgctgtcaaagatggatataggtgtgccattactagccattggctgttacagtcaggtcaaccctatcacactgaccgcagccctccttctgttggtggctcactatgcaatcattgggcccggactgcaggccaaggcgaccagagaggctcagaaacgcgccgcagccggcataatgaagaatccaacagttgacggtatcactgtgattgatctcgaccccatcccttacgatccgaaattcgaaaagcaactggggcaggtcatgcttttaattctgtgcgtaacacaggtgctcatgatgaggaccacatgggctttgtgtgaggccctgactctagcaaccggccccatcagcacactgtgggaaggaaacccaggccggttttggaataccactatagctgtttccatggccaacatcttccgtgggtcttatctcgcgggagccggccttctgtttagcattatgaaaaatacgacaaacaccagaaggggtactgggaacatcggagagaccttgggcgagaagtggaaatcccgcctgaatgcactcggtaagtcagagttccaaatttacaagaaatctggcatccaggaggtggaccggacactggctaaggaagggataaaacgaggagagactgatcaccatgccgtcagtagaggctcggcaaagttaaggtggtttgtggagcgcaacatggtcacccctgaagggaaagtggttgaccttggatgcggccggggtgggtggagctattactgtggaggcctgaagaatgtgagagaggtaaagggtctcacaaaaggcgggcccggacacgaagaacctattccaatgtccacgtatggctggaacctagtgcgtctgcagtctggggtcgatgttttcttcataccccctgaaaagtgcgacaccttgctgtgtgatatcggagagtcaagcccaaatcccactgtggaggctggcaggacactccgggtccttaacctggtggaaaattggttgaacaataacacccagttttgcattaaagtactgaatccgtacatgccttccgtgatagagaagatggaagccctccaacgcaaatacggtggggccttagttcgaaacccactgagtagaaattctactcatgagatgtattgggtgagcaacgcgtcaggaaatatcgtctccagtgtgaacatgattagcaggatgcttatcaaccggttcacaatgcgccacaagaaggctacctacgaacccgacgtcgacctgggctctggcacgagaaatattgggatcgagtccgagatacctaacctagatatcattggaaaaaggatcgaaaagattaaacaggagcatgaaacctcatggcactatgaccaggatcacccatacaagacatgggcatatcatggtagctacgagactaaacagaccggctcggcctctagtatggtgaatggggttgtacgactcctgacaaagccctgggacgtgttgccgactgtcacccaaatggctatgacagataccactccttttggacagcagcgggtgttcaaggaaaaagttgacacgcgtacacaggagcccaaggagggcaccaaaaagctgatgaaaatcactgccgaatggctctggaaggagcttggtaaaaagaagaccccaagaatgtgtacacgcgaagagtttacgaaaaaggtgaggtccaacgcagccctgggggctattttcaccgatgagaataaatggaaaagcgcgcgggaagccgtcgaggactcaagattttgggaattagtggataaagagcgcaacctgcacttggaaggaaagtgcgagacttgtgtatataatatgatgggcaagagggagaaaaagctcggcgagttcgggaaagcaaagggatcccgagctatatggtacatgtggctgggtgcccggtttctagagttcgaagcacttggctttctgaacgaggaccattggttctctagagaaaatagcctcagtggggtggagggagagggcctgcacaaattgggttacatcctgagggatgtttccaagaaggaagggggagccatgtatgctgacgacacagccggctgggatacccgcattactctcgaggaccttaaaaacgaagagatggtcacaaatcacatggaaggcgagcataagaaactggcggaggcaatctttaagttaacctaccaaaacaaagtggtgcgtgtccagcggcctacacccagagggactgttatggatatcattagcaggcgcgaccagcgaggatctggtcaagtgggcacctatgggctgaatacgttcaccaacatggaagcccagttgatacggcagatggagggagaaggcgtattcaagaatatccagcacctcacagtgactgaggaggtcgctgtgcaaaactggctggccagagttggtagggaacgcctatcaagaatggcaattagtggggatgactgcgtggtcaagccacttgatgaccggtttgctaacgccctgaccgctctcaatgatatgggaaaaatcaggaaggacattcagcagtgggagccctccaaaggctggaacgattggacacaggtgcctttctgcagccatcactttcatgaactgatcatgaaggacggccgtgtattggttgtgccatgtcgaaatcaagatgagttaatagggcgcgccagaatctctcagggagcaggttggtcgctgcgggaaactgcgtgcctcggcaaatcatacgcccagatgtggagccttatgtatttccacaggcgcgacctgagactagctgccaacgcaatttgttccgctgtcccgagtcactgggtgcccacctctcggacgacatggagcatccatgccaagcacgagtggatgaccactgaggacatgctgacagtgtggaatagggtctggattcgagaaaacccttggatggaggataagaccccagttgaatcctgggaggaaatcccctacctcgggaaacgtgaggaccagtggtgcggatcattgataggcctgacaagtagagcaacctgggccaagaatattcaagcggctatcaaccaggtgcgctctcttattggtaatgaggaatatacagattacatgcctagcatgaaacggtttaggagagaggaagaggaagccggggtactgtggtga

SEQ ID NO: 14607 - RNA, 9876 nt, synthetic construct
  misc_feature 1..9876: note = derived and/or modified CDS sequence (opt3) from DENV-2__FJ744713__SS-prME
  source 1..9876: mol_type = other RNA
agcgcaggaatgatcattatgctgatccccaccgtgatggctttccacctcacaactagaaatggggaacctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaatgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgtaaccactatggctaagaataagcccacattagatttcgaactgattaaaaccgaggccaagcagcctgcgacgcttaggaaatattgcatcgaagcaaagttgaccaacacaactaccgagtcccggtgtccaacacaaggagagccctctctgaaagaagaacaggacaagcgctttgtttgcaagcatagcatggtggatcgaggctggggtaatgggtgtggactattcggcaaaggcgggatcgtcacttgcgccatgtttacctgcaagaaaaacatggaaggaaagattgtgcagcctgagaatctcgaatacacaatagtggtcaccccacactccggtgaggagcatgctgttggcaacgacactgggaaacacggaaaggaaatcaaagtgacgccgcagtcaagtattacagaggccgaactgaccggctatggtactgtaaccatggagtgtagccccagaacatctcttgatttcaatgaaatggtgctgttgcaaatggagaacaaggcatggctcgtccacaggcagtggtttctggacttacctctgccatggctccccggggctgataagcaggagtccaattggatccagaaagaaacccttgtgactttcaagaaccctcatgccaaaaagcaagacgttgtggtcctgggctcacaggagggagcgatgcacacagccttgacgggcgcaaccgaaatacagatgagcagtgggaatctactgtttactggacatctcaaatgccggctgcgtatggacaaacttcaactgaagggtatgtcttactccatgtgtacaggcaaattcaaggtggtaaaagagattgctgagacccagcacgggacaatcgttatccgcgtgcagtatgaaggagatggcagcccatgcaagattcccttcgagatcatggacttggagaagagatacgtcctcggtaggctgattactgtgaacccgatagtcaccgagaaggattcgcctgtgaacatcgaagccgagcccccatttggggactcttacattatcatcggcgttgagcctggacagttaaagctgaattggttcaaaaagggctcctcaattgggcaaatgtttgaaacgaccatgcggggagctaaacgaatggccatactaggtgatacagcatgggacttcggcagtctcgggggagtgtttactagcatcggcaaggccctgcatcaggtattcggtgctatttatggggcggcattttccggcgtctcttggaccatgaaaatccttattggagtgatcataacatggatcggcatgaacagccgctcaacaagtttgtccgttagcctggtgctcgtcgggattgtgaccctgtaccttggagtaatggtgcaggccgattctggctgtgttgtctcatggaagaataaggagctgaaatgcggtagtgggatcttcattacggacaacgtgcacacatggaccgaacagtataagtttcaacccgagagcccatccaaattggcttctgccatccagaaggcacaggaagagggaatatgtggcattagatcggtgactaggctcgagaatctgatgtggaaacagatcacacccgaattaaaccacattctggccgagaatgaagtcaagctaaccatcatgactggtgatataaaaggcatcatgcaagctgggaagcggagcctccgccctcagccaaccgagctgaagtactcctggaaaacatggggaaaggccaaaatgctttcaacggaaagttataaccagaccttcttgattgacggcccggagactgcagagtgccccaatacaaacagagcgtggaactctctggaagttgaggattacgggtttggagtgttcaccacaaacatctggctcaagctgaaagaaaagcaggacgctttttgtgacagcaagttaatgtccgccgcaattaaagataatagggccgtgcatgctgacatgggctattggatcgagtcagccctgaacgatacttggaagatagagaaagccagcttcattgaagtaaagaattgccactggcctaaatctcataccctttggtccaacggtgtcttggagagtgaaatgatcatcccaaagaacctcgctgggcccgtgagccaacacaattaccgtcctggataccacacgcagattgccggcccatggcatctgggtaagctagagatggacttcgatttttgtgacggcacaaccgttatcgtgactgaagattgcgggaaccggggaccctctctgcgaaccacaactgcgtccggcaaactcattaccgagtggtgctgtagatcatgcacactgccgcctcttaggtatcgcggggaggacggatgttggtacggcatggaaatacggccattgaaggagaaagaagagaatctggtcaacagtttagtgacggccggtcacgggcaggttgataatttcagcctcggagtgctgggcatggctctttttctggaagagatgttgagaaccagggtaggtactaagcatgcaatcctcctggtcgccgtgtcgttcgtgacactaattaccggcaacatgtcctttaaagacctggggcgcgtcgttgtgatggtaggagctactatggccgatgacatcggcatgggggtgacatatctcgcactgcttgcggccttcaaggtccgacccacctttgctgccggattgctgttacggaagctcacgtctaaagagctgatgatgactaccattggcatcgtgcttctgagccaatcaacaatacctgaaaccatcctagagctcactgatgcactggctttgggtatgatggttctgaagattgtgcgtaatatggaaaaataccagttagccgtcacaatcatggcaattctctgcgtgcccaacgccgttatcctgcagaatgcttggaaggtgagttgtaccatacttgcggtcgtatccgtgtctccactgttgctcacaagctcccagcagaaaactgactggattcctctggccctaaccatcaaggggctgaaccccacggcaatcttccttacaaccctctcaagaactaataaaaagaggagctggccactgaacgaggctattatggccgttggaatggtgagtatattggcctcttccctgttaaagaatgacatcccgatgaccggccctctcgtcgctggcgggctgcttacagtgtgctatgtactgactggacgcagcgcagatttggaactcgagcgggccaccgacgtgaaatgggaggatcaggcggaaatttcgggttcatctcccatcctgagtattacgatctccgaggacggcagcatgtctataaagaacgaagaggaggaacagatcctaacaattctgatcagaaccgggcttctcgtcattagcggactgtttccaatctccatacccattactgctgccgcatggtacttgtgggaggttaaaaagcagagggccggcgtgttatgggatgtgccttcaccaccccctatcggtaaagctgaactggaggacggggcatatcgaatcaagcaaaagggcattctcggatacagtcagatcggcgccggggtctacaaagaaggaacattccacaccatgtggcatgtgactcgcggtgcggttctgatgcacaagggcaaacggatagagccgagctgggctgatgtaaagaaagaccttatttcttatgggggaggctggaagctggagggtgaatggaaggagggggaagaggtgcaggtcttggccctagaaccaggcaaaaatcccagagcagtgcagacaaagcctggcctgtttaaaaccaacacgggcactatcggggccgtttccctcgatttctcaccaggaaccagtggtagccccattatcgacaagaaaggcaaggtggtcgggctgtacggaaacggcgtggtaacaaggtccggtgcttatgtctctgccatagcacaaaccgagaagtcgattgaggataatcctgaaatcgaggacgatatctttcgtaaacgccggcttacaattatggacttacacccgggggctggaaagactaaaagatacctgcccgccatcgtgagggaagcgattaagcgaggcctccggaccttgatactggccccaacgcgcgttgtggcagctgagatggaagaggccctcagaggcctgcctatcaggtatcagacacccgctattcgggcagagcatactgggcgagaaatcgtcgaccttatgtgtcacgccaccttcacaatgagactgttgagcccagtgcgcgttcctaactacaatctaatcattatggatgaggcccatttcaccgaccccgcttcaatagcggcaaggggatatatctccactcgtgtggaaatgggtgaggccgctggcatttttatgaccgccacaccaccggggagtcgggatcctttcccccagtctaacgcaccaatcattgacgaggaaagagagatccccgaaaggagctggaactccggacacgagtgggtcacggattttaaaggcaagactgtgtggttcgtaccttcaataaaggccggtaacgacatcgctgcgtgcctgcgcaaaaatgggaagaaagtgattcaactctctcgaaagacctttgatagcgaatacgttaaaacaagaaccaacgactgggatttcgtcgtgactacagacatcagtgagatgggagccaattttaaggcagagcgggtgattgatccaaggcgctgtatgaaacccgtcatcttaaccgacggcgaagaacgtgtaatactggctggccctatgccggtgacgcattccagcgccgcacagagacgggggaggattggacgcaacccaaagaatgaaaacgaccagtacatctatatgggtgagccccttgaaaatgatgaggactgcgcccactggaaggaggctaaaatgctgctcgataacattaatactcctgaaggcatcataccctctatgttcgagccagaacgagagaaggttgacgccatcgatggggaatacagattgcggggagaggcgaggaaaacatttgtggacctgatgcgcagaggcgatctccctgtctggctggcattcaaggtggccgctgagggtattaactatgccgacaggcggtggtgttttgatgggatcaaaaacaatcagattcttgaagagaacgttgaagtggagatctggaccaaggagggcgaacgtaagaaactaaagccccgctggctggacgctcgaatatactcagatccattggcattaaaagagttcaaggagttcgccgctggaagaaaatccctgaccctcaatctgattactgagatgggcaggcttcctacatttatgacccaaaagacacgggacgccctggataacctcgcagtcttgcacactgcggaagccgggggacgcgcttataatcatgccctgagtgagctaccggagacgctggaaaccctccttctgttaacattgctggcaactgtgaccggtggcatcttcctctttctgatgagcgggagaggaatcggcaagatgacacttggtatgtgctgcattatcaccgcttcgatactgctctggtacgcccagattcagccccactggatcgcagcctctattatcttggagttctttctgatagtattactaatcccagaacctgagaaacagaggactccccaagacaaccagctgacgtatgtggttattgctatcctcaccgtcgtggcggccacaatggcaaatgaaatggggttccttgagaagactaaaaaggacctgggcttgggatccattgctacccagcagccagagagcaacatcctggatattgacctccggcctgcctcagcctggacactgtacgcagtggctaccacttttgtcacacccatgcttcgacatagtatcgaaaattcttccgttaacgtgagcctcacggccatagcgaatcaagctaccgtactgatgggcttggggaaaggatggccgctgtcaaagatggatattggtgtgccattactagccatcggctgttacagtcaggtcaaccctatcactctgacagcagccctccttctgttggtggctcactatgcaattatagggcccggactgcaggccaaggcgaccagagaggctcagaaacgcgccgcagccggcatcatgaagaatccaaccgttgacggtattacagtgatcgatctcgaccccattccttacgatccgaaattcgaaaagcaactggggcaggtcatgcttttaatcctgtgcgtaactcaggtgctcatgatgaggacgacctgggctttgtgtgaggccctgacactagcaactggccccataagcaccctgtgggaaggaaacccaggccggttttggaatacaaccatcgctgtttccatggccaacattttccgtgggtcttatctcgcgggagccggccttctgtttagcatcatgaaaaatactacgaacacaagaaggggtaccgggaacattggagagactttgggcgagaagtggaaatcccgcctgaatgcactcggtaagtcagagttccaaatctacaagaaatctggcatacaggaggtggaccggaccctggctaaggaagggattaaacgaggagagacagatcaccatgccgtcagtagaggctcggcaaagttaaggtggtttgtggagcgcaacatggtcactcctgaagggaaagtggttgaccttggatgcggccggggtgggtggagctattactgtggaggcctgaagaatgtgagagaggtaaagggtctcaccaaaggcgggcccggacacgaagaacctatcccaatgtccacatatggctggaacctagtgcgtctgcagtctggggtcgatgttttcttcataccccctgaaaagtgcgacacgttgctgtgtgatattggagagtcaagcccaaatcccaccgtggaggctggcaggactctccgggtccttaacctggtggaaaattggttgaacaataacacacagttttgcataaaagtactgaatccgtacatgccttccgtgatcgagaagatggaagccctccaacgcaaatacggtggggccttagttcgaaacccactgagtagaaattctacccatgagatgtattgggtgagcaacgcgtcaggaaatattgtctccagtgtgaacatgatcagcaggatgcttattaaccggttcactatgcgccacaagaaggctacatacgaacccgacgtcgacctgggctctggcaccagaaatatcgggatagagtccgagatccctaacctagatattatcggaaaaaggattgaaaagatcaaacaggagcatgaaacgtcatggcactatgaccaggatcacccatacaagacctgggcatatcatggtagctacgagacaaaacagactggctcggcctctagtatggtgaatggggttgtacgactcctgaccaagccctgggacgtgttgccgacagtcactcaaatggctatgaccgatacaaccccttttggacagcagcgggtgttcaaggaaaaagttgacactcgtacgcaggagcccaaggagggcactaaaaagctgatgaaaattaccgccgaatggctctggaaggagcttggtaaaaagaagactccaagaatgtgtacccgcgaagagtttacaaggaaagtgcggtccaacgcagccctgggggctatattcacggatgagaataagtggaaaagcgcgagagaagccgtcgaggactcacgcttttgggaattagtggataaggagaggaacctgcacttggaaggaaaatgcgagacctgtgtatataatatgatgggcaagcgagagaagaaactcggcgagttcgggaaggcaaaaggatcccgggctatctggtacatgtggctgggtgccagatttctagagttcgaagcacttggctttctgaacgaggaccattggttctctagggaaaatagcctcagtggggtggagggagagggcctgcacaagttgggttacattctgcgcgatgtttccaaaaaggaagggggagccatgtatgctgacgacactgccggctgggatacacgtatcaccctcgaggaccttaagaacgaagagatggtcactaatcacatggaaggcgagcataaaaagctggcggaggcaatctttaaattaacataccaaaacaaggtggtgcgggtccagagacctacccccagggggacagttatggatattataagccgccgagaccagcggggatctggtcaagtgggcacttatgggctgaataccttcacgaacatggaagcccagttgatcagacagatggagggagaaggcgtattcaaaaatattcagcacctcaccgtgacagaggaggtcgctgtgcaaaactggctggccagggttggtcgcgaaagactatcacggatggcaatcagtggggatgactgcgtggtcaagccacttgatgacaggtttgctaacgccctgactgctctcaatgatatgggaaagattcgtaaagacatccagcagtgggagccctccaagggctggaacgattggacccaggtgcctttctgcagccatcactttcatgaactgataatgaaagacggccgagtattggttgtgccatgtcgcaatcaagatgagttaatcgggagagcccggatttctcagggagcaggttggtcgctgagggaaacagcgtgcctcggcaagtcatacgcccagatgtggagccttatgtatttccaccgcagagacctgcggctagctgccaacgcaatctgttccgctgtcccgagtcactgggtgcccacttctaggaccacgtggagcattcatgccaaacacgagtggatgacaaccgaggacatgctgactgtgtggaatcgagtctggatccgtgaaaacccttggatggaggataagacaccagttgaatcctgggaggaaataccctacctcgggaagagagaggaccagtggtgcggatcattgattggcctgaccagtcgcgcaacttgggccaaaaatatccaagcggctattaaccaggtgcggtctcttatcggtaatgaggaatataccgattacatgcctagcatgaagaggtttagacgcgaggaagaggaagccggggtactgtggtga

SEQ ID NO: 14608 - RNA, 9876 nt, synthetic construct
  misc_feature 1..9876: note = derived and/or modified CDS sequence (opt3) from DENV-2__FJ744714__SS-prME
  source 1..9876: mol_type = other RNA
agcgccggaatgataattatgctgatacccaccgtgatggctttccacctcactactagaaacggggagcctcatatgatcgtcgggattcaagaaaagggtaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagcgatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaataccagttagctgttacaattatggccatcctctgcgtgcccaacgcagtcattctgcagaatgcctggaaggtatcatgtaccatccttgctgtggttagtgtgtccccactgttgctcacatctagccagcagaaaactgactggatacctctggcgctaaccattaagggactgaaccccacggccatcttccttacaaccctctccagaactaataaaaagaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaaatgggaggatcaggccgaaatcagcggctcgtcacccattctgtctatcacgattagtgaggacgggtccatgagcatcaagaacgaagaggaggaacagacactaaccatactgatcagaactggacttctcgtgatttctggcctgtttccaatcagcattcccatcacagcggctgcctggtacttgtgggaggtgaaaaagcagagggcgggtgtcttatgggatgtgccttccccaccccctatggggaaagccgaactggaggacggagcttatcgaataaagcaaaagcgcattctcggctactcacagatcggcgcaggggtttacaaagaaggaaccttccacactatgtggcatgtaacacggggtgccgtgctgatgcacaagggcaaaagaatcgagccgagttgggcggatgtcaagaaagaccttattagctatgggggaggctggaagctggagggtgaatggaaggagggggaagaggtgcaggttttggctctagaaccaggcaaaaatcccagggccgtgcagaccaagcctggcctgtttaaaacgaacactggcaccatcggggcagtctctctcgatttctccccaggaacatcaggtagtcccataattgacaagaaaggcaaggtggtagggctgtacggaaacggcgtcgtgacccgtagcggtgcctatgtttccgctatcgcccaaacagagaagtctattgaggataatcctgaaatcgaggacgatatatttcgcaaacggagacttactattatggacttacacccgggggcaggaaagaccaaaaggtacctgcccgctatcgtgcgagaagccatcaagcggggcctccgcacgttgattctggcgccaacaagagtcgtggccgcagagatggaagaggctctcaggggcctgcctatccggtatcagactcccgccattcgagctgagcataccgggagagaaatagttgaccttatgtgtcacgcaacattcaccatgcgcctgttgtcgccagtgagggtccctaactacaatctaatcattatggatgaggcccatttcactgaccccgccagcatcgctgcgcgtggatatatctcaacccgggtggaaatgggtgaggcagccggcatttttatgacagctacgccaccggggtccagagatcctttcccccagagtaacgccccaataatcgacgaggaaagggagattcccgaacgctcttggaatagcggacacgagtgggtaactgattttaaaggcaagaccgtgtggttcgttccttccatcaaggcaggtaacgacattgccgcttgcctgcggaaaaatgggaagaaagtcatccaactctcaagaaagacatttgattctgaatacgtgaaaaccagaactaacgactgggatttcgtggtcacaaccgacataagcgagatgggagcgaattttaaggccgagagggtaatcgatccacgccgttgtatgaaacccgtgattttaacggacggcgaagagagagttatcctggcaggccctatgccggtgactcatagttccgctgcccagcggagggggcgcattggacgaaacccaaagaatgaaaacgaccagtacatctatatgggtgagccccttgaaaatgatgaggactgcgcacactggaaggaggccaaaatgctgctcgataacataaatacacctgaaggcattatccccagcatgttcgagccagaaagagagaaggtcgacgctattgatggggaataccggttgaggggagaggcccgcaaaacctttgtggacctgatgagaaggggcgatctccctgtttggctggcgtataaggtggcagccgagggtatcaactacgctgaccggcgttggtgtttcgatgggatcaaaaacaatcagatccttgaagagaacgtcgaagtggagatttggaccaaggagggcgaacgcaagaaactaaagccccgatggctggacgccagaatctattctgatccattggctttaaaagagtttaaggagttcgcagccggaaggaaatcactgactctcaatctgattacagagatgggccggcttcctaccttcatgacacaaaagactcgcgacgctctggataacctcgccgtattgcacacggcagaagcagggggtagagcatacaatcatgctctgtccgagctaccggagaccctggaaacactccttctgttaactttgctggccaccgtgacaggaggcatctttctcttcctgatgagtgggaggggaataggcaagatgacccttggtatgtgctgcattatcactgcaagcatcctgctctggtatgctcagattcagccccactggatcgccgcatcgataattttggagtttttcctgatcgttttactaattccagaacctgagaaacagcggacgccccaagacaaccagctgacctacgtcgtgatcgccatactcacagtggtcgctgcgactatggccaatgaaatggggtttcttgagaagaccaaaaaggacctgggcttgggatctatcgcaacacagcagccagagtccaacattctggatatcgacctccgacctgctagcgcctggaccctgtacgccgttgcaactacattcgtgacgcccatgcttagacattcaattgaaaatagttctgtaaacgtgtccctcaccgctatcgccaatcaagcgactgtcctgatgggcttggggaaaggatggccgctgagcaagatggatattggtgtgccattactagctatcggctgttattcacaggttaaccctataacactgaccgccgcactccttctgttggtggcccactacgctattatcgggcccggactgcaggcaaaggccacccgcgaggcgcagaaaagggctgccgcaggcatcatgaagaatccaacagtcgacggtattactgtaatagatctcgaccccatcccttatgatccgaaatttgaaaagcaactgggacaggtgatgcttttaattctgtgcgttacacaggtgctcatgatgcggaccacatgggccttgtgtgaggctctgactctagccaccggccccatcagtacactgtgggaaggaaacccaggccgtttctggaataccactattgcagtcagcatggctaacatctttagagggtcctacctcgccggagcgggccttctgttctctataatgaaaaatacgacaaacaccaggcgcggtactgggaacatcggagagaccttgggcgagaagtggaaaagccggctgaatgccctcggtaagtccgaatttcaaatttataagaaatcaggcatccaggaggtggaccgaacactggcaaaggaagggattaaaagaggagagactgatcaccatgctgtctctaggggcagtgccaagttacgctggttcgtggagcggaacatggttacccctgaagggaaagtggtagaccttggatgcggcagaggtgggtggtcgtactattgtggaggcctgaagaatgtgcgtgaggtcaagggtctcacaaaaggcgggcccggacacgaagaacctatcccaatgagcacgtacggctggaacctagttaggctgcagtccggggtggatgtctttttcataccccctgaaaagtgcgacaccttgctgtgtgatattggagagtcttcaccaaatcccactgtggaggcaggccggacactccgcgtacttaacctggtggaaaattggttgaacaataacacccagttctgcatcaaagttctgaatccgtacatgcctagcgtgatcgagaagatggaagctctccaacgaaaatatggtggggccttagtcagaaacccactgtccaggaatagtactcatgagatgtactgggtgtctaacgccagcggaaatattgtctcatccgtgaacatgataagtcggatgcttatcaaccgctttacaatgagacacaagaaggcgacctatgaacccgacgttgacctgggcagcggcacgaggaatattgggatcgagtctgaggtacctaacctagatattatcggaaaacgaatagaaaagatcaaacaggagcatgaaacctcctggcactacgaccaggatcacccatataagacatgggcttaccatggttcatatgagactaaacagaccggcagcgcatcgtctatggtgaatggggtcgtgcggctcctgacaaagccctgggacgttttgccgactgtgacccaaatggccatgacagataccactcctttcggacagcagcgtgtctttaaggaaaaagtggacacgagaacacaggagcccaaggagggcaccaaaaagctgatgaaaattactgctgaatggctctggaaggagcttggtaaaaagaagaccccacgcatgtgtacaagggaagagttcacgcggaaagtaagaagtaacgccgcactgggggccatctttaccgatgagaataagtggaaatccgctcgcgaagcggtggaggacagcaggttctgggaattagttgataaggagcgaaacctgcacttggaaggaaaatgcgagacttgtgtctacaatatgatgggcaagcgggagaagaaactcggcgaatttgggaaggccaaaggatcaagagcaatttggtacatgtggctgggtgctaggttcctagagtttgaagcccttggcttcctgaacgaggaccattggttttcccgcgaaaattctctcagcggggtggagggagagggcctgcacaagttgggttatatcctgcgtgatgtgagtaaaaaggaagggggagcaatgtacgccgacgacacagctggctgggatacccggattactctcgaggaccttaagaacgaagagatggtcacaaatcacatggaaggcgagcataaaaagctggccgaggcgatattcaaattaacctatcaaaacaaggttgtgagagtacagaggcctacaccccgcgggactgtgatggatatcatttcccgacgggaccagagaggaagcggtcaagtcggcacctacgggctgaatacgtttaccaacatggaagcacagttgatcaggcagatggagggagaaggcgtgttcaaaaatatccagcacctcacagttactgaggaggtggccgtccaaaactggctggctcgcgtgggtagagaacggctatctaggatggccatttcaggggatgactgcgtagttaagccacttgatgaccgtttcgcaaacgctctgaccgccctcaatgatatgggaaagatacgaaaagacatccagcagtgggagcccagtaagggctggaacgattggacacaggtgcctttttgctcccatcacttccatgaactgattatgaaagacggccgcgtcttggtggtgccatgtagaaatcaagatgagttaatcgggcgggctaggattagccagggagccggttggtctctgcgcgaaactgcatgcctcggcaagtcgtatgcgcagatgtggtcacttatgtactttcacagacgggacctgaggctagccgctaacgccatctgtagcgcagtcccgtcccactgggttcccaccagtcgaacgacatggtctatacatgctaaacacgagtggatgaccactgaggacatgctgacagtgtggaatcgtgtatggatcagagaaaacccttggatggaggataagaccccagtggaaagctgggaggaaattccctatctcgggaagcgcgaggaccagtggtgcggatccttgatcggcctgacttcacgggccacctgggccaaaaatattcaagccgcgatcaaccaggtcaggagtcttataggtaatgaggaatacacagattacatgccttctatgaagagattccgccgggaggaagaggaagctggggtgctgtggtga

SEQ ID NO: 14609 - RNA, 9876 nt, synthetic construct
  misc_feature 1..9876: note = derived and/or modified CDS sequence (opt3) from DENV-2__FJ744716__SS-prME
  source 1..9876: mol_type = other RNA
agcgcaggaatgataattatgctgatacccaccgtgatggctttccacctcactactagaaacggggagcctcatatgatcgtcgggattcaagaaaagggtaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagcgatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaataccagttagctgttacaattatggccatcctctgcgtgcccaacgcagtcattctgcagaatgcctggaaggtatcatgtaccatccttgctgtggttagtgtgtccccactgttgctcacatctagccagcagaaaactgactggatacctctggcgctaaccattaagggactgaaccccacggccatcttccttacaaccctctccagaactaataaaaagaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaaatgggaggatcaggccgaaatcagcggctcgtcacccattctgtctatcacgattagtgaggacgggtccatgagcatcaagaacgaagaggaggaacagacactaaccatactgatcagaactggacttctcgtgatttctggcctgtttccaatcagcattcccatcacagcggctgcctggtacttgtgggaggtgaaaaagcagagggcgggtgtcttatgggatgtgccttccccaccccctatggggaaagccgaactggaggacggagcttatcgaataaagcaaaagcgcattctcggctactcacagatcggcgcaggggtttacaaagaaggaaccttccacactatgtggcatgtaacacggggtgccgtgctgatgcacaagggcaaaagaatcgagccgagttgggcggatgtcaagaaagaccttattagctatgggggaggctggaagctggagggtgaatggaaggagggggaagaggtgcaggttttggctctagaaccaggcaaaaatcccagggccgtgcagaccaagcctggcctgtttaaaacgaacactggcaccatcggggcagtctctctcgatttctccccaggaacatcaggtagtcccataattgacaagaaaggcaaggtggtagggctgtacggaaacggcgtcgtgacccgtagcggtgcctatgtttccgctatcgcccaaacagagaagtctattgaggataatcctgaaatcgaggacgatatatttcgcaaacggagacttactattatggacttacacccgggggcaggaaagaccaaaaggtacctgcccgctatcgtgcgagaagccatcaagcggggcctccgcacgttgattctggcgccaacaagagtcgtggccgcagagatggaagaggctctcaggggcctgcctatccggtatcagactcccgccattcgagctgagcataccgggagagaaatagttgaccttatgtgtcacgcaacattcaccatgcgcctgttgtcgccagtgagggtccctaactacaatctaatcattatggatgaggcccatttcactgaccccgccagcatcgctgcgcgtggatatatctcaacccgggtggaaatgggtgaggcagccggcatttttatgacagctacgccaccggggtccagagatcctttcccccagagtaacgccccaataatcgacgaggaaagggagattcccgaacgctcttggaatagcggacacgagtgggtaactgattttaaaggcaagaccgtgtggttcgttccttccatcaaggcaggtaacgacattgccgcttgcctgcggaaaaatgggaagaaagtcatccaactctcaagaaagacatttgattctgaatacgtgaaaaccagaactaacgactgggatttcgtggtcacaaccgacataagcgagatgggagcgaattttaaggccgagagggtaatcgatccacgccgttgtatgaaacccgtgattttaacggacggcgaagagagagttatcctggcaggccctatgccggtgactcatagttccgctgcccagcggagggggcgcattggacgaaacccaaagaatgaaaacgaccagtacatctatatgggtgagccccttgaaaatgatgaggactgcgcacactggaaggaggccaaaatgctgctcgataacataaatacacctgaaggcattatccccagcatgttcgagccagaaagagagaaggtcgacgctattgatggggaataccggttgaggggagaggcccgcaaaacctttgtggacctgatgagaaggggcgatctccctgtttggctggcgtataaggtggcagccgagggtatcaactacgctgaccggcgttggtgtttcgatgggatcaaaaacaatcagatccttgaagagaacgtcgaagtggagatttggaccaaggagggcgaacgcaagaaactaaagccccgatggctggacgccagaatctattctgatccattggctttaaaagagtttaaggagttcgcagccggaaggaaatcactgactctcaatctgattacagagatgggccggcttcctaccttcatgacacaaaagactcgcgacgctctggataacctcgccgtattgagaacggcagaagcagggggaagggcctacaatcacgctctgtccgagctaccggagaccctggaaacactccttctgttaactttgctggccaccgtgacaggtggcatctttctcttcctgatgagtgggcggggaataggcaagatgacccttggtatgtgctgcattatcactgcaagcatcctgctctggtatgctcagattcagccccattggatcgccgcatcgataattttggagtttttcctgatcgttttactaattccagaacctgagaaacagcgaacgccccaagacaaccagctgacctacgtcgtgatcgccatactcacagtggtcgctgcgactatggccaatgaaatggggtttcttgagaagaccaaaaaggacctgggcttgggatctatcgcaacacagcagccagagtccaacattctggatatcgacctcagacctgctagcgcctggaccctgtacgccgttgcaactacattcgtgacgcccatgcttcgccactcaattgaaaatagttctgtaaacgtgtccctcaccgctatcgccaatcaagcgactgtcctgatgggcttggggaaaggatggccgctgagcaagatggatattggtgtgccattactagctatcggctgttattcacaggttaaccctataacactgaccgccgcactccttctgttggtggcccattacgctattatcgggcccggactgcaggcaaaggccaccagggaggcgcagaaacgggctgccgcaggcatcatgaagaatccaacagtcgacggtattactgtaatagatctcgaccccatcccttatgatccgaaatttgaaaagcaactgggacaggtgatgcttttaattctgtgcgttacacaggtgctcatgatgcgtaccacatgggccttgtgtgaggctctgactctagccaccggccccatcagtacactgtgggaaggaaacccaggcagattctggaataccactattgcagtcagcatggctaacatctttagggggtcctacctcgccggagcgggccttctgttctctataatgaaaaatacgacaaacacccgccggggtactgggaacatcggagagaccttgggcgagaagtggaaaagccgactgaatgccctcggtaagtccgaatttcaaatttataagaaatcaggcatccaggaggtggacagaacactggcaaaggaagggattaaaaggggagagactgatcaccacgctgtctctcgcggcagtgccaagttacggtggttcgtggagagaaacatggttacccctgaagggaaagtggtagaccttggatgcggccgtggtgggtggtcgtactattgtggaggcctgaagaatgtgagggaggtcaagggtctcacaaaaggcgggcccggacatgaagaacctatcccaatgagcacgtacggctggaacctagttcggctgcagtccggggtggatgtctttttcataccccctgaaaagtgcgacaccttgctgtgtgatattggagagtcttcaccaaatcccactgtggaggcaggccgcacactccgagtacttaacctggtggaaaattggttgaacaataacacccagttctgcatcaaagttctgaatccgtacatgcctagcgtgatcgagaagatggaagctctccaaagaaaatatggtggggccttagtcaggaacccactgtcccggaatagtactcacgagatgtactgggtgtctaacgccagcggaaatattgtctcatccgtgaacatgataagtcgcatgcttatcaacagatttacaatgaggcataagaaggcgacctatgaacccgacgttgacctgggcagcggcacgcgaaatattgggatcgagtctgaggtacctaacctagatattatcggaaaacggatagaaaagatcaaacaggagcacgaaacctcctggcattacgaccaggatcacccatataagacatgggcttaccacggttcatatgagactaaacagaccggcagcgcatcgtctatggtgaatggggtcgtgcgtctcctgacaaagccctgggacgttttgccgactgtgacccaaatggccatgacagataccactcctttcggacagcagagagtctttaaggaaaaagtggacacgcgcacacaggagcccaaggagggcaccaaaaagctgatgaaaattactgctgaatggctctggaaggagcttggtaaaaagaagaccccaaggatgtgtacacgggaagagttcacgagaaaagtacgcagtaacgccgcactgggggccatctttaccgatgagaataagtggaaatccgctagggaagcggtggaggacagccgattctgggaattagttgataaggagcggaacctgcatttggaaggaaaatgcgagacttgtgtctacaatatgatgggcaagagagagaagaaactcggcgaatttgggaaggccaaaggatcaagggcaatttggtacatgtggctgggtgctcgcttcctagagtttgaagcccttggcttcctgaacgaggaccactggttttcccgtgaaaattctctcagcggggtggagggagagggcctgcataagttgggttatatcctgcgggatgtgagtaaaaaggaagggggagcaatgtacgccgacgacacagctggctgggataccagaattactctcgaggaccttaagaacgaagagatggtcacaaatcacatggaaggcgagcacaaaaagctggccgaggcgatattcaaattaacctatcaaaacaaggttgtgagggtacagcgccctacaccccgagggactgtgatggatatcatttcccggagagaccagaggggaagcggtcaagtcggcacctacgggctgaatacgtttaccaacatggaagcacagttgatccgccagatggagggagaaggcgtgttcaaaaatatccagcatctcacagttactgaggaggtggccgtccaaaactggctggctagagtgggtcgggaaaggctatctcgtatggccatttcaggggatgactgcgtagttaagccacttgatgaccgattcgcaaacgctctgaccgccctcaatgatatgggaaagatacgcaaagacatccagcagtgggagcccagtaagggctggaacgattggacacaggtgcctttttgctcccaccatttccacgaactgattatgaaagacggcagagtcttggtggtgccatgtcggaatcaagatgagttaatcgggagggctcgcattagccagggagccggttggtctctgagagaaactgcatgcctcggcaagtcgtatgcgcagatgtggtcacttatgtactttcatcggagggacctgcgactagccgctaacgccatctgtagcgcagtcccgtcccactgggttcccaccagtcgtacgacatggtctatacacgctaaacatgagtggatgaccactgaggacatgctgacagtgtggaatagagtatggatccgcgaaaacccttggatggaggataagaccccagtggaaagctgggaggaaattccctatctcgggaagcgggaggaccagtggtgcggatccttgatcggcctgacttcaagggccacctgggccaaaaatattcaagccgcgatcaaccaggtcagaagtcttataggtaatgaggaatacacagattacatgccttctatgaagcgcttccggagggaggaagaggaagctggggtgctgtggtga

SEQ ID NO: 14610 - RNA, 9876 nt, synthetic construct
  misc_feature 1..9876: note = derived and/or modified CDS sequence (opt3) from DENV-2__FJ744718__SS-prME
  source 1..9876: mol_type = other RNA
agcgcaggcatgataattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacactatcacttacaaatgcccactactcaggcaaaacgaaccggaggatattgactgttggtgcaattctacctcaacatgggtgacctatggaacttgtacgaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaataccagttagctgttacaattatggccatcctctgcgtgcccaacgcagtcattctgcagaatgcctggaaggtatcatgtaccatccttgctgtggttagtgtgtccccactgttgctcacatctagccagcagaaaactgactggatacctctggcgctaaccattaagggactgaaccccacggccatcttccttacaaccctctccagaactaataaaaagaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaaatgggaggatcaggccgaaatcagcggctcgtcacccattctgtctatcacgattagtgaggacgggtccatgagcatcaagaacgaagaggaggaacagacactaaccatactgatcagaactggacttctcgtgatttctggcctgtttccaatcagcattcccatcacagcggctgcctggtacttgtgggaggtgaaaaagcagagggccggtgtcttatgggatgtgccttccccaccccctatggggaaagccgaactggaggacggagcttatcgaataaagcaaaagggcattctcggctactcacagatcggggcaggagtttacaaagaaggtaccttccacactatgtggcatgtaacacgcggcgccgtgctgatgcacaaggggaaacggatcgagccgagttgggcggatgtcaagaaagaccttattagctatggaggcggttggaagctggagggggaatggaaggagggagaagaggtgcaggttttggctctagaaccaggcaaaaatcccagagccgtgcagaccaagcctggcctgtttaaaacgaacactgggaccatcggagcagtctctctcgatttctccccaggtacatcaggcagtcccataattgacaagaaagggaaggtggtaggactgtacggcaacggtgtcgtgaccaggagcggggcctatgtttccgctatcgcccaaacagagaagtctattgaggataatcctgaaatcgaggacgatatatttcgtaaacgccggcttactattatggacttacacccgggagcaggcaagaccaaaagatacctgcccgctatcgtgagggaagccatcaagcgaggcctccggacgttgattctggcgccaacacgcgtcgtggccgcagagatggaagaggctctcagagggctgcctatcaggtatcagactcccgccattcgggctgagcataccggacgagaaatagttgaccttatgtgtcacgcaacattcaccatgagactgttgtcgccagtgcgcgtccctaactacaatctaatcattatggatgaggcccatttcactgaccccgccagcatcgctgcgaggggttatatctcaacccgtgtggaaatgggcgaggcagccgggatttttatgacagctacgccaccgggatcccgggatcctttcccccagagtaacgccccaataatcgacgaggaaagagagattcccgaaaggtcttggaatagcggccacgagtgggtaactgattttaaaggtaagaccgtgtggttcgttccttccatcaaggcagggaacgacattgccgcttgcctgcgcaaaaatggaaagaaagtcatccaactctcacgaaagacatttgattctgaatacgtgaaaaccagaactaacgactgggatttcgtggtcacaaccgacataagcgagatgggcgcgaattttaaggccgagcgggtaatcgatccaaggcgctgtatgaaacccgtgattttaacggacggcgaagaacgtgttatcctggcagggcctatgccggtgactcatagttccgctgcccagagacggggaaggattggtcgcaacccaaagaatgaaaacgaccagtacatctatatgggcgagccccttgaaaatgatgaggactgcgcacactggaaggaggccaaaatgctgctcgataacataaatacacctgaagggattatccccagcatgttcgagccagaacgagagaaggtcgacgctattgatggagaatacagattgcggggcgaggccaggaaaacctttgtggacctgatgcgcagaggtgatctccctgtttggctggcgtataaggtggcagccgaggggatcaactacgctgacaggcggtggtgtttcgatggcatcaaaaacaatcagatccttgaagagaacgtcgaagtggagatttggaccaaggagggagaacgtaagaaactaaagccccgctggctggacgcccgaatctattctgatccattggctttaaaagagtttaaggagttcgcagccggcagaaaatcactgactctcaatctgattacagagatggggaggcttcctaccttcatgacacaaaagactcgggacgctctggataacctcgccgtattgcacacggcagaagcgggaggtcgcgcctacaatcatgctctgtccgagctaccggagaccctggaaacactccttctgttaactttgctggccaccgtgacaggcgggatctttctcttcctgatgagtggaagaggcataggtaagatgacccttgggatgtgctgcattatcactgcaagcatcctgctctggtatgctcagattcagccccactggatcgccgcatcgataattttggagtttttcctgatcgttttactaattccagaacctgagaaacagaggacgccccaagacaaccagctgacctacgtcgtgatcgccatactcacagtggtcgctgcgactatggccaatgaaatgggctttcttgagaagaccaaaaaggacctgggattgggctctatcgcaacacagcagccagagtccaacattctggatatcgacctccggcctgctagcgcctggaccctgtacgccgttgcaactacattcgtgacgcccatgcttcgacattcaattgaaaatagttctgtaaacgtgtccctcaccgctatcgccaatcaagcgactgtcctgatggggttgggaaaaggttggccgctgagcaagatggatattggcgtgccattactagctatcgggtgttattcacaggttaaccctataacactgaccgccgcactccttctgttggtggcccactacgctattatcggacccggcctgcaggcaaaggccaccagagaggcgcagaaacgcgctgccgcaggtatcatgaagaatccaacagtcgacgggattactgtaatagatctcgaccccatcccttatgatccgaaatttgaaaagcaactgggccaggtgatgcttttaattctgtgcgttacacaggtgctcatgatgaggaccacatgggccttgtgtgaggctctgactctagccaccggacccatcagtacactgtgggaaggcagcccagggcggttctggaacaccactattgcagtctccatggctaatatctttcgtggatcttacctcgccggcgcgggtcttctgttcagcataatgaaaaacacgacaaataccagaagggggactggaaacatcggcgagaccttgggtgagaagtggaaatcccgcctgaacgccctcggcaagtcagaatttcaaatttataagaaatctgggatccaggaggtggaccggacactggcaaaggaaggaattaaacgaggcgagactgatcaccatgctgtcagtagagggtcggccaagttaaggtggttcgtggagcgcaatatggttacccctgaaggaaaagtggtagaccttggctgcggtagagggggatggagctactattgtggcggtctgaagaacgtgagagaggtcaagggcctcacaaaagggggacccggccacgaggaacctatcccaatgtccacgtacgggtggaatctagttcgtctgcagtctggagtggatgtctttttcataccccctgaaaagtgcgacaccttgctgtgtgatattggcgagtcaagcccaaaccccactgtggaggcaggtaggacactccgggtacttaatctggtggaaaactggttgaataacaatacccagttctgcatcaaagttctgaacccgtacatgccttccgtgatcgagaagatggaagctctccaacgcaaatatgggggagccttagtccgaaatccactgagtagaaactctactcatgagatgtactgggtgagcaatgcctcaggcaacattgtctccagtgtgaatatgataagcaggatgcttatcaaccggtttacaatgcgccacaagaaggcgacctatgaacccgacgttgacctgggctctgggacgagaaacattggaatcgagtccgaggtacctaatctagatattatcggtaaaaggatagaaaagatcaaacaggagcatgaaacctcatggcactacgaccaggatcacccatataagacatgggcttaccatggcagctatgagactaaacagaccgggtcggcatctagtatggtgaacggagtcgtgcgactcctgacaaagccctgggacgttttgccgactgtgacccaaatggccatgacagataccactcctttcggccagcagcgggtctttaaggaaaaagtggacacgcgtacacaggagcccaaggagggtaccaaaaagctgatgaaaattactgctgaatggctctggaaggagcttgggaaaaagaagaccccaagaatgtgtacacgcgaagagttcacgaggaaagtacggtccaatgccgcactgggagccatctttaccgatgagaacaagtggaaaagcgctagagaagcggtggaggactcacgcttctgggaattagttgataaggagaggaatctgcacttggaaggcaaatgcgagacttgtgtctacaacatgatgggcaagcgagagaagaaactcggggaatttggaaaggccaaaggttcccgggcaatttggtacatgtggctgggcgctagattcctagagtttgaagcccttgggttcctgaatgaggaccattggttttctagggaaaacagcctcagtggagtggagggcgagggtctgcacaagttggggtatatcctgcgcgatgtgtccaaaaaggaaggaggcgcaatgtacgccgacgacacagctggctgggatacccgtattactctcgaggaccttaagaatgaagagatggtcacaaaccacatggaaggggagcataaaaagctggccgaggcgatattcaaattaacctatcaaaataaggttgtgcgggtacagagacctacacccaggggaactgtgatggatatcattagccgccgagaccagcggggttctggccaagtcgggacctacggactgaacacgtttaccaatatggaagcacagttgatcagacagatggagggcgaaggtgtgttcaaaaacatccagcacctcacagttactgaggaggtggccgtccaaaattggctggctagggtggggcgcgaaagactatcacggatggccattagtggagatgactgcgtagttaagccacttgatgacaggttcgcaaacgctctgaccgccctcaacgatatgggcaagatacgtaaagacatccagcagtgggagccctccaagggctggaatgattggacacaggtgcctttttgcagccatcacttccatgaactgattatgaaagacgggcgagtcttggtggtgccatgtcgcaaccaagatgagttaatcggacgggctcggatttctcagggtgccggctggtcgctgagggaaactgcatgcctcgggaagtcatatgcgcagatgtggagccttatgtactttcaccgcagagacctgcggctagccgctaatgccatctgttccgcagtcccgagtcactgggttcccacctctaggacgacatggagcatacatgctaaacacgagtggatgaccactgaggacatgctgacagtgtggaaccgagtatggatccgtgaaaatccttggatggaggataagaccccagtggaatcctgggaggaaattccctatctcggaaagagagaggaccagtggtgcggctcattgatcggtctgacaagtcgcgccacctgggccaaaaacattcaagccgcgatcaatcaggtccggtctcttatagggaacgaggaatacacagattacatgcctagcatgaagaggttcagacgcgaggaagaggaagctggagtgctgtggtga

SEQ ID NO: 14611 - RNA, 9876 nt, synthetic construct
  misc_feature 1..9876: note = derived and/or modified CDS sequence (opt3) from DENV-2__FJ744722__SS-prME
  source 1..9876: mol_type = other RNA
agcgtgggcatgatcattatgctgatccccaccgtcatggccttccacctcaccactaggaatggggagcctcatatgatcgtttccattcaggaaaagggaaagtctcttctgtttaagacggaggacggtgtgaatatgtgcaccttgatggctatggatttaggcgaactgtgtgaggacacaatcacttacaaatgcccacttctcaggcaaaacgaaccggaggatattgactgttggtgcaattcaaccagtacatgggtgacctatgggacttgtacaaccacgggagagcaccggcgcgaaaagcgaagcgtggcactggtcccccatgtgggcatgggtcttgagactcgtaccgaaacatggatgtcctctgagggggcctggaaacacgcgcagagaatcgagacttggatactgaggcatcctggattcaccatcatggctgccattttggcatacacaatcggcaccacgcactttcagcggactctcattttcatcctgctgacagccgttgctccatcgatgaccatgcgctgcataggcatttcaaacagagattttgtggaaggggtcagcggaggtagttgggtggacatcgtactcgagcacggctcctgtgttactacaatggcaaagaataagcccaccttagatttcgaactgattaaaacggaggccaagcagcctgctacccttaggaaatattgcatcgaagccaagttgacaaacactaccacagagtctcggtgtccaactcaaggggagcccaatctgaaagaagaacaggacaagcgctttgtgtgcaagcatagcatggtcgatcgaggatggggcaacggttgtgggctattcggaaaaggcggcatcgtgacctgcgcgatgtttacatgcaagaaaaatatggaagggaagattgtgcagcctgagaacctcgaatacaccatagtcgttactccacactccggagaggagcatgcagtgggtaatgacacgggcaaacacgggaaggaaatcaaagtaacaccgcagtcaagtattaccgaggccgaactgactggatatggcaccgtgacaatggagtgtagccccagaaccggtcttgatttcaacgaaatggtcctgttgcaaatggagaataaggcttggctcgtgcacaggcagtggtttctggacttacctctgccatggctccccggggccgatactcagggctctaactggatccagaaggagacacttgttacgttcaaaaatcctcatgcaaagaaacaagacgtggtcgtgctgggatcccaggaaggcgctatgcacaccgccttgactggggcgacagagatacagatgtcaagcggaaacctactgtttaccggtcatctcaagtgccggctgcgtatggacaaacttcaactgaagggcatgagttactctatgtgtacagggaagttcaaagtagttaaggaaattgccgagactcagcacggaaccatcgtgatccgcgtccagtatgagggcgatggttccccatgcaaaattcccttcgaaatcatggacttggagaagagatacgtgctcgggaggctgattacggtcaacccgatagtgaccgaaaaagatagccctgttaatatcgaggcagaacccccatttggcgactcgtacattatcatcggagtggagcctggccagttaaagctgaactggttcaagaaagggtcttccattggacaaatgtttgagacaactatgcggggtgctaagcgaatggccatactaggcgataccgcttgggacttcgggtcactcggaggcgtatttacaagtatcggtaaagccctgcatcaggtcttcggggcaatttatggcgccgcttttagcggagtgtcctggactatgaagatccttattggcgttatcataacctggatcgggatgaactctcgcagcacgtcattgagtgtgtccctggtcctcgtgggagtagtgacactgtaccttggcgttatggtccaggcggatagcggttgtgtggtgtcttggaaaaacaaggaactgaagtgcgggtcaggaattttcatcaccgacaatgtccacacttggacagagcagtataaatttcaacccgaaagtccaagcaagttggcatccgccattcagaaagctcaggaggaaggcatctgtggtataagatctgttaccaggctcgagaacctgatgtggaagcagattactcccgagttaaatcacatcctggccgaaaacgaggtgaaactaaccattatgacaggcgatatcaaggggataatgcaagcaggaaaacggtcgctccgccctcagccaacggaactgaagtacagctggaagacctggggcaaagccaagatgctttccactgagtcacataatcagacattcttgatcgacgggccggaaaccgctgagtgccccaacacaaatagagcctggaacagtctggaggtggaagattatggatttggcgtattcactaccaatatttggctcaaactgaaggagaaacaggacgcattttgtgactctaagttaatgagcgcggctatcaaggataacagggccgtccacgcagacatgggttactggattgaatccgccctgaatgatacgtggaaaatcgagaaggcttcattcatagaggtgaaaaactgccattggcctaagagccacacactttggtctaacggggttttggaatccgagatgattatccccaagaatctcgccggacccgtgagtcaacacaactatcgtcctggctaccatacccagatcgcaggtccatggcacctgggcaagctagaaatggacttcgatttttgtgacgggactaccgtcgtggttacagaggattgcggaaatcggggccccagcctgcgaactaccacagcttctgggaagctcattacggaatggtgctgtagatcctgcaccctgccgcctcttaggtaccgcggagaggacggctgttggtatggtatggagatccggccattgaaagaaaaggaggaaaacctggtaaattcattagtaactgccgggcatggacaggtcgataacttcagtctcggcgtgctgggtatggcgctttttctggaggaaatgttgagaacaagggtgggcaccaaacacgccattctcctggtcgctgttagcttcgtgactctaataacagggaatatgtcgtttaaggacctgggacgcgtagtggtcatggtgggcgcaaccatgacggatgacatcgggatgggagttacttacctcgccctgcttgctgccttcaaagtgcgacccacctttgcagcgggcttgttcctgcggaagttaacatccaaggagctcatgatgaccactattggtatcgtcctgctttctcaaagcacaattcctgagaccatcctggaactaacagatgccctcgctctggggatgatggtgttgaaaatggttcgtgacatggagaagtatcagctggccgtgactataatggcaatcttatgcgtccccaacgctgtaattctccagaatgcctggaaagtgtcatgtaccatcctggcagttgtgagtgtctccccacttctgttgacgtctagccagcaaaagacagactggattcctctcgccctgaccatcaaaggactaaaccccactgctatatttctgaccacactttccagaactaataagaaaaggtcatggccactcaacgaagcgattatggccgtgggcatggtaagcatcctggcaagttctttgctgaagaatgatatcccgatgaccggccctttagtggctgggggactcctgacggtctgctacgttcttacaggtcgctccgccgacctggagttggaacgggccaccgatgtgaagtgggaggaccaggctgagattagcggctcgtcacccatactctctatcactattagtgaagatgggtccatgagcatcaaaaacgaggaagaggagcagacactgaccattctaatcagaactggactgcttgtgatatctggcctcttcccagtcagcatccccattacagcagccgcgtggtatctgtgggaagtgaagaaacagagggctggtgttttgtgggacgtaccttccccaccccctatggggaaggccgagttagaagatggagcataccgaatcaaacaacgcggcattctgggctattcacagatcggggccggagtgtacaaggagggtacctttcatacgatgtggcacgtcactcggggcgctgtgctcacccacaaggggaaaagaatagaaccgagttgggcagacgttaagaaagatctgattagctacggaggcggttggaaacttgagggggagtggaaagaaggagaggaagtgcaggtcctggccttggagccaggcaagaatcccagggcggtgcagacaaagcctggcctattcaaaaccaacacagggactatcggagctgtatctctggacttttccccaggtacctcaggcagtcccatcattgataagaaagggaaggtcgtgggactctatggcaacggtgttgtgacgcgtagcggggcctacgtctccgcaatcgcccaaacagaaaaatctatagaggacaatcctgatattgaggacgacatcttccgcaagcggagactgactattatggatcttcatccgggagctggcaagaccaaaaggtatttacccgccatcgtgcgagaagcaataaagcggggcctgcgcacactcattttggctccaaccagagttgtggccgcggagatggaagaggccctgagggggctccctatccggtaccagactcccgcaatccgagctgaacacaccggaagagagattgtcgacctgatgtgtcatgccacattcacgatgcgccttctgtcgccagtgagggtacctaactataatttgatcattatggatgaggctcactttactgaccccgcaagcatagccgcccgtggttacatctcaacccgggtggaaatgggcgaggctgcggggattttcatgacagcaaccccaccgggatccagagatccttttccccagagtaacgccccaatcatcgacgaagagagggagattcccgaacgctcttggaatagcggccatgagtgggttactgatttcaaaggtaagacagtctggtttgtgccttccataaaagctgggaacgacatcgccgcatgcctacgaaagaatggaaagaaagtgattcaactgtcaagaaagaccttcgattctgaatatgtcaaaacgcggactaacgactgggattttgtagtgacaaccgacatcagcgagatgggcgccaatttcaaggctgaaagggttattgacccacgccgttgtatgaaacccgtgatcctcaccgatggcgaggagagagtcatattagcggggcctatgccggtgactcacagttccgccgcacagcggaggggacgcatcggtcgaaacccaaagaatgaaaacgaccagtacatttacatgggcgagcccctggaaaatgatgaggactgcgctcactggaaagaagccaagatgcttctggataacatcaatacacctgaggggattatccccagcatgtttgagccagaaagagagaaggttgacgcaatagatggagaatatcggctcaggggcgaggcccgcaaaaccttcgtggacttgatgagaaggggtgatctgcctgtctggctcgcttacaaggtggccgcggaagggattaactatgcagaccggcgttggtgttttgatggcatcaaaaacaatcagattctggaggagaacgtagaagtggagatctggacaaaggaaggagagcgcaagaaacttaaaccccgatggctagacgccagaatatactctgatccactggctttgaaagagttcaaggagttcgccgctggcaggaaatcattaactctgaatctcatcacggagatggggcggctgcctacctttatgacacaaaagactcgcgacgcacttgacaacctggccgttctccataccgctgaagccggaggtagagcatataatcacgcgttgtccgagctgccggaaacactagagaccctgctccttctgactttattggccacggtcaccggcgggattttcctgtttctcatgagtggaaggggcatcggtaaaatgacactggggatgtgctgcattgtgactgctagcatccttctgtggtacgcccagatacagccccattggattgcagcttcgatcatcctcgagttctttttgattgtgctgttaatcccagaacctgagaagcagcggacaccacaagataaccagctaacatatgtcgttatagccattctgaccgtggtagcagccactatggctaatgaaatgggcttcctcgagaagaccaagaaggaccttggactgggctctatcgcgacgcagcagccagaatccaacattttggatatcgacctgcgacctgccagcgcatggaccctctacgctgtggccactacatttgtcacccccatgctgagacactcaatagagaatagttctgtgaacgtttcccttaccgccatcgcaaatcaagctacagtgctcatggggctgggaaaaggttggccgttgagcaagatggatattggcgccccactgttagcgatcgggtgttactcacaggtcaaccctattactctaacggctgccctgctccttctggtagcacactatgccatcattggacccggcttgcaggctaaagcaacccgcgaggcccagaagagggcggctgccggtatcatgaagaatccaacagtggacgggataactgttattgatctggaccccatcccttacgatccgaaattcgaaaagcaactcggccaggtgatgctgcttgtcttatgcgtgacccaggtcctgatgatgcggacaacctgggcactctgtgaggccttgactctggctacgggacccatcagtacactatgggaaggcaacccagggcgtttttggaataccactattgccgtgagcatggcaaacatattcagaggatcctatctggctggcgccggtctcctattttctatcatgaaaaataccacaaacagcaggcgcgggactggaaacattggcgagaccctgggtgaaaagtggaaatcccggttgaatgcgctgggcaagtcagagttccaaatctacaaaaagtctgggattcaggaggttgaccgaacactcgccaaggaaggaatcaaaagaggcgagacggatcatcacgcagtgagtagggggtcggctaagctgcgctggtttgtagaacggaacatggtgacccctgagggaaaagtcgttgacttaggctgcggtagagggggatggagctattactgtggcggtcttaagaatgtgcgtgaggtcaaaggcctgactaaaggcgggcccgggcatgaagaacctataccaatgtccacatatgggtggaacctcgtgaggctacagtctggagtagatgtgttcttcataccccctgaaaagtgcgacaccctgttgtgtgacattggcgagtcaagcccaaatcccactgttgaagccggtcggacactgcgcgtgctcaaccttgtcgagaattggctgaacaataacacccagttttgcatcaaagtgttgaatccgtacatgccttccgtcattgagaagatggaaacgctgcaacgaaaatacgggggagcactcgtgagaaacccattaagtagaaattctacccacgagatgtattgggttagcaacgcttcaggcaatatcgtatccagtgtgaacatgataagccggatgctgattaaccgcttcacaatgagacataagaaagccacttacgaacccgatgtcgaccttggctctgggaccaggaatatcggaatcgagtccgaaattcctaacctggatataatcggtaagcgaattgagaagatcaaacaggagcacgaaacatcatggcactatgaccaggatcatccatacaagacttgggcctatcacggcagctacgagaccaaacagacagggtcggcgtctagtatggtgaatggagttgtgcggctactcaccaagccctgggacgtcctgccgactgtgacgcaaatggctatgacagataccactccttttggccagcagcgtgtattcaaagaaaaggtggacaccagaacacaggagcccaaggaaggtacgaaaaagttgatgaaaattaccgcagagtggctgtggaaggagctcgggaaaaagaaaactccacgcatgtgtacaagggaagagtttacccggaaggttagatccaacgccgctcttggagccatcttcactgatgaaaataagtggaaaagcgcacgcgaggccgtcgaggactcaaggttttgggaactggtggataaggagcgaaacttacatctggaaggcaaatgcgagacatgtgtgtataatatgatgggcaagcgggagaagaagttgggggagttcggaaaggctaaaggttccagagcgatatggtacatgtggctcggcgccaggtttctggagttcgaagcactagggtttcttaacgaggaccactggttctctcgcgaaaatagcctgagtggagtcgagggcgaaggtctccaccgtctggggtacatcttgcgggacgtttccaagaaagagggaggcgctatgtatgccgatgacaccgcaggctgggatacaagaattactctggaggacctcaagaacgaagagatggtgaccaatcatatggaaggggagcacaagaaacttgccgaagctatctttaaactgacgtaccaaaacaaagtagtgagggtccagcgccctacaccccgaggaacagtgatggatattatcagccggagagaccagaggggttctggccaagttgggacttatggattaaataccttcacaaacatggaggcccagctgattcgccagatggagggcgaaggtgtgttcaagaatatacagcatttgactgtcaccgaggaaatcgcggtgcaaaactggctcgcaagagtagggcgggagaggctgtcacgtatggccattagtggagatgactgcgttgtgaaaccactagatgaccgatttgcttccgcccttacggcactgaacgatatgggcaagatccgcaaagacatccagcagtgggagcccagcagaggctggaatgattggacacaggtccctttctgctctcaccattttcacgaactcattatgaaggacgggcgggtgctggtggtcccatgtaggaaccaagacgagttgataggacgcgctagaatctcgcagggtgccggctggtcattacgggaaaccgcttgcctgggaaagagctacgcccagatgtggtccctcatgtatttccacaggcgagatcttcgtctggcagcgaatgccatttgtagtgctgttccgtctcattgggtgcccactagcagaacaacctggtccatccacgccaaacatgagtggatgactaccgaagacatgctaacagtatggaaccgcgtgtggattcaggagaatccttggatggaggataagacgccagtcgaatcatgggaggaaatcccctacctgggaaaacgggaggaccaatggtgcggcagtctcataggtttgacctctagggcaacttgggctaagaacatccaggtggccattaatcaggttagaagcctgatcgggaacgaagagtatacagattacatgccttccatgaaacgctttcggagggaggaagaggaagcaggagtgctttggtga

SEQ ID NO: 14612 - RNA, 9876 nt, synthetic construct
  misc_feature 1..9876: note = derived and/or modified CDS sequence (opt3) from DENV-2__FJ744723__SS-prME
  source 1..9876: mol_type = other RNA
agcgtgggcatgatcattatgctgatccccaccgtcatggccttccacctcaccactagaaacggggagcctcatatgatcgtttccattcaggaaaagggaaagtctcttctgtttaagacggaggacggtgtgaatatgtgcaccttgatggctatggatttaggcgaactgtgtgaggacacaatcacttacaaatgcccactactcaggcaaaacgaaccggaggatattgactgttggtgcaattcaaccagtacatgggtaacctatgggacttgtacaaccacgggagagcaccggcgcgaaaagcgaagcgtggcactggtcccccatgtgggcatgggtcttgagactcgtaccgaaacatggatgtcctctgagggggcctggaaacacgcgcagagaatcgagacttggatactgaggcatcctggattcaccatcatggctgccattttggcatacacaatcggcaccacgcactttcagcggactctcattttcatcctgctgacagccgttgctccatcgatgaccatgcgctgcataggcatttcaaacagagattttgtggaaggggtcagcggaggtagttgggtggacatcgtactcgagcacggctcctgtgttactacaatggcaaagaataagcccaccttagatttcgaactgattaaaacggaggccaagcagcctgctacccttaggaaatattgcatcgaagccaagttgacaaacactaccacagagtctcggtgtccaactcaaggggagcccagcctgaaagaagaacaggacaagcgctttgtgtgcaagcattccatggtcgatcgaggatggggcaatggttgtgggctattcggaaaaggcggcatcgtgacctgcgcgatgtttacatgcaagaaaaacatggaagggaagattgtgcagcctgagaatctcgaatacaccatagtcgttactccacactcaggagaggagcatgcagtgggtaacgacacgggcaaacacgggaaggaaatcaaagtaacaccgcagagtagcattaccgaggccgaactgactggatatggcaccgtgacaatggagtgttctcccagaaccggtcttgatttcaatgaaatggtcctgttgcaaatggagaacaaggcttggctcgtgcacaggcagtggtttctggacttacctctgccatggctccccggggccgatactcagggctccaattggatccagaaggagacacttgttacgttcaaaaaccctcatgcaaagaaacaagacgtggtcgtgctgggatcacaggaaggcgctatgcacaccgccttgactggggcgacagagatacagatgagcagtggaaatctactgtttaccggtcatctcaagtgccggctgcgtatggacaaacttcaactgaagggcatgtcttactccatgtgtacagggaagttcaaagtagttaaggaaattgccgagactcagcacggaaccatcgtgatccgcgtccagtatgagggcgatggtagcccatgcaaaattcccttcgaaatcatggacttggagaagagatacgtgctcgggaggctgattacggtcaacccgatagtgaccgaaaaagattcgcctgttaacatcgaggcagaacccccatttggcgactcttacattatcatcggagtggagcctggccagttaaagctgaattggttcaagaaagggtcctcaattggacaaatgtttgagacaactatgcggggtgctaagcgaatggccatactaggcgataccgcttgggacttcgggagtctcggaggcgtatttacaagcatcggtaaagccctgcatcaggtcttcggggcaatttatggcgccgctttttccggagtgtcttggactatgaagatccttattggcgttatcataacctggatcgggatgaacagccgctcaacgagtttgtccgtgagcctggtcctcgtgggagtagtgacactgtaccttggcgttatggtccaggcggattctggttgtgtggtgtcatggaaaaataaggaactgaagtgcgggagtggaattttcatcaccgacaacgtccacacttggacagagcagtataaatttcaacccgaaagcccatccaagttggcatctgccattcagaaagctcaggaggaaggcatctgtggtataagatcggttaccaggctcgagaatctgatgtggaagcagattactcccgagttaaaccacatcctggccgaaaatgaggtgaaactaaccattatgacaggcgatatcaaggggataatgcaagcaggaaaacggagcctccgccctcagccaacggaactgaagtactcctggaagacctggggcaaagccaagatgctttcaactgagagtcataaccagacattcttgatcgacgggccggaaaccgctgagtgccccaatacaaacagagcctggaactctctggaggtggaagattatggatttggcgtattcactaccaacatttggctcaaactgaaggagaaacaggacgcattttgtgacagcaagttaatgtccgcggctatcaaggataatagggccgtccacgcagacatgggttactggattgaatcagccctgaacgatacgtggaaaatcgagaaggctagcttcatagaggtgaaaaattgccattggcctaagtctcacacactttggtccaacggggttttggaaagtgagatgattatccccaagaatctcgccggacccgtgagccaacacaattatcgtcctggctaccatacccagatcgcaggtccatggcacctgggcaagctagaaatggacttcgatttttgtgacgggactaccgtcgtggttacagaggattgcggaaaccggggcccctctctgcgaactaccacagcttccgggaagctcattacggaatggtgctgtagatcatgcaccctgccgcctcttaggtaccgcggagaggacggctgttggtatggtatggagatccggccattgaaagaaaaggaggaaaatctggtgaacagtttagtaactgccgggcatggacaggtcgataatttcagcctcggcgtgctgggtatggcgctttttctggaggaaatgttgagaacaagggtgggcaccaaacacgccattctcctggtcgctgtttcgttcgtgactctaataacagggaacatgtcctttaaggacctgggacgcgtagtggtcatggtgggcgcaaccatgacggatgacatcgggatgggagttacttacctcgccctgcttgctgccttcaaagtgcgacccacctttgcagcgggcttgttcctgcggaagttaacatctaaggagctcatgatgaccactattggtatcgtcctgcttagccaatcaacaattcctgagaccatcctggaactaacagatgccctcgctctggggatgatggtgttgaaaatggttcgtgacatggagaagtatcagctggccgtgactataatggcaatcttatgcgtccccaatgctgtaattctccagaacgcctggaaagtgagttgtaccatcctggcagttgtgtccgtctctccacttctgttgacgagctcccagcaaaagacagactggattcctctcgccctgaccatcaaaggactaaatcccactgctatatttctgaccacactttcaagaactaacaagaaaaggagctggccactcaatgaagcgattatggccgtgggcatggtaagtatcctggcatcttccttgctgaagaacgatatcccgatgaccggccctttagtggctgggggactcctgacggtctgctacgttcttacaggtcgcagcgccgacctggagttggaacgggccaccgatgtgaagtgggaggaccaggctgagatttcgggctcatctcccatactcagtatcactatttccgaagatgggagcatgtctatcaaaaatgaggaagaggagcagacactgaccattctaatcagaactggactgcttgtgataagcggcctcttcccagtctccatccccattacagcagccgcgtggtatctgtgggaagtgaagaaacagagggctggtgttttgtgggacgtaccttcaccaccccctatggggaaggccgagttagaagatggagcataccgaatcaaacaacgcggcattctgggctatagtcagatcggggccggagtgtacaaggagggtacctttcatacgatgtggcacgtcactcggggcgctgtgctcacccacaaggggaaaagaatagaaccgagctgggcagacgttaagaaagatctgatttcttacggaggcggttggaaacttgagggggagtggaaagaaggagaggaagtgcaggtcctggccttggagccaggcaagaaccccagggcggtgcagacaaagcctggcctattcaaaaccaatacagggactatcggagctgtatccctggacttttcaccaggtaccagtggcagccccatcattgataagaaagggaaggtcgtgggactctatggcaacggtgttgtgacgcgttccggggcctacgtctctgcaatcgcccaaacagaaaaatcgatagaggacaaccctgatattgaggacgacatcttccgcaagcggagactgactattatggatcttcatccgggagctggcaagaccaaaaggtatttacccgccatcgtgcgagaagcaataaagcggggcctgcgcacactcattttggctccaaccagagttgtggccgcggagatggaagaggccctgagggggctccctatccggtaccagactcccgcaatccgagctgaacacaccggaagagagattgtcgacctgatgtgtcatgccacattcacgatgcgccttctgagcccagtgagggtacctaattataacttgatcattatggatgaggctcactttactgaccccgcatcaatagccgcccgtggttacatctccacccgggtggaaatgggcgaggctgcggggattttcatgacagcaaccccaccgggaagtagagatccttttccccagtctaatgccccaatcatcgacgaagagagggagattcccgaacgcagctggaactccggccatgagtgggttactgatttcaaaggtaagacagtctggtttgtgccttcaataaaagctgggaatgacatcgccgcatgcctacgaaagaacggaaagaaagtgattcaactgtctagaaagaccttcgatagcgaatatgtcaaaacgcggactaatgactgggattttgtagtgacaaccgacatcagtgagatgggcgccaacttcaaggctgaaagggttattgacccacgccgttgtatgaaacccgtgatcctcaccgatggcgaggagagagtcatattagcggggcctatgccggtgactcactccagcgccgcacagcggaggggacgcatcggtcgaaatccaaagaacgaaaatgaccagtacatttacatgggcgagcccctggaaaacgatgaggactgcgctcactggaaagaagccaagatgcttctggataatatcaacacacctgaggggattatcccctctatgtttgagccagaaagagagaaggttgacgcaatagatggagaatatcggctcaggggcgaggcccgcaaaaccttcgtggacttgatgagaaggggtgatctgcctgtctggctcgcttacaaggtggccgcggaagggattaattatgcagaccggcgttggtgttttgatggcatcaaaaacaaccagattctggaggagaatgtagaagtggagatctggacaaaggaaggagagcgcaagaaacttaaaccccgatggctagacgccagaatatactcagatccactggctttgaaagagttcaaggagttcgccgctggcaggaaatccttaactctgaacctcatcacggagatggggcggctgcctacctttatgacacaaaagactcgcgacgcacttgacaatctggccgttctccataccgctgaagccggaggtagagcatataaccacgcgttgagtgagctgccggaaacactagagaccctgctccttctgactttattggccacggtcaccggcgggattttcctgtttctcatgagcggaaggggcatcggtaaaatgacactggggatgtgctgcattgtgactgcttcgatccttctgtggtacgcccagatacagccccattggattgcagcttctatcatcctcgagttctttttgattgtgctgttaatcccagaacctgagaagcagcggacaccacaagataatcagctaacatatgtcgttatagccattctgaccgtggtagcagccactatggctaacgaaatgggcttcctcgagaagaccaagaaggaccttggactgggctccatcgcgacgcagcagccagaaagcaatattttggatatcgacctgcgacctgcctcagcatggaccctctacgctgtggccactacatttgtcacccccatgctgagacacagtatagagaactcttccgtgaatgttagccttaccgccatcgcaaaccaagctacagtgctcatggggctgggaaaaggttggccgttgtcaaagatggatattggcgccccactgttagcgatcgggtgttacagtcaggtcaatcctattactctaacggctgccctgctccttctggtagcacactatgccatcattggacccggcttgcaggctaaagcaacccgcgaggcccagaagagggcggctgccggtatcatgaagaacccaacagtggacgggataactgttattgatctggaccccatcccttacgatccgaaattcgaaaagcaactcggccaggtgatgctgcttgtcttatgcgtgacccaggtcctgatgatgcggacaacctgggcactctgtgaggccttgactctggctacgggacccatcagcacactatgggaaggcaatccagggcgtttttggaacaccactattgccgtgtccatggcaaatatattcagaggatcttatctggctggcgccggtctcctttttagcatcatgaaaaacaccacaaattccaggcgcgggactggaaacattggcgagaccctgggtgaaaagtggaaatcacggttgaacgcgctgggcaagtctgagttccaaatctacaaaaagagtgggattcaggaggttgaccgaacactcgccaaggaaggaatcaaaagaggcgagacggatcatcacgcagtgtcgagggggagcgctaagctgcgctggtttgtagaacggaatatggtgacccctgagggaaaagtcgttgacttaggctgcggtagagggggatggtcctattactgtggcggtcttaagaacgtgcgtgaggtcaaaggcctgactaaagggggacccggccatgaagaacctataccaatgtctacatatgggtggaatctcgtgaggctacagtcaggagtagatgtgttcttcataccccctgaaaagtgcgacaccctgttgtgtgacattggcgagagctccccaaaccccactgttgaagccggtcggacactgcgcgtgctcaatcttgtcgagaactggctgaataacaatacccagttttgcatcaaagtgttgaacccgtacatgcctagtgtcattgagaagatggaaacgctgcaacgaaaatacgggggagcactcgtgagaaatccattatctaggaacagcacccacgagatgtattgggtttcaaatgcttccggcaacatcgtaagtagcgtgaatatgatatctcggatgctgattaaccgcttcacaatgagacataagaaagccacttacgaacccgatgtcgaccttggctccgggaccaggaacatcggaatcgagtcagaaattcctaatctggatataatcggtaagcgaattgagaagatcaaacaggagcacgaaacaagctggcactatgaccaggatcatccatacaagacttgggcctatcacggctcgtacgagaccaaacagacagggtctgcgagttccatggtgaacggagttgtgcggctactcaccaagccctgggacgtcctgccgactgtgacgcaaatggctatgacagataccactccttttggccagcagcgtgtattcaaagaaaaggtggacaccagaacacaggagcccaaggaaggtacgaaaaagttgatgaaaattaccgcagagtggctgtggaaggagctcgggaaaaagaaaactccacgcatgtgtacaagggaagagtttacccggaaggttagaagcaatgccgctcttggagccatcttcactgatgaaaacaagtggaaatcagcacgcgaggccgtcgaggactccaggttttgggaactggtggataaggagcgaaatttacatctggaaggcaaatgcgagacatgtgtgtataacatgatgggcaagcgggagaagaagttgggggagttcggaaaggctaaaggttctagagcgatatggtacatgtggctcggcgccaggtttctggagttcgaagcactagggtttcttaatgaggaccactggttcagccgcgaaaacagtctgtccggagtcgagggcgaaggtctccaccgtctggggtacatcttgcgggacgttagcaagaaagagggaggcgctatgtatgccgatgacaccgcaggctgggatacaagaattactctggaggacctcaagaatgaagagatggtgaccaaccatatggaaggggagcacaagaaacttgccgaagctatctttaaactgacgtaccaaaataaagtagtgagggtccagcgccctacaccccgaggaacagtgatggatattatctctcggagagaccagaggggttcaggccaagttgggacttatggattaaacaccttcacaaatatggaggcccagctgattcgccagatggagggcgaaggtgtgttcaagaacatacagcatttgactgtcaccgaggaaacggcggtgcaaaattggctcgcaagagtagggcgggagaggctgagtcgtatggccatctccggagatgactgcgttgtgaaaccactagatgaccgatttgctagcgcccttacagcactgaacgatatgggcaagattcgcaaagacatccagcagtgggagccctctagaggctggaacgattggacccaggtccctttctgctcgcaccattttcacgaactcatcatgaaggacgggcgggtgctggtggtcccatgtaggaatcaagacgagttgattggacgcgctagaatatcacagggtgccggctggagcttacgggaaactgcttgcctggggaagtcctacgcccagatgtggagtctcatgtatttccacaggcgagatcttcgtctggcagcgaacgccatctgttctgctgttccgagccattgggtgcccacatccagaaccacttggtcaattcacgccaaacatgagtggatgaccacagaagacatgctaacggtatggaatcgcgtgtggatccaggagaacccttggatggaggataagaccccagtcgaaagttgggaggaaattccctacctgggaaaacgggaggaccaatggtgcggctctctcatcggtttgactagcagggcaacatgggctaagaatatacaggtggccatcaaccaggttagatccctgattgggaatgaagagtataccgattacatgccttcaatgaaacgctttcggagggaggaagaggaagcaggagtgctttggtga

SEQ ID NO: 14613 - RNA, 9876 nt, synthetic construct
  misc_feature 1..9876: note = derived and/or modified CDS sequence (opt3) from DENV-2__FJ744724__SS-prME
  source 1..9876: mol_type = other RNA
agcgcaggcatgataattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatcgtcgatcgaggctggggtaatgggtgtggactattcggcaaaggcgggattgtgacttgcgcaatgtttacctgcaagaaaaacatggaaggaaagatagtgcagcctgagaatctcgaatacacaatcgtcgttaccccacactccggtgaggagcatgccgtgggcaacgacactgggaaacacggaaaggaaattaaagtaacgccgcagtcaagtgtgacagaggctgaactgaccggctatggtactgtcaccatggagtgtagccccagaacagggcttgatttcaatgaaatggtgctgttgcaaatggagaacaaggcctggctcgttcacaggcagtggtttctggacttacctctgccatggctccccggcgcagataagcaggagtctaattggatccagaaagaaacccttgtgactttcaagaaccctcatgctaaaaagcaagacgtcgtggtactgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggttgtgaaagagattgcagagacccagcacggaacaatcgtcatccgcgtgcagtatgaaggcgatggttccccatgcaagattcccttcgagatcatggacttggagaagagatacgtcctcgggaggctgattactgtgaacccgatagttaccgagaaggatagccctgtgaacatcgaagctgagcccccatttggcgactcgtacattatcatcggagtagagcctggccagttaaagctgaattggttcaaaaaggggtcttccattggacaaatgtttgaaacgaccatgcggggtgccaaacgaatggctatactaggcgatacagcctgggacttcgggtcactcggaggcgtctttacaagtatcggtaaggcactgcatcaggtgttcggggccatttatggcgctgcgtttagcggagtttcctggaccatgaaaatccttattggcgtgatcataacatggatcgggatgaactctcgcagcacttcattgagtgtctccctggtgctcgtaggaattgtgaccctgtaccttggcgttatggtccaggcagatagcggttgtgtggtgtcttggaagaataaggagctgaaatgcgggtcaggaatcttcattacggacaacgtccacacatggaccgaacagtataagtttcaacccgagagtccaagcaaattggcctccgctatccagaaggcccaggaagagggcatatgtggtattagatctgttactaggctcgagaatctgatgtggaaacagatcacacccgaattaaaccacattctggcagagaatgaagtgaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtattcaccacaaacatctggctcaagctgaaagaaaagcaggacgcgttttgtgactctaagttaatgagcgctgccattaaagataatagggcagtccatgccgacatgggttattggatcgagtccgctctgaacgatacttggaagatagagaaagcctcattcattgaagtgaagaattgccactggcctaaaagccataccctttggtctaacggggttttggagtccgaaatgatcatcccaaagaacctcgcaggacccgtgagtcaacacaattaccgtcctggctaccacacgcagattgctggtccatggcatctgggcaagctagagatggacttcgatttttgtgacgggacaaccgtcgtggttactgaagattgcggaaaccggggccccagcctgcgaaccacaactgcctctgggaaactcatcaccgagtggtgctgtagatcctgcacactgccgcctcttaggtatcgcggagaggacggctgttggtacggtatggaaattcggccattgaaggagaaagaagagaatctggtgaactcattagtaacggcggggcacggacagatagataatttcagtctcggcgtcctgggtatggccctttttctggaagagatgttgagaaccagggtgggcactaagcatgctatcctcctggtggcagtcagcttcgttacactaattaccgggaacatgtcgtttaaagacctgggacgcgtggtagtgatggtcggcgccactatggctgatgacatcgggatgggagtgacatatctcgccctgcttgcagcgttcaaggttcgacccacctttgccgctggcttgctgttacggaagctcacgtccaaagagctgatgatgactaccattggtatcgtgcttctgtctcaaagcacaatacctgaaaccgtcctagagctcactgatgccctggcattggggatgatggtgctgaagatcgttcgtgacatggaaaaataccagttagctgtgacaattatggccatcctctgcgtccccaatgcagtaattctgcagaacgcctggaaggtgtcatgtaccatccttgctgttgtgagtgtctccccactgttgctcacatctagccagcagaaaactgactggatacctctggcgctaaccattaagggactgaatcccacggccatcttccttacaaccctctccagaactaacaaaaagaggtcatggccactgaatgaggcaatcatggctgtgggcatggtaagcattttggccagttctctgttaaagaacgatataccgatgaccggccctctcgtggccgggggactgcttacagtctgctatgttctgactggtcgctccgctgacttggaactcgagcgggcaaccgatgtgaaatgggaggaccaggccgaaatcagcggctcgtcacccattctgtctatcacgattagtgaggatgggtccatgagcatcaagaatgaagaggaggaacagacactaaccatactgatcagaactggacttctcgtgatttctggcctgtttccaatcagcattcccatcacagcggctgcctggtacttgtgggaggtcaaaaagcagagggccggtgtgttatgggacgttccttccccaccccctatggggaaagccgaactggaggatggagcttatcgaataaagcaaaagggcattctcggctactcacagatcggggcaggagtatacaaagaaggtaccttccacactatgtggcatgtgacacgcggcgccgtcctgatgcacaaggggaaacggatcgagccgagttgggcggacgtgaagaaagatcttattagctatggaggcggttggaagctggagggggaatggaaggagggagaagaggttcaggtgttggctctagaaccaggcaaaaaccccagagccgtccagaccaagcctggcctgtttaaaacgaatactgggaccatcggagcagtgtctctcgacttctccccaggtacatcaggcagtcccataattgataagaaagggaaggtagtcggactgtacggcaacggtgtggttaccaggagcggggcctatgtgtccgctatcgcccaaacagagaagtctattgaggacaaccctgaaatcgaggatgacatatttcgtaaacgccggcttactattatggacttacacccgggagcaggcaagaccaaaagatacctgcccgctatcgtcagggaagccatcaagcgaggcctccggacgttgattctggcgccaacacgcgtggttgccgcagagatggaagaggctctcagagggctgcctatcaggtatcagactcccgccattcgggctgagcataccggacgagaaatagtggatcttatgtgtcacgcaacattcaccatgagactgttgtcgccagtccgcgtgcctaattacaacctaatcattatggacgaggcccatttcactgatcccgccagcatcgctgcgaggggttatatctcaacccgtgtagaaatgggcgaggcagccgggatttttatgacagctacgccaccgggatcccgggaccctttcccccagagtaatgccccaataatcgatgaggaaagagagattcccgaaaggtcttggaacagcggccacgagtgggtgactgactttaaaggtaagaccgtttggttcgtcccttccatcaaggcagggaatgatattgccgcttgcctgcgcaaaaacggaaagaaagtgatccaactctcacgaaagacatttgactctgaatacgtgaaaaccagaactaatgattgggacttcgtcgtaacaaccgatataagcgagatgggcgcgaactttaaggccgagcgggtgatcgacccaaggcgctgtatgaaacccgttattttaacggacggcgaagaacgtgtgatcctggcagggcctatgccggtcactcatagttccgctgcccagagacggggaaggattggtcgcaatccaaagaacgaaaatgatcagtacatctatatgggcgagccccttgaaaacgacgaggattgcgcacactggaaggaggccaaaatgctgctcgacaatataaacacacctgaagggattatccccagcatgttcgagccagaacgagagaaggtggatgctattgacggagaatacagattgcggggcgaggccaggaaaacctttgttgatctgatgcgcagaggtgacctccctgtgtggctggcgtataaggtcgcagccgaggggatcaattacgctgataggcggtggtgtttcgacggcatcaaaaacaaccagatccttgaagagaatgtggaagtagagatttggaccaaggagggagaacgtaagaaactaaagccccgctggctggatgcccgaatctattctgacccattggctttaaaagagtttaaggagttcgcagccggcagaaaatcactgactctcaacctgattacagagatggggaggcttcctaccttcatgacacaaaagactcgggatgctctggacaatctcgccgtgttgcacacggcagaagcgggaggtcgcgcctacaaccatgctctgtccgagctaccggagaccctggaaacactccttctgttaactttgctggccaccgttacaggcgggatctttctcttcctgatgagtggaagaggcataggtaagatgacccttgggatgtgctgcattatcactgcaagcatcctgctctggtatgctcagattcagccccactggatcgccgcatcgataattttggagtttttcctgatcgtcttactaattccagaacctgagaaacagaggacgccccaagacaatcagctgacctacgtggtgatcgccatactcacagtcgttgctgcgactatggccaacgaaatgggctttcttgagaagaccaaaaaggatctgggattgggctctatcgcaacacagcagccagagtccaatattctggacatcgatctccggcctgctagcgcctggaccctgtacgccgtggcaactacattcgtaacgcccatgcttcgacattcaattgaaaacagttctgtgaatgtctccctcaccgctatcgccaaccaagcgactgtgctgatggggttgggaaaaggttggccgctgagcaagatggacattggcgttccattactagctatcgggtgttattcacaggtgaatcctataacactgaccgccgcactccttctgttggtcgcccactacgctattatcggacccggcctgcaggcaaaggccaccagagaggcgcagaaacgcgctgccgcaggtatcatgaagaacccaacagtagatgggattactgtgatagacctcgatcccatcccttatgacccgaaatttgaaaagcaactgggccaggttatgcttttaattctgtgcgtgacgcaggtcctcatgatgaggaccacatgggccttgtgtgaggctctgactctagccaccggacccatcagtacactgtgggaaggcaatccagggcggttctggaacaccactattgcagtgagcatggctaatatctttcgtggatcctacctcgccggcgcgggtcttctgttctctataatgaaaaacacgacaaataccagaagggggactggaaacatcggcgagaccttgggtgagaagtggaaaagccgcctgaacgccctcggcaagtccgaatttcaaatttataagaaatcagggatccaggaggtcgatcggacactggcaaaggaaggaattaaacgaggcgagactgaccaccatgctgtgtctagagggagtgccaagttaaggtggttcgttgagcgcaatatggtgacccctgaaggaaaagtagtggatcttggctgcggtagagggggatggtcgtactattgtggcggtctgaagaacgtcagagaggttaagggcctcacaaaagggggacccggccacgaggaacctatcccaatgagcacgtacgggtggaatctagtgcgtctgcagtccggagtcgacgtgtttttcataccccctgaaaagtgcgataccttgctgtgtgacattggcgagtcttcaccaaaccccactgtagaggcaggtaggacactccgggtgcttaatctggttgaaaactggttgaataacaatacccagttctgcatcaaagtgctgaacccgtacatgcctagcgtcatcgagaagatggaagctctccaacgcaaatatgggggagccttagtgcgaaatccactgtccagaaacagtactcatgagatgtactgggtctctaatgccagcggcaacattgtgtcatccgttaatatgataagtaggatgcttatcaaccggtttacaatgcgccacaagaaggcgacctatgaacccgacgtagatctgggcagcgggacgagaaacattggaatcgagtctgaggtgcctaatctagacattatcggtaaaaggatagaaaagatcaaacaggagcatgaaacctcctggcactacgatcaggaccacccatataagacatgggcttaccatggctcatatgagactaaacagaccgggagcgcatcgtctatggtcaacggagtggttcgactcctgacaaagccctgggatgtgttgccgactgtcacccaaatggccatgacagacaccactcctttcggccagcagcgggtgtttaaggaaaaagtagatacgcgtacacaggagcccaaggagggtaccaaaaagctgatgaaaattactgctgaatggctctggaaggagcttgggaaaaagaagaccccaagaatgtgtacacgcgaagagttcacgaggaaagtgcggagtaatgccgcactgggagccatctttaccgacgagaacaagtggaaatccgctagagaagcggttgaggatagccgcttctgggaattagtcgacaaggagaggaatctgcacttggaaggcaaatgcgagacttgtgtgtacaacatgatgggcaagcgagagaagaaactcggggaatttggaaaggccaaaggttcacgggcaatttggtacatgtggctgggcgctagattcctagagtttgaagcccttgggttcctgaatgaggatcattggttttccagggaaaactctctcagcggagtggagggcgagggtctgcacaagttggggtatatcctgcgcgacgtcagtaaaaaggaaggaggcgcaatgtacgccgacgatacagctggctgggacacccgtattactctcgaggatcttaagaatgaagagatggttacaaaccacatggaaggggagcataaaaagctggccgaggcgatattcaaattaacctatcaaaataaggtggtacgggtgcagagacctacacccaggggaactgtcatggacatcatttcccgccgagatcagcggggtagcggccaagtggggacctacggactgaacacgtttaccaatatggaagcacagttgatcagacagatggagggcgaaggtgttttcaaaaacatccagcacctcacagtgactgaggaggtcgccgtgcaaaattggctggctagggtagggcgcgaaagactatctcggatggccatttcaggagacgattgcgttgtgaagccacttgacgataggttcgcaaacgctctgaccgccctcaacgacatgggcaagatacgtaaagatatccagcagtgggagcccagtaagggctggaatgactggacacaggtccctttttgctcccatcacttccatgaactgattatgaaagatgggcgagtgttggtggtcccatgtcgcaaccaagacgagttaatcggacgggctcggattagccagggtgccggctggtctctgagggaaactgcatgcctcgggaagtcgtatgcgcagatgtggtcacttatgtactttcaccgcagagacctgcggctagccgctaatgccatctgtagcgcagttccgtcccactgggtgcccaccagtaggacgacatggtctatacatgctaaacacgagtggatgaccactgaggatatgctgacagtatggaaccgagtgtggatccgtgaaaatccttggatggaggacaagaccccagtcgaaagctgggaggaaattccctatctcggaaagagagaggatcagtggtgcggctccttgatcggtctgacttcacgcgccacctgggccaaaaacattcaaacagccatcaatcaggtgcggagtcttatagggaacgaggaatacacggactacatgccttctatgaagaggttcagacgcgaggaagaggaagcgggagttctgtggtga

SEQ ID NO: 14614 - RNA, 9876 nt, synthetic construct
  misc_feature 1..9876: note = derived and/or modified CDS sequence (opt3) from DENV-2__FJ906957__SS-prME
  source 1..9876: mol_type = other RNA
agcgccggcatgatcattatgctgatccccaccgtgatggctttccacctcaccactagaaatggggagcctcatatgatcgtctccattcaggaaaagggaaaatctcttctgtttaagacggaggacggtgttaatatgtgcaccttgatggcaatggatttaggcgaactgtgtgaggacacaatcacttacaaatgcccactactcaggcaaaatgaaccggaggatattgactgttggtgcaattcaaccagtacatgggtgacctatgggacttgtacaaccacgggagagcaccggcgcgaaaagcgaagcgtagccctggtgccccatgtcggcatgggtcttgagactcgtaccgaaacatggatgtcctctgagggggcgtggaaacacgctcagagaatcgagacttggatactgaggcatcctggattcaccatcatggccgcaattttggcctacacaatcggcaccacgcactttcagcgggctctcattttcatcctgctgactgcagtggccccatcgatgacaatgcgctgcataggcatttcaaacagagattttgttgaaggggtgagcggaggtagttgggtcgacatcgtgctcgagcacggctcctgtgtaaccactatggctaagaataagcccacattagatttcgaactgattaaaaccgaggccaagcagcctgcgacgcttaggaaatattgcatcgaagcaaagttgaccaacacaactaccgagtctcggtgtccaacacaaggggagcccagcctgaaagaggaacaagacaagcgctttgtttgcaagcattccatggtggatcgaggatggggcaatggttgtgggctattcggaaaaggcggcatcgtcacttgcgccatgtttacctgcaagaaaaacatggaagggaagattgtgcagcctgagaatctcgaatacacaatagtggtcaccccacactcaggagaggagcatgctgttggtaacgacactggcaaacacgggaaggaaatcaaagtgacgccgcagagtagcattacagaggccgaactgaccggatatggcactgtaaccatggagtgttctcccagaacaggtcttgatttcaatgaaatggtgctgttgcaaatggagaacaaggcatggctcgtccacaggcagtggtttctggacttacctctgccatggctccccggggctgataagcagggctccaattggatccagaaagagacccttgtgactttcaagaaccctcatgccaaaaagcaagacgttgtggtcctgggatcacaggaaggcgcgatgcacacagccttgacgggggcaaccgagatacagatgagcagtggaaatctactgtttactggtcatctcaaatgccggctgcgtatggacaaacttcaactgaagggcatgtcttactccatgtgtacagggaaattcaaggtggtaaaagaaattgctgagacccagcacggaacaatcgttatccgcgtgcagtatgagggcgatggtagcccatgcaagattcccttcgaaatcatggacttggagaaaagatacgtcctcgggaggctgattactgtgaacccgatagtcaccgaaaaggattcgcctgtgaacatcgaggccgaacccccatttggcgactcttacattatcatcggagttgagcctggccagttaaagctgaattggttcaaaaaggggtcctcaattggacaaatgtttgagacgaccatgcggggtgctaaacgaatggccatactaggcgatacagcatgggacttcgggagtctcggaggcgtgtttactagcatcggtaaggccctgcatcaggtattcggggctatttatggcgcggcattttccggagtctcttggaccatgaaaatccttattggcgtgatcataacatggatcgggatgaacagccgctcaacaagtttgtccgttagcctggtgctcgtcggaattgtgaccctgtaccttggcgtaatggtgcaggccgattctggttgtgttgtctcatggaagaataaggaactgaaatgcgggagtggaatcttcattacggacaacgtgcacacatggaccgagcagtataagtttcaacccgaaagcccatccaaattggcttctgccatccagaaggcacaggaggaaggcatatgtggtattagatcggtgactaggctcgagaatctgatgtggaaacagatcacacccgagttaaaccacattctggccgaaaatgaggtcaagctaaccatcatgactggcgatataaaagggatcatgcaagctggaaagcggagcctccgccctcagccaaccgaactgaagtactcctggaaaacatggggcaaggccaaaatgctttcaacggagagtcataaccagaccttcttgattgacgggccggaaactgcagagtgccccaatacaaacagagcgtggaactctctggaggttgaagattatggatttggcgtgttcaccacaaacatctggctcaagctgaaagagaagcaggacgctttttgtgacagcaagttaatgtccgccgcaattaaagataatagggccgtgcacgctgacatgggttactggatcgaatcagccctgaacgatacttggaagatagagaaagccagcttcattgaggtaaagaattgccattggcctaaatctcacaccctttggtccaacggggtcttggaaagtgagatgatcatcccaaagaacctcgctggacccgtgagccaacacaattatcgtcctggctaccatacgcagattgccggtccatggcacctgggcaagctagaaatggacttcgatttttgtgacgggacaaccgttgtggtcactgaggattgcggaaaccggggcccctctctgcgaaccacaactgcgtccgggaaactcatcaccgaatggtgctgtagatcatgcacactgccgcctcttaggtaccgcggagaggacggctgttggtatggtatggagattcggccattgaaggaaaaagaggaaaatctggtgaacagtttagttacggccgggcatggacaggtggataatttcagcctcggcgtactgggtatggctctttttctggaggaaatgttgagaaccagggtcggcactaagcacgcaatactcctggtggccgcttcgttcgtgacactaatcaccgggaacatgtcctttaaagacctgggacgcgtcgttgtgatggtaggcgccactatgacagatgacattgggatgggagtgacctacctcgcactgcttgcggccttcaaggtccgacccacgtttgctgccggcttgctgttacggaagctcacttctaaagagctgatgatgaccacaatcggtattgtgcttctgagccaatcaaccatccctgagactatactagaactcacagatgcactggctttggggatgatggttctgaagatcgtgcgtaatatggagaaatatcagttagccgtcaccattatggcaatcctctgcgtgcccaacgccgttattctgcagaatgcttggaaggtgagttgtacaatccttgcggtcgtatccgtgtctccactgttgctcactagctcccagcagaagaccgactggatacctctggccctaacgattaagggactgaaccccacagcaatcttccttaccactctctcaagaaccaataaaaagaggagctggccactgaacgaagctatcatggccgttggcatggtgagtattttggcctcttccctgttaaagaatgacataccgatgacaggccctctcgtcgctgggggactgcttactgtgtgctacgtactgaccggtcgcagcgcagatttggagctcgaacgggccacggacgtgaaatgggaggatcaggcggagatctcgggctcatctcccattctgagtatcacaatttccgaagacgggagcatgtctatcaagaacgaggaagaggagcagaccctaactatactgatcagaacaggacttctcgtcattagcggcctgtttccagtttccatccccattaccgctgccgcatggtatttgtgggaagtgaaaaagcagagggccggtgtgttatgggatgtcccttcaccaccccctatggggaaagctgagctggaagacggagcataccgaatcaagcaaaagggcatactcggctatagtcagattggggccggagtgtacaaagagggtactttccatacaatgtggcacgttacccgcggcgcggtactgatgcacaaggggaaacggatcgaaccgagctgggctgatgtgaagaaagaccttatctcttacggaggcggttggaagctggagggggagtggaaggaaggagaggaagtccaggtgttggccctagagccaggcaaaaatcccagagcagttcagacgaagcctggcctgtttaaaactaacaccgggacaattggagccgtgtccctcgatttctcaccaggtaccagtggcagccccatcatagacaagaaagggaaggtcgtgggactgtatggcaacggtgtagtcacaaggtccggggcttacgtgtctgccattgcacaaactgaaaagtcgatcgaggataatcctgagattgaagacgatatctttcgtaaacgccggcttaccataatggacttacatccgggagctggcaagacgaaaagatatctgcccgccattgttagggaggcgatcaagcgaggcctccggacattgatcctggccccaactcgcgtggtcgcagctgaaatggaggaagccctcagagggctgcctattaggtaccagacccccgctatccgggcagagcacacaggacgagagattgtggaccttatgtgtcatgccaccttcactatgagactgttgagcccagttcgcgtgcctaactataatctaataatcatggatgaagcccacttcaccgaccccgcttcaattgcggcaaggggttacatctccacacgtgtcgagatgggcgaagccgctgggatctttatgacggccactccaccgggaagtcgggatcctttcccccagtctaacgcaccaattatagacgaggagagagaaatccccgagaggagctggaactccggccatgaatgggtgaccgattttaaaggtaagacagtatggttcgtgccttcaattaaggccgggaacgacatcgctgcgtgcctgcgcaaaaatggaaagaaagttattcaactctctcgaaagacctttgatagcgagtatgtcaaaactagaacaaacgactgggatttcgtggtgaccacggacatcagtgaaatgggcgccaattttaaggcagagcgggtcatagatccaaggcgctgtatgaaacccgtaatcttaactgacggcgaggaacgtgtgattctggctgggcctatgccggttacacactccagcgccgcacagagacggggaaggatcggtcgcaacccaaagaatgagaacgaccagtacatttacatgggcgaaccccttgagaatgatgaagactgcgcccactggaaggaggctaaaatgctgctcgataacatcaatacccctgaggggataattccctctatgttcgaaccagagcgagaaaaggtggacgccatcgatggagagtatagattgcggggcgaagcgaggaaaacctttgtcgacctgatgcgcagaggtgatctccctgtgtggctggcatacaaggttgccgctgaggggattaactatgccgacaggcggtggtgtttcgatggcatcaaaaacaatcagatacttgaggaaaacgtggaggtcgaaatctggactaaggagggagagcgtaagaaactaaagccccgctggctggacgctcgaatttactcagatccattggcattaaaagaatttaaggagttcgccgctggcagaaaatccctgacactcaatctgatcaccgaaatggggaggcttcctacattcatgactcaaaagacgcgggacgccctggataacctcgcagtgttgcataccgcggaggccggaggtcgcgcttataatcacgccctgagtgaactaccggagacactggagactctccttctgttaaccttgctggcaacagtaaccggcgggatttttctcttcctgatgagcggaagaggcatcggtaagatgactcttgggatgtgctgcataattacggcttcgatcctgctctggtacgcccagatccagccccattggattgcagcctctatcatattggaatttttcctgattgtgttactaatcccagagcctgaaaaacagaggacaccccaagacaaccagctgacatatgttgtcattgctatcctcactgtggtggcggccaccatggcaaatgagatgggctttcttgaaaagactaaaaaggacctgggattgggctccatagctacccagcagccagagagcaacatcctggatattgacctccggcctgcctcagcctggactctgtacgcagtcgctacaacgttcgttacccccatgcttcgacacagtatcgaaaattcttccgtgaacgtaagcctcactgccattgcgaatcaagctacagtgctgatggggttgggaaaaggttggccgctgtcaaagatggatatcggcgtcccattactagccattgggtgttacagtcaggtgaaccctatcaccctgaccgcagccctccttctgttggttgctcactatgcaataattggacccggcctgcaggccaaggcgacaagagaagctcagaaacgcgccgcagccggtatcatgaagaatccaactgtggacgggatcacggtcattgatctcgaccccataccttacgatccgaaatttgagaagcaactgggccaggtaatgcttttaatcctgtgcgtgacccaggttctcatgatgaggacaacttgggctttgtgtgaagccctgaccctagcaacaggacccattagcaccctgtgggagggcaacccagggcggttctggaatactacgatcgctgtgtccatggccaacatttttcgtggatcttatctcgcgggcgccggtcttctgttcagcatcatgaaaaatacaaccaacactagaagggggaccggaaacataggcgaaacattgggtgagaagtggaaatcccgcctgaatgcactcggcaagtcagagtttcaaatctacaagaaatctgggattcaggaagtcgaccggactctggctaaggagggaatcaaacgaggcgaaaccgatcatcacgccgtgagtagagggtcggcaaagttaaggtggttcgtcgagcgcaacatggtgacacctgagggaaaagttgtggaccttggctgcggtcggggaggatggagctattactgtggcggtctgaagaatgtaagagaagtgaagggcctcacgaaagggggacccggccatgaggaacctattccaatgtccacctatgggtggaacctagtccgtctgcagtctggagttgatgtgtttttcataccccctgagaagtgcgacactttgctgtgtgatataggcgaatcaagcccaaatcccacagtcgaggctggtaggaccctccgggtgcttaacctggtagagaattggttgaacaataacactcagttctgcattaaagtgctgaatccgtacatgccttccgttatcgaaaagatggaggccctccaacgcaaatacgggggagccttagtgcgaaacccactgagtagaaattctacacacgaaatgtattgggtcagcaacgcgtcaggcaatatcgtgtccagtgtcaacatgattagcaggatgcttataaaccggtttaccatgcgccataagaaggctacgtacgagcccgacgtggacctgggctctgggaccagaaatatcggaattgaatccgagatccctaacctagatattatcggtaaaaggatagagaagatcaaacaggaacacgagacatcatggcactatgaccaggatcatccatacaagacttgggcatatcacggcagctacgaaaccaaacagacagggtcggcctctagtatggttaatggagtagtgcgactcctgactaagccctgggacgtcttgccgaccgtgacacaaatggctatgaccgatactacgcctttcggccagcagcgggtttttaaggagaaagtggacacacgtacccaggaacccaaggagggtactaaaaagctgatgaaaattaccgccgagtggctctggaaggaacttgggaaaaagaagacaccaagaatgtgtacgcgcgaggagttcaccaggaaagtccggtccaacgcagccctgggagctatctttactgatgagaataagtggaaaagcgcgagagaggccgtggaagactcacgcttctgggagttagtagataaggaaaggaacctgcatttggagggcaaatgcgaaacatgtgtgtataatatgatgggcaagcgagagaagaaactcggggagtttggaaaggcaaaaggttcccgggctatttggtacatgtggctgggcgccagattcctagaatttgaggcacttgggttcctgaacgaagaccactggttttctagggagaatagcctcagtggagttgaaggcgagggtctgcacaagttggggtacatcctgcgcgatgtctccaaaaaggagggaggcgccatgtatgctgacgacaccgccggctgggatactcgtattacactcgaagaccttaagaacgaggaaatggtgaccaatcatatggagggggaacacaaaaagctggcggaggcaatattcaaattaacataccaaaacaaggtggtccgggttcagagacctactcccaggggaaccgtgatggatatcattagccgccgagaccagcggggttctggccaagtagggacgtatggactgaatacctttacaaacatggaggcccagttgatcagacagatggaaggcgagggtgtgttcaaaaatatccagcatctcactgtcaccgaagagattgctgtgcaaaactggctggccagggttgggcgcgagagactatcacggatggcaataagtggagatgactgcgtggtcaagccacttgatgacaggttcgctaacgccctgacagctctcaatgatatgggcaagatccgtaaagacattcagcagtgggaaccctccaagggctggaacgattggactcaggtgcctttttgcagccaccatttccacgagctgatcatgaaagacgggcgagtattggttgtgccatgtcgcaatcaagatgaattaattgggagagcacggatctctcagggtgcaggctggtcgctgagggagaccgcgtgcctcgggaagtcatacgcccagatgtggagccttatgtattttcaccgcagagacctgcggctagctgccaacgcaatatgttccgctgtcccgagtcattgggtgcccacgtctaggacaacctggagcatccacgccaaacatgaatggatgactacagaggacatgctgaccgtgtggaatcgagtctggattcaggagaacccttggatggaagataagactccagttgagtcctgggaagagatcccctacctcggaaagcgtgaagaccaatggtgcggctcattgattggtctgaccagtagagcaacatgggccaaaaatatccaggcggctataaaccaggtgcgctctcttattgggaatgaggagtatacggattacatgcctagcatgaagcggttcaggagagaagaggaagaggccggagtactgtggtga

SEQ ID NO: 14615 - RNA, 9876 nt, synthetic construct
  misc_feature 1..9876: note = derived and/or modified CDS sequence (opt3) from DENV-2__FJ906958__SS-prME
  source 1..9876: mol_type = other RNA
agcgtgggaatgatcattatgctgataccaaccgtcatggccttccacctcacaactagaaacggggagcctcatatgatcgtttccattcaggaaaagggaaaatctcttctgtttaagacggaggacggtgtgaatatgtgcaccttgatggctatggatttaggcgaactgtgtgaggacacaatcacttacaaatgcccactactcaggcaaaacgaaccggaggatattgactgttggtgcaattcaaccagtacatgggtaacctatgggacttgtacaaccacgggagagcaccggcgcgaaaagcgaagcgtggcactggtcccacatgtgggcatgggtcttgagactcgtaccgaaacatggatgtcctctgagggggcctggaaacacgcgcagagaatcgagacttggatactgaggcatcctggattcaccatcatggctgccattttggcatacacaatcggcaccacgcactttcagcgggccctcattttcatcctgctgactgctgttgcaccatcgatgacaatgcgctgcataggcatttcaaacagagattttgtggaaggggtcagcggaggtagttgggtggacatcgtactcgagcacggctcctgtgttaccactatggccaagaataagcccacattagatttcgaactgattaaaaccgaggctaagcagcctgccacgcttaggaaatattgcatcgaagcgaagttgaccaacacaactaccgagtctcggtgtccaacacaaggggagcccagcctgaaagaagaacaggacaagcgctttgtgtgcaagcattccatggtcgatcgaggatggggcaatggttgtgggctattcggaaaaggcggcatcgtgacttgcgcaatgtttacctgcaagaaaaacatggaagggaagattgtgcagcctgagaatctcgaatacacaatagtcgttaccccacactcaggagaggagcatgccgtgggtaacgacactggcaaacacgggaaggaaatcaaagtaacgccgcagagtagcattacagaggctgaactgaccggatatggcactgtgaccatggagtgttctcccagaacaggtcttgatttcaatgaaatggtcctgttgcaaatggagaacaaggcctggctcgtgcacaggcagtggtttctggacttacctctgccatggctccccggggcagatacccagggctccaattggatccagaaggagactcttgttacattcaaaaaccctcatgctaagaaacaagacgtggtcgtgctgggatcacaggaaggcgccatgcacacggcgttgaccggggccactgagatacagatgagcagtggaaatctactgtttacaggtcatctcaagtgccggctgcgtatggacaaacttcaactgaagggcatgtcttactccatgtgtaccgggaagttcaaagtagttaaggaaattgcagagacacagcacggaactatcgtgatccgcgtccagtatgagggcgatggtagcccatgcaaagtgcccttcgaaattatggacttggagaagagatacgtcctcgggaggctgatcaccgtgaacccggttgtgacggaaaaagattcgcctgtaaacattgaggctgaacccccatttggcgactcttacataatcattggagtcgagcctggccagttaaagctgaattggttcaagaaagggtcctcaatcggacaaatgtttgagaccacaatgcggggtgccaagcgaatggctatcctaggcgatactgcctgggacttcgggagtctcggaggcgtgtttaccagcattggtaaagcactgcatcaggttttcggggccatatatggcgctgcgttttccggagtgtcttggacaatgaagatccttattggcgtcatcattacttggatcgggatgaacagccgctcaaccagtttgtccgtgagcctggtactcgtgggaatagttacgctgtaccttggcgtcatggtgcaggcagattctggttgtgtggtctcatggaaaaataaggaactgaagtgcgggagtggaatcttcattacagacaacgttcacacctggactgagcagtataaatttcaacccgaaagcccatccaagttggcctctgctatccagaaagcccaggaggaaggcatttgtggtatcagatcggtgacaaggctcgagaatctgatgtggaagcagataacccccgagttaaaccacattctggcagaaaatgaggtgaaactaactatcatgaccggcgatattaaggggatcatgcaagccggaaaacggagcctccgccctcagccaacagaactgaagtactcctggaagacgtggggcaaagctaagatgctttcaaccgagagtcataaccagactttcttgatagacgggccggaaacagccgagtgccccaataccaacagagcatggaactctctggaggtagaagattatggatttggcgtcttcacaactaacatctggctcaaactgaaggagaaacaggacgcgttttgtgacagcaagttaatgtccgctgccgtgaaggataatagggcagttcacgccgacatgggttactggattgaatcagctctgaacgatacctggaaaatcgagaaggccagcttcattgaggtgaaaaattgccattggcctaagtctcacacgctttggtccaacggggtcttggaaagtgagatgatcatacccaagaatctcgcaggacccgtgagccaacacaattatcgtcctggctaccatacacagattgctggtccatggcacctgggcaagctagaaatggacttcgatttttgtgacgggaccactgttgtggtaaccgaggattgcggaaaccggggcccctctctgcgaacaactaccgcctccgggaagctcatcacagaatggtgctgtagatcatgcacgctgccgcctcttaggtaccgcggagaggacggctgttggtatggtatggagatccggccattgaaagaaaaggaggaaaatctggtcaacagtttagtgaccgcggggcagggacaagtggataatttcagcctcggcgtcctgggtatggccctttttctggaggaaatgttgagaactagggttggcacaaaacatgctattctcctggtggcagtatcgttcgtgaccctaatcactgggaacatgtcctttaaggacctgggacgcgtcgtggttatggtgggcgccacaatgaccgatgacattgggatgggagtcacgtacctcgctctgcttgccgcattcaaagtgcgacccacttttgcggccggcttgctgttacggaagctcacctctaaggagctgatgatgacaaccataggtatcgttcttctgagccagtcaactattcctgagacaatcctagaactcaccgatgctctggccttggggatgatggtgctgaaaattgtccgtgacatggagaagtatcagttagcagtaacaatcatggctatactctgcgtgcccaatgccgttatcctgcagaacgcatggaaagtgagttgtactattcttgccgtcgtgtccgtatctccactgttgctcaccagctcccaacagaagacggactggatccctctggctctaacaattaaaggactgaatcccaccgcgatcttccttactaccctctcaagaacaaacaagaaaaggagctggccactgaatgaagccataatggcagtgggcatggtcagtattttggcttcttccctgttaaagaacgatatcccgatgactggccctctcgttgccgggggactgcttaccgtgtgctacgtgctgacgggtcgcagcgccgacttggagctcgaacgggctacagatgtcaagtgggaggaccaggcagagatctcgggctcatctcccattctgagtataaccatctccgaagatgggagcatgtctattaaaaatgaggaagaggagcagactctaacaatcctgattagaaccggacttctcgtgatcagcggcctgtttccagtttccatacccatcactgccgcggcttggtatttgtgggaagtaaagaaacaaagggccggtgtgttatgggacgtcccttcaccaccccctatggggaaggcagagctggaagatggagcctaccgaattaaacagaagggcatcctcggctatagtcagattggggctggagtgtacaaggagggtacattccacaccatgtggcatgttacgcgcggcgcagtgctgatgcacaaagggaagcggatcgaaccgagctgggccgacgtcaaaaaggatcttatatcttacggaggcggttggaaactggagggggagtggaaggaaggagaggaagtgcaggtattggcgctagagccaggcaagaaccccagagctgtccaaactaaacctggcctgtttaagaccaatacagggaccattggagccgtgtccctcgacttctcaccaggtacaagtggcagccccatcatcgataaaaaggggaaagttgtgggactgtatggcaacggtgtcgtgactaggtccggggcatacgtttctgccattgctcagaccgaaaagtcgatcgaggacaaccctgatatagaggacgacatttttcgtaagcgccggcttacgatcatggatttacacccgggagccggcaaaacaaagagatatctgcccgcaattgtgagggaagctatcaaacgaggcctccggactttgatactggccccaacccgcgtcgtggcggccgagatggaagaggcactcagagggctgcctattaggtaccagacacccgctatccgggccgaacataccggacgagagatcgtagaccttatgtgtcacgctactttcaccatgagactgttgagcccagtgcgcgttcctaattataacctaattatcatggatgaggcacatttcacagaccccgcctcaattgccgctaggggttacatatccacgcgtgtcgaaatgggcgaggcggcagggatctttatgactgccaccccaccgggaagtcgggatcctttcccccaatctaatgctccaattatcgacgaagagagagagatccccgaaaggagctggaactccggccacgagtgggtgacagattttaagggtaaaaccgtgtggttcgtcccttcaattaaggccgggaatgacatagcagcctgcctgcgcaagaacggcaagaaggtaatccagctctctcgaaaaacttttgatagcgaatatgctaagacaagaaccaatgactgggatttcgtggttacgactgacattagtgagatgggcgcgaactttaaagccgaacgggtgatcgacccaaggcgctgtatgaagcccgtcattttaacagatggcgaggagcgtgtgatcctggcagggcctatgccggttacccattccagcgctgcccagagacggggaaggataggtcgcaatcccaaaaacgaaaatgaccagtacatctacatgggcgagccccttgaaaacgatgaggactgcgcacactggaaggaagccaagatgctgctcgataatattaacacccctgaggggatcattccctctatgttcgagccagaacgagagaaagtggacgctatcgatggagaatatagattgcggggcgaggccaggaagacttttgtcgacctgatgcgcagaggtgatctccctgtgtggctggcgtacaaagtagcagccgaagggataaattatgctgacaggcggtggtgtttcgatggcattaagaacaaccaaatccttgaggagaatgtggaagttgagatttggacaaaagaaggagagcgtaagaagctaaaaccccgctggctggacgcccgaatctactcagatccattggctttaaaggagtttaaagagttcgcagccggcagaaagtccctgaccctcaacctgataacagagatggggaggcttcctactttcatgacgcagaaaacccgggacgctctggacaatctcgccgtcttgcacacagcagaagcgggaggtcgcgcctataaccatgctctgagtgagctaccggaaactctggagaccctccttctgttaacattgctggccaccgtgactggcgggatctttctcttcctgatgagcggaagaggcattggtaagatgacgcttgggatgtgctgcatcgtgaccgcatcgattctgctctggtacgctcagatccagccccactggatagccgcatctattatcttggagtttttcctgatcgtcttactaattccagaacctgagaagcaaaggacaccccaggataatcagctgacttatgttgtgatcgccatactcaccgtagtggctgcgacaatggccaacgaaatgggctttcttgagaaaaccaagaaagacctgggattgggctccattgcaactcagcaaccagaaagcaatatcctggatattgacctccggcctgcttcagcctggacactgtacgccgtcgcaacgaccttcgtgactcccatgcttcgacatagtatcgagaactcttccgttaatgtgagcctcacagctatagccaaccaggcgaccgtcctgatggggttgggaaagggttggccgctgtcaaaaatggatatcggcgtaccattactagctattgggtgttacagtcaggtgaatcctatcaccctgacagccgcactccttctgttggttgcccactatgctattatcggacccggcctgcaggcaaaggccactagagaggcgcaaaagcgcgctgccgcaggtattatgaaaaacccaacggtggacgggatcaccgtcatagatctcgaccccattccttacgatccgaagtttgaaaaacagctgggccaggtgatgcttttagtcctgtgcgtgacacaagttctcatgatgaggactacctgggccttgtgtgaggctctgacactagccaccggacccatcagcactctgtgggaaggcaatccagggcggttctggaacacgacaatcgcagtgtccatggctaatatttttcgtggatcttatctcgccggcgcgggtcttctgttcagcataatgaagaacaccactaataccagaagggggacaggaaacatcggcgagactttgggtgaaaaatggaagtcccgcctgaacgccctcggcaaatcagagtttcagatttacaagaagtctgggatccaggaggtagaccggaccctggcaaaagaaggaattaagcgaggcgagacagatcaccatgctgtgagtagagggtcggccaaattaaggtggttcgtcgaacgcaatatggttacgcctgagggaaaggtggtcgaccttggctgcggtagagggggatggagctattactgtggcggtctgaaaaacgtgcgggaggtaaagggcctcaccaaagggggacccggccacgaggaacctatcccaatgtccacttatgggtggaatctagtgcgtctgcagtctggagttgatgtgtttttcataccccctgaaaaatgcgacacattgctgtgtgacatcggcgagtcaagcccaaaccccaccgtcgaagcaggtaggactctccgggtgcttaatctggtcgagaactggttgaataacaatacacaattctgcattaaggtgctgaacccgtacatgccttccgttatcgagaaaatggaaaccctccagcgcaagtacgggggagctttagtacgaaatccactgagtagaaactctacgcatgagatgtattgggtgagcaatgcctcaggcaacattgtctccagtgtgaatatgatcagcaggatgcttataaaccggtttaccatgcgccacaaaaaggccacatacgaacccgatgttgacctgggctctgggactagaaacattggaatcgagtccgaaatccctaatctagatattataggtaagaggatcgagaaaattaagcaggagcatgaaacctcatggcactatgaccaggatcacccatacaaaacatgggcgtatcatggcagctacgagactaagcaaaccgggtcggcttctagtatggtgaacggagtcgtgcgactcctgacaaaaccctgggacgtattgccgaccgtgactcagatggcaatgacggatacaacccctttcggccagcagcgggtttttaaggaaaaggtcgacactcgtacccaagagcccaaagaaggtacaaagaaactgatgaagatcacggccgagtggctctggaaagagcttgggaagaaaaagaccccaagaatgtgtactcgcgaagagttcacaaggaaggtgcggtccaatgctgccctgggagcaatttttaccgatgaaaacaaatggaaaagcgccagagaggctgtggaggactcacgcttctgggaattagtcgataaagagaggaatctgcacttggaaggcaagtgcgagacttgtgtttataacatgatgggcaaacgagaaaagaagctcggggagtttggaaaagcgaagggttcccgggccatctggtacatgtggctgggcgcaagattcctagagtttgaagctcttgggttcctgaatgaggaccattggttttctagggaaaacagcctcagtggagtggagggcgaaggtctgcacaaattggggtacatactgcgcgacgtatccaagaaagagggaggcgccatgtatgcagatgacacagccggctgggatacccgtatcacactcgaggaccttaagaatgaagagatggtgactaaccacatggaaggggagcataagcggctggctgaagccattttcaaattaacctaccagaataaggtcgtgagagttcagaggcctacgccccgcggaaccgtgatggatatcattagccgacgggaccaaagaggttctggccaggtcgggacatatggactgaacacttttaccaatatggaggcgcagttgatcaggcagatggagggcgaaggtgtgttcaaaaacattcaacacctcacagtaactgaggaaatagcagttcagaattggctggcccgcgtggggagagagcggctatcaaggatggctatcagtggagatgactgcgtcgtgaagccacttgatgaccgtttcgcctccgcactgaccgctctcaacgatatgggcaaaattcgaaaggacatccagcagtgggagcccagccgcggctggaacgattggacgcaagtgcctttttgctctcatcacttccatgaactgatcatgaaggacgggagagtcttggttgtgccatgtcggaatcaggacgagttaattggaagggcccgcatatcgcagggtgctggctggtcactgagagaaacagcctgcctcgggaaaagctacgcacagatgtggtcccttatgtattttcaccggagggatctgcgactagcggccaacgctatctgtagtgccgtaccgtctcactgggtgcccaccagccgtactacatggtccattcatgcaaagcacgagtggatgaccactgaagacatgctgaccgtctggaatagagtgtggatccaagagaacccttggatggaggataaaacaccagttgaatcatgggaggaaattccctacctcggaaagcgcgaggaccagtggtgcggcagtttgatcggtctgacgtctcgggctacctgggccaaaaatatacaggcagccatcaaccaggtgaggagccttattgggaatgaagagtatactgattacatgccttccatgaagagattccgccgggaggaagaggaagcgggagtcctgtggtga

SEQ ID NO: 14616 - RNA, 9876 nt, synthetic construct
  misc_feature 1..9876: note = derived and/or modified CDS sequence (opt3) from DENV-2__FJ898452__SS-prME
  source 1..9876: mol_type = other RNA
agcgcaggcatgataattatgctgatacccaccgtgatggctttccacctcactactagaaacggggagcctcatatgatcgtcggtattcaagaaaagggaaaatcccttctgtttaagacggaggacggcgttaatatgtgcaccttgatggcaatggatttaggggaactgtgtgaggacacgatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagcactggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggtgctcattttcatcctgctgactgctgttgcaccatctatgacaatgcgctgcatagggatttcgaacagagattttgtggaaggagtctcaggtggcagctgggtggacatcgtactcgagcacgggagttgtgttaccactatggccaagaataagcccacattagatttcgaactgattaaaaccgaggctaagcagcctgccacgcttaggaaatattgcatcgaagcgaagttgaccaacacaactaccgagtcccggtgtccaacacaaggagagccctctctgaaagaagaacaggacaagcgctttgtgtgcaagcatagcatggtcgatcgaggctggggtaatgggtgtggactattcggcaaaggcgggatcgtgacttgcgcaatgtttacctgcaagaaaaacatggaaggaaagattgtgcagcctgagaatctcgaatacacaatagtcgttaccccacactccggtgaggagcatgccgtgggcaacgacactgggaaacacggaaaggaaatcaaagtaacgccgcagtcaagtattacagaggctgaactgaccggctatggtactgtgaccatggagtgtagccccagaacagggcttgatttcaatgaaatggtcctgttgcaaatggagaacaaggcctggctcgtgcacaggcagtggtttctggacttacctctgccatggctccccggcgcagataagcaggagtctaattggatccagaaagaaacccttgttactttcaagaaccctcatgctaaaaagcaagacgtggtcgtgctgggatcccaggagggcgccatgcacacagcgttgacgggggccaccgaaatacagatgtcaagcggaaatctactgtttactggtcatctcaaatgccggctgcgtatggacaaacttcaactgaagggcatgagttactctatgtgtacagggaaattcaaggtagttaaagagattgcagagacccagcacggaacaatcgtgatccgcgtccagtatgaaggcgatggttccccatgcaagattcccttcgagatcatggacttggagaagagatacgtgctcgggaggctgattactgtcaacccgatagtgaccgagaaggatagccctgttaacatcgaagctgagcccccatttggcgactcgtacattatcatcggagtggagcctggccagttaaagctgaattggttcaaaaaggggtcttccattggacaaatgtttgaaacgaccatgcggggtgccaaacgaatggctatactaggcgatacagcctgggacttcgggtcactcggaggcgtatttacaagtatcggtaaggcactgcatcaggtcttcggggccatttatggcgctgcgtttagcggagtgtcctggaccatgaaaatccttattggcgttatcataacatggatcgggatgaactctcgcagcacttcattgagtgtgtccctggtcctcgtgggaattgtaaccctgtaccttggcgtgatggttcaggcagatagcggttgtgtcgtgtcttggaagaataaggagctgaaatgcgggtcaggaatcttcattacggacaacgtgcacacatggaccgaacagtataagtttcaacccgagagtccaagcaaattggcctccgctatccagaaggcccaggaagagggcatatgtggtattagatctgtcactaggctcgagaatctgatgtggaaacagatcacacccgaattaaaccacattctggcagagaatgaagttaagctaaccatcatgactggcgatataaaagggatcatgcaagccggaaagcggtcgctccgccctcagccaaccgagctgaagtacagctggaaaacatggggcaaggctaaaatgctttccacggaatcatataaccagaccttcttgattgacgggccggagactgccgagtgccccaatacaaacagagcatggaatagtctggaagtggaggattacggatttggcgtgttcaccacaaacatctggctcaagctgaaagaaaagcaggacgcgttttgtgactctaagttaatgagcgctgccattaaagataatagggcagtacatgccgacatgggttattggatcgagtccgctctgaacgatacttggaagatagagaaagcctcattcattgaagtcaagaattgccactggcctaaaagccataccctttggtctaacggggtgttggagtccgaaatgatcatcccaaagaacctcgcaggacccgttagtcaacacaattaccgtcctggctaccacacgcagattgctggtccatggcatctgggcaagctagagatggacttcgatttttgtgacgggacaaccgtgatcgtcactgaagattgcggaaaccggggccccagcctgcgaaccacaactgcctctgggaaactcattaccgagtggtgctgtagatcctgcacactgccgcctcttaggtatcgcggagaggacggctgttggtacggtatggaaatacggccattgaaggagaaagaagagaatctggtgaactcattagttacggcggggcacggacaggtggataatttcagtctcggcgtactgggtatggccctttttctggaagagatgttgagaaccagggtcggcactaagcatgctatcctcctggtggcagtgagcttcgtcacactaattaccgggaacatgtcgtttaaagacctgggacgcgttgtggtaatggtgggcgccactatggctgatgacatcgggatgggagtcacatatctcgccctgcttgcagcgttcaaggtgcgacccacctttgccgctggcttgctgttacggaagctcacgtccaaagagctgatgatgactaccattggtatcgttcttctgtctcaaagcacaatacctgaaaccgtgctagagctcactgatgccctggcattggggatgatggtcctgaagatcgtgcgtaatatggaaaaataccagttagctgttacaattatggccatcctctgcgtgcccaacgcagtcattctgcagaatgcctggaaggtatcatgtaccatccttgctgtggttagtgtgtccccactgttgctcacatctagccagcagaaaactgactggatacctctggcgctaaccattaagggactgaaccccacggccatcttccttacaaccctctccagaactaataaaaagaggtcatggccactgaacgaggcaatcatggctgtcggcatggtgagcattttggccagttctctgttaaagaatgacataccgatgaccggccctctcgtagccgggggactgcttacagtgtgctatgtcctgactggtcgctccgctgatttggaactcgagcgggcaaccgacgttaaatgggaggatcaggccgaaatcagcggctcgtcacccattctgtctatcacgattagtgaggacgggtccatgagcatcaagaacgaagaggaggaacagacactaaccatactgatcagaactggacttctcgtgatttctggcctgtttccaatcagcattcccatcacagcggctgcctggtacttgtgggaggtgaaaaagcagagggccggtgtcttatgggatgtgccttccccaccccctatggggaaagccgaactggaggacggagcttatcgaataaagcaaaagggcattctcggctactcacagatcggggcaggagtttacaaagaaggtaccttccacactatgtggcatgtaacacgcggcgccgtgctgatgcacaaggggaaacggatcgagccgagttgggcggatgtcaagaaagaccttattagctatggaggcggttggaagctggagggggaatggaaggagggagaagaggtgcaggttttggctctagaaccaggcaaaaatcccagagccgtgcagaccaagcctggcctgtttaaaacgaacactgggaccatcggagcagtctctctcgatttctccccaggtacatcaggcagtcccataattgacaagaaagggaaggtggtaggactgtacggcaacggtgtcgtgaccaggagcggggcctatgtttccgctatcgcccaaacagagaagtctattgaggataatcctgaaatcgaggacgatatatttcgtaaacgccggcttactattatggacttacacccgggagcaggcaagaccaaaagatacctgcccgctatcgtgagggaagccatcaagcgaggcctccggacgttgattctggcgccaacacgcgtcgtggccgcagagatggaagaggctctcagagggctgcctatcaggtatcagactcccgccattcgggctgagcataccggacgagaaatagttgaccttatgtgtcacgcaacattcaccatgagactgttgtcgccagtgcgcgtccctaactacaatctaatcattatggatgaggcccatttcactgaccccgccagcatcgctgcgaggggttatatctcaacccgtgtggaaatgggcgaggcagccgggatttttatgacagctacgccaccgggatcccgggatcctttcccccagagtaacgccccaataatcgacgaggaaagagagattcccgaaaggtcttggaatagcggccacgagtgggtaactgattttaaaggtaagaccgtgtggttcgttccttccatcaaggcagggaacgacattgccgcttgcctgcgcaaaaatggaaagaaagtcatccaactctcacgaaagacatttgattctgaatacgtgaaaaccagaactaacgactgggatttcgtggtcacaaccgacataagcgagatgggcgcgaattttaaggccgagcgggtaatcgatccaaggcgctgtatgaaacccgtgattttaacggacggcgaagaacgtgttatcctggcagggcctatgccggtgactcatagttccgctgcccagagacggggaaggattggtcgcaacccaaagaatgaaaacgaccagtacatctatatgggcgagccccttgaaaatgatgaggactgcgcacactggaaggaggccaaaatgctgctcgataacataaatacacctgaagggattatccccagcatgttcgagccagaacgagagaaggtcgacgctattgatggagaatacagattgcggggcgaggccaggaaaacctttgtggacctgatgcgcagaggtgatctccctgtttggctggcgtataaggtggcagccgaggggatcaactacgctgacaggcggtggtgtttcgatggcatcaaaaacaatcagatccttgaagagaacgtcgaagtggagatttggaccaaggagggagaacgtaagaaactaaagccccgctggctggacgcccgaatctattctgatccattggctttaaaagagtttaaggagttcgcagccggcagaaaatcactgactctcaatctgattacagagatggggaggcttcctaccttcatgacacaaaagactcgggacgctctggataacctcgccgtattgcacacggcagaagcgggaggtcgcgcctacaatcatgctctgtccgagctaccggagaccctggaaacactccttctgttaactttgctggccaccgtgacaggcgggatctttctcttcctgatgagtggaagaggcataggtaagatgacccttgggatgtgctgcattatcactgcaagcatcctgctctggtatgctcagattcagccccactggatcgccgcatcgataattttggagtttttcctgatcgttttactaattccagaacctgagaaacagaggacgccccaagacaaccagctgacctacgtcgtgatcgccatactcacagtggtcgctgcgactatggccaatgaaatgggctttcttgagaagaccaaaaaggacctgggattgggctctatcgcaacacagcagccagagtccaacattctggatatcgacctccggcctgctagcgcctggaccctgtacgccgttgcaactacattcgtgacgcccatgcttcgacattcaattgaaaatagttctgtaaacgtgtccctcaccgctatcgccaatcaagcgactgtcctgatggggttgggaaaaggttggccgctgagcaagatggatattggcgtgccattactagctatcgggtgttattcacaggttaaccctataacactgaccgccgcactccttctgttggtggcccactacgctattatcggacccggcctgcaggcaaaggccaccagagaggcgcagaaacgcgctgccgcaggtatcatgaagaatccaacagtcgacgggattactgtaatagatctcgaccccatcccttatgatccgaaatttgaaaagcaactgggccaggtgatgcttttaattctgtgcgttacacaggtgctcatgatgaggaccacatgggccttgtgtgaggctctgactctagccaccggacccatcagtacactgtgggaaggcaacccagggcggttctggaataccactattgcagtcagcatggctaacatctttcgtggatcctacctcgccggcgcgggtcttctgttctctataatgaaaaatacgacaaacaccagaagggggactggaaacatcggcgagaccttgggtgagaagtggaaaagccgcctgaatgccctcggcaagtccgaatttcaaatttataagaaatcagggatccaggaggtggaccggacactggcaaaggaaggaattaaacgaggcgagactgatcaccatgctgtctctagagggagtgccaagttaaggtggttcgtggagcgcaacatggttacccctgaaggaaaagtggtagaccttggctgcggtagagggggatggtcgtactattgtggcggtctgaagaatgtgagagaggtcaagggcctcacaaaagggggacccggccacgaggaacctatcccaatgagcacgtacgggtggaacctagttcgtctgcagtccggagtggatgtctttttcataccccctgaaaagtgcgacaccttgctgtgtgatattggcgagtcttcaccaaatcccactgtggaggcaggtaggacactccgggtacttaacctggtggaaaattggttgaacaataacacccagttctgcatcaaagttctgaatccgtacatgcctagcgtgatcgagaagatggaagctctccaacgcaaatatgggggagccttagtccgaaacccactgtccagaaatagtactcatgagatgtactgggtgtctaacgccagcggcaatattgtctcatccgtgaacatgataagtaggatgcttatcaaccggtttacaatgcgccacaagaaggcgacctatgaacccgacgttgacctgggcagcgggacgagaaatattggaatcgagtctgagattcctaacctagatatcataggtaaaaggatcgaaaagattaaacaggagcatgaaacctcctggcactacgaccaggatcacccatataagacatgggcttaccatggctcatatgagactaaacagaccgggagcgcatcgtctatggtaaatggagtggtccgactcctgacaaagccctgggacgtgttgccgactgttacccaaatggccatgacagataccactcctttcggccagcagcgggtgtttaaggaaaaagtcgacacgcgtacacaggagcccaaggagggtaccaaaaagctgatgaaaatcactgctgaatggctctggaaggagcttgggaaaaagaagaccccaagaatgtgtacacgcgaagagttcacgaggaaagtgcggagtaacgccgcactgggagccatttttaccgatgagaataagtggaaatccgctagagaagcggtagaggacagccgcttctgggaattagtggataaggagaggaacctgcacttggaaggcaaatgcgagacttgtgtttacaatatgatgggcaagcgagagaagaaactcggggaatttggaaaggccaaaggttcacgggcaatctggtacatgtggctgggcgctagattcctagagtttgaagcccttgggttcctgaacgaggaccattggttttccagggaaaattctctcagcggagtcgagggcgagggtctgcacaagttggggtatattctgcgcgatgtgagtaaaaaggaaggaggcgcaatgtacgccgacgacacagctggctgggatacccgtataactctcgaggaccttaagaacgaagagatggtgacaaatcacatggaaggggagcataaaaagctggccgaggcgatcttcaaattaacctatcaaaacaaggtcgttcgggtgcagagacctacacccaggggaactgtaatggatattatctcccgccgagaccagcggggtagcggccaagtggggacctacggactgaatacgtttaccaacatggaagcacagttgatcagacagatggagggcgaaggtgtcttcaaaaatattcagcacctcacagtgactgaggaggttgccgtgcaaaactggctggctagggtcgggcgcgaaagactatctcggatggccatatcaggagatgactgcgtggtaaagccacttgatgacaggttcgcaaacgctctgaccgccctcaatgatatgggcaagatccgtaaagacattcagcagtgggagcccagtaagggctggaacgattggacacaggttcctttttgctcccatcacttccatgaactgatcatgaaagacgggcgagtgttggtcgtgccatgtcgcaatcaagatgagttaattggacgggctcggatcagccagggtgccggctggtctctgagggaaactgcatgcctcgggaagtcgtatgcgcagatgtggtcacttatgtactttcaccgcagagacctgcggctagccgctaacgccatatgtagcgcagtgccgtcccactgggtccccaccagtaggacgacatggtctatccatgctaaacacgagtggatgaccactgaggacatgctgacagtttggaatcgagtgtggattcgtgaaaacccttggatggaggataagaccccagtagaaagctgggaggaaatcccctatctcggaaagagagaggaccagtggtgcggctccttgattggtctgacttcacgcgccacctgggccaaaaatatccaagccgcgataaaccaggtgcggagtcttattgggaatgaggaatacacagattacatgccttctatgaagaggttcagacgcgaggaagaggaagctggagtcctgtggtga

SEQ ID NO: 14617 - RNA, 9876 nt, synthetic construct
  misc_feature 1..9876: note = derived and/or modified CDS sequence (opt3) from DENV-2__GQ868591__SS-prME
  source 1..9876: mol_type = other RNA
agcgcaggcatgatcattatgctgataccaaccgtgatggctttccacctcactactagaaatggggaacctcatatgatcgtctccaggcaggaaaagggaaaatctcttctgtttaagacggaggacggtgttaatatgtgcaccttgatggcaatggatttaggcgaactgtgtgaggacacgattacttacaaatgcccacttctccggcaaaacgaaccggaggatatcgactgttggtgcaattcaaccagtacatgggtgacctatgggacttgtacaaccatgggagagcaccgccgagaaaagcgtagcgtagcactggtgccccatgtcggcatgggtcttgagacgcggactgaaacctggatgtcctctgagggggcgtggaaacacgtgcagaggattgagacatggatcctgcggcatcctggattcactatgatggctgccatattggcatacaccatcggcacaacccactttcagcgcgccctcattttcatcctgctgacggctgttactccatcgatgacaatgagatgcattggcatgtcaaacagggattttgtggaaggggtcagcggaggtagttgggtggacatcgtactcgagcacggctcctgtgttaccactatggcaaagaataagcccacattagatttcgaactgataaaaaccgaggccaagcagcctgctacgcttcggaaatattgcattgaagccaagttgaccaacacaactaccgagtctcgctgtccaacacaaggggagcccagcctgaatgaggaacaggacaaacgatttgtgtgcaagcattccatggtcgatagaggatggggcaacggttgtgggctattcggaaagggcggcatcgtgacttgcgcgatgtttaggtgcaaaaagaatatggaagggaaagtggtccagcctgagaacctcgaatacaccattgttatcacaccacactcaggagaggagcatgcagtgggtaatgacaccggcaagcacgggaaagaaatcaagattactccgcagagtagcataacggaggccgaactgacaggatatggcaccgtaactatggagtgttctccccggaccggtcttgatttcaacgaaatggtgctgttgcaaatggagaataaggcttggctcgtccaccgtcagtggtttctggacttacctctgccatggctccccggggccgatacacagggctccaactggatccagaaggagacccttgtgactttcaagaatcctcatgccaagaagcaagacgttgtggtcctgggatcacaggaaggcgctatgcacacagccttgacgggggcgaccgagattcagatgagcagtggaaacctactgtttactggtcatctcaaatgccgcctgagaatggacaaacttcaactgaaaggcatgtcttactccatgtgtacagggaagttcaaggtggtaaaagaaatcgccgagacccagcacggaacaatagttattagggtgcagtatgagggcgatggtagcccatgcaagatccccttcgaaatcatggacttggagaaacggcatgtcctcgggcgactgattactgtgaacccgatcgtcaccgaaaaggattcgcctgtgaatattgaggcagaacccccatttggcgactcttacataatcattggagttgagcctggccagttaaaactgaactggttcaagaaggggtcctcaatcggacaaatgtttgagacgaccatgcgcggtgctaaaagaatggccatcctaggcgatacagcttgggacttcgggagtctcggaggcgtgtttactagcattggtaaggccctgcaccaggtattcggggcaatatacggcgccgctttttccggagtctcttggaccatgaaaatccttattggcgtgatcattacatggatcgggatgaatagcaggtcaacaagtttgtccgttaccctggtgctcgtcggaatagtgacgctgtatcttggcgtaatggtgcaggcggatagcggttgtgttgtctcttggaagaacaaagaactgaagtgcgggtcaggaatcttcattacagacaatgtgcacacctggactgagcagtacaagtttcaacccgaaagtccaagcaaattggcatccgccatccagaaggctcatgaggaaggcatttgtggtatccggtctgtgacacgcctcgagaacctgatgtggaaacagataacccccgagttaaatcacattctgtcggaaaacgaggtcaagctaactatcatgaccggcgatattaaagggatcatgcaggccggaaagagaagcctcaggcctcaaccaacagaactgaaatattcctggaagacgtggggcaaggcaaaaatgctttcaaccgagagtcataatcagactttcttgatagacgggccggaaacagccgagtgccccaacaccaatcgtgcttggaactctctggaggttgaagattacggatttggcgtgttcacaactaatatctggctcaagctgaaagagaagcaggacgtgttttgtgacagcaaattaatgtccgccgcaattaaggataaccgggcggtacacgctgacatgggttattggatcgaatcagccctgaatgatacctggaagattgagaaagccagcttcatcgaggtcaagaactgccactggcctaaatctcatacgctttggtccaacggggtgttggaaagtgagatgataattccaaagaatctcgccggacccgttagccagcacaactaccgacctggctatcatacacaaatcaccggtccatggcacctgggcaaactagaaatggacttcgatttttgtgacgggactaccgtggtcgtgacagaggattgcggaaatagaggcccctctctgaggactaccacagcttccgggaagctcatcacggaatggtgctgtcgctcatgcaccctgccgcctcttcggtacagaggagaggacggctgttggtacggtatggagattaggccattgaaggaaaaagaggaaaacctggttaatagtttagtgactgccgggcatggacaggtagataacttcagcctcggcgtcctgggtatggcactttttctggaggaaatgttgcgcacacgagtgggcaccaagcacgctatcctcctggtggccgtctcgttcgttactctaattacagggaatatgtcctttcgggacctgggacgtgtgatggtaatggtgggcgcgaccatgacggatgacatagggatgggagtcacttatctcgccctgcttgctgcattcaaagtgagacccacctttgccgctggcttgctgttaaggaagctcacatctaaagagctgatgatgaccactatcggtattgttcttctgagccagtcaacaatccctgagaccattctagaactcacagatgccctggcattggggatgatggtgctgaagatggtccgcaacatggagaagtaccaattagcggtgactatcatggccatactctgcgttcccaatgctgtgatcctgcagaacgcctggaaagtcagttgtaccattcttgcagtagtgtccgtttctccactgttgctcacgagctcccagcagaagacagactggatccctctggctctaaccattaaaggactgaatcccactgccatcttccttaccacactctcacggactagcaagaaaagaagttggccactgaacgaagcaataatggccgtgggcatggtctctattttggcttccagcctgttaaagaatgacatcccgatgaccggccctctcgtggccgggggactgcttacggtatgctatgtgctgacaggtaggtcggcggatttggagctcgaacgagcagctgacgtcaaatgggaggatcaagccgagatctcaggctctagtcccattctgtccataaccatcagcgaagacgggtctatgagcattaagaacgaggaagaggagcagactctaacaatcctgattcgcaccggacttctcgttatctccggcctgtttccagtgtcaatacccatcactgccgctgcatggtacttgtgggaagtgaagaaacagcgggccggtgtcttatgggatgtgcctagtccaccccctatggggaaggcggagctggaagacggagcttatagaattaaacagaagggcatcctcggctacagccaaattggggccggagtttataaagagggtacattccacaccatgtggcatgtaacgaggggcgcagtgctgatgcacaaggggaagcgtatcgaaccgtcttgggccgatgtcaaaaaggaccttatatcctacggaggcggttggaaactggagggggagtggaaggaaggagaggaagtgcaggttttggctctagagccaggcaaaaatccccgcgcagtgcagactaagcctggcctgtttaagaccaacgccgggacaattggagcggtctcactcgatttcagtccaggtaccagcggctcccccatcatcgacaaaaaggggaaagtggtaggactgtacggcaacggtgtcgtgacacggtctggggcttatgtttcggccattgcacagactgaaaagagcatcgaggataatcctgagatagaagacgatatttttagaaaaaggcgacttaccatcatggacttacatccgggagccggcaagacgaagcggtacctgcccgctattgtgcgcgaggccatcaaaagaggcctcaggacattgatactggcaccaactcgggtcgtggctgccgaaatggaggaagcgctccgagggctgcctattagatatcaaacccccgccatccgcgcagagcacacaggaagggagatcgttgaccttatgtgtcatgctaccttcactatgcgtctgttgtcaccagtgcgggtccctaactacaatctaattatcatggatgaagcccacttcaccgaccccgcttccattgcagccagaggttatataagtacaagggtggagatgggcgaagccgctgggatctttatgacggcgactccaccgggatctcgcgatcctttcccccagagcaacgcaccaattatcgacgaggagcgagaaatccccgagagatcctggaactcaggccacgaatgggtaaccgattttaagggtaaaacagtgtggttcgttccttctattaaggccgggaacgacatagctgcctgcctgcggaaaaatggaaagaaggtcatccagctcagcaggaaaacctttgatagtgagtacgtgaagactcgcacaaacgactgggatttcgtggtcaccacggacatttccgaaatgggcgcaaattttaaagccgagcgtgtaatcgatccaagacggtgtatgaagcccgtgattttaactgacggcgaggaaagggttatcctggctgggcctatgccggtgacacatagctctgcggcccaacgccgaggaagaataggtcggaaccccaagaatgagaacgaccagtatatctacatgggcgaaccccttgagaatgatgaagactgcgcacactggaaggaggctaaaatgctgctcgataacattaatacccctgaggggatcattccctcaatgttcgaaccagagagggaaaaggtcgacgccatcgatggagagtaccgcttgagaggcgaagcaaggaagacctttgtggacctgatgcggcgtggtgatctccctgtttggctggcctatcgcgtggctgccgaggggataaactacgcggaccgaagatggtgtttcgatggcgtcaaaaacaatcagattcttgaggaaaacgtggaggtagaaatctggactaaggagggagagaggaaaaagctaaaaccccggtggctggacgcacgcatttattccgatccattggccttaaaggaatttaaggagttcgctgccggcagaaaaagtctgacactcaatctgatcaccgaaatggggaggcttcctacattcatgactcagaaggctcgggacgcactggataacctcgccgtgttgcatacggctgaggccggaggtcgagcatacaatcacgcgctgagcgaactaccggagaccctggagacactccttctgttaactttgctggccaccgttacaggcgggatatttctcttcctgatgtcgggaagaggcatcggtaaaatgacccttgggatgtgctgcattatcactgcttctattctgctctggtatgcccaaatccagccccactggatagcagcttccattatcttggaatttttcctgatcgtcttactaattccagagcctgaaaagcagcgcacgccccaggacaaccaactgacctacgtggtgatcgccatactcacagtcgttgcagccactatggctaatgagatgggctttcttgagaaaaccaagaaggacctgggattgggcagcattgcgacacagcagccagagtcaaacatcctggatattgacctcaggcctgccagtgcatggaccctgtatgctgtggccactacattcgtaacgcccatgcttcggcattctatcgaaaattccagcgtgaacgtctcactcaccgccatagcaaatcaggctactgtgctgatggggttgggaaaaggttggccgctgagtaagatggatatcggcgttccattactagccattgggtgttacagccaagtgaaccctatcacactgaccgcggctctctttcttctggtcgcccactacgcaattatcggacccggcttgcaggccaaagctacccgtgaagcacagaagagagccgcggctggtattatgaaaaatccaacagtagacgggatcactgtgatagatctggaccccattccttatgatccgaagttcgagaagcagctcggccaagttatgctgcttgtgttatgcgtcacacaggtgctgatgatgaggaccacatgggccctctgtgaagcattgactctggccaccggacccatctccacactatgggagggcaacccagggcgcttttggaataccactatcgctgtctctatggccaacattttccggggaagctacctggcaggcgctggtctcctattttccataatgaaaaatacgacaaacacccgaagagggactggaaacatcggcgaaaccctgggtgagaagtggaaatcaaggttgaatgccctgggcaagtctgagttccagatttataaaaagagtgggatccaagaagtggaccgcacactcgcgaaagagggaattaagcggggcgaaactgatcatcacgccgtttcgagagggagcgcaaagctgcgttggtttgtggagaggaacatggtaacccctgagggaaaagtggtcgacttaggctgcggtagagggggatggtcctactattgtggcggtcttaagaatgttcgcgaagtgaaaggcctgacaaaagggggacccggccatgaggaacctatcccaatgtctacgtacgggtggaacctcgtccgactacagtcaggagtggatgtattcttcataccccctgagaaatgcgacaccctgttgtgtgatatcggcgaaagctccccaaatcccactgtggaggctggtagaacactgagggttctcaaccttgtggagaattggctgaacaataacacccagttttgcattaaggtcttgaatccgtatatgcctagtgtgatcgaaaagatggaggccctgcagcggaaatacgggggagcactcgtccgcaacccattatctagaaatagcactcacgaaatgtactgggtgtcaaacgcttccggcaatattgttagtagcgtaaacatgatctctaggatgctgataaaccgattcacaatgcggtataagaaagccacctacgagcccgacgtggaccttggctccgggacgcgtaatattggaatcgaatcagagatccctaacctggatattataggtaagagaatcgagaaaattaagcaagaacacgagaccagctggcattatgaccaggatcacccatacaagacatgggcctatcatggctcgtacgaaactaaacagaccgggtctgcgagttccatggtcaatggagtggttcgcctactcacaaagccctgggacgtggtcccgatggtgactcagatggctatgaccgatacaaccccttttggccaacagagggtattcaaagagaaggtggacactcggacgcaggaacccaaagagggtacaaagaagctgatgaaaatcaccgcagagtggttgtggaaggaactggggaaaaagaaaactccaagaatgtgtacccgcgaggaatttacaaggaaggttcgaagcaacgccgctctcggagccattttcgcagatgagaataaatggaagtcagcccgggaggctgtcgaagactccagattttgggagcttgtggataaggaaaggaacctgcacttagagggcaaatgcgaaacgtgtgtgtataatatgatgggcaagcgcgagaaaaagctgggggagttcggaaaagcgaagggttctcgtgccatctggtacatgtggttgggcgcacggtttctcgagttcgaggctctggggtttctaaacgaagaccactggttcagcagagagaatagtctttccggagtcgaaggcgagggtctgcataagctcgggtacatactgagggatgttagcaaaaaggagggaggcgccatgtatgcagacgacaccgccggctgggatactcgcatcacattggaagacctgaaaaacgaggaaatggtgaccaatcacatggagggggaacataagaaactcgctgaggccatttttaaacttacttaccagaacaaggtagtgcgagtccaacggcctacacccagaggaaccgtgatggatatcatttctaggcgcgaccagagaggttcaggccaggttgggacatatggactgaatactttcaccaacatggaggcgcaattaatccggcagatggaaggcgagggtgtgttcaaaagtattcagcacctgacgataaccgaagagatcgcagtccagaattggttggccagggtggggcgtgagcgactctcccgcatggctattagcggagatgactgcgtagttaagccactggatgacagatttgcctctgcactaacagctcttaacgatatgggcaaaatccggaaggacatccaacagtgggaaccctcgaggggctggaacgattggactcaggtgcctttctgctcacatcactttcacgagctgattatgaaagacgggcgcgtcctcgtggtgccatgtagaaatcaggatgaactgataggacgggccaggatcagccaaggtgctggctggtccttgcgagagaccgcctgcttagggaagagttacgcacagatgtggtctctgatgtatttccatcgtagagacctccgccttgcggccaacgctatttgtagcgccgtcccgtcccactgggttcccacatcacggactacctggagtatccatgcaaagcacgaatggatgacgacagaggacatgctgaccgtgtggaatagggtatggattcaggagaacccttggatggaagataaaactccagtggagtcttgggaagagatcccctacctaggaaagagagaagaccagtggtgcggcagcctgataggtctcacatcccgcgctacctgggccaaaaatatccaagcagccattaaccaggtccggtcattgatcgggaatgaggagtatactgattacatgcctagcatgaagaggtttcgaagagaagaggaagaggcgggagtgctgtggtga

SEQ ID NO: 14618 - RNA, 9876 nt, synthetic construct
  misc_feature 1..9876: note = derived and/or modified CDS sequence (opt3) from DENV-2__GQ868542__SS-prME
  source 1..9876: mol_type = other RNA
agcgcaggaatgatcattatgctgataccaaccgtgatggctttccacctcacgactagaaatggggaacctcatatgatcgtctccattcaggaaaagggaaaatctcttctgtttaagacggaggacggtgttaatatgtgcaccttgatggcaatggatttaggcgaactgtgtgaggacacaatcacttacaaatgcccactactcaggcaaaacgaaccggaggatattgactgttggtgcaattcaaccagtacatgggtgacctatgggacttgtacaaccacgggagagcaccggcgcgaaaagcgaagcgtagccctggtgccacatgtcggcatgggtcttgagactcgtaccgaaacatggatgtcctctgagggggcgtggaaacacgctcagagaatcgagacttggatactgaggcatcctggattcaccatcatggccgcaattttggcctacacaatcggcaccacgcactttcagcgggctctcattttcatcctgctgactgcagtggccccatcgatgacaatgcgctgcataggcatttcaaacagagattttgttgaaggggtgagcggaggtagttgggtcgacatcgtgctcgagcacggctcctgtgtaaccactatggctaagaataagcccacattagatttcgaactgattaaaaccgaggccaagcagcctgcgacgcttaggaaatattgcatcgaagcaaagttgaccaacacaactaccgagtctcggtgtccaacacaaggggagcccagcctgaaagaagaacaagacaagcgctttgtttgcaagcattccatggtggatcgaggatggggcaatggttgtgggctattcggaaaaggcggcatcgtcacttgcgccatgtttacctgcaagaaaaacatggaagggaagattgtgcagcctgagaatctcgaatacacaatagtggtcaccccacactcaggagaggagcatgctgttggtaacgacactggcaaacacgggaaggaaatcaaagtgacgccgcagagtagcattacagaggccgaactgaccggatatggcactgtaaccatggagtgttctcccagaacaggtcttgatttcaatgaaatggtgctgttgcaaatggagaacaaggcatggctcgtccacaggcagtggtttctggacttacctctgccatggctccccggggctgatacccagggctccaattggatccagaaggagactcttgtgacattcaaaaaccctcatgccaagaaacaagacgttgtggtcctgggatcacaggaaggcgcgatgcacacggccttgaccggggcaactgagatacagatgagcagtggaaatctactgtttacaggtcatctcaagtgccggctgcgtatggacaaacttcaactgaagggcatgtcttactccatgtgtaccgggaagttcaaagtggtaaaggaaattgctgagacacagcacggaactatcgttatccgcgtgcagtatgagggcgatggtagcccatgcaaaattcccttcgaaatcatggacttggagaagagatacgtcctcgggaggctgattaccgtgaacccgatagtcacggaaaaagattcgcctgtgaacatcgaggccgaacccccatttggcgactcttacattatcatcggagttgagcctggccagttaaagctgaattggttcaagaaagggtcctcaattggacaaatgtttgagaccacaatgcggggtgctaagcgaatggccatactaggcgatactgcatgggacttcgggagtctcggaggcgtgtttaccagcatcggtaaagccctgcatcaggtattcggggctatttatggcgcggcattttccggagtctcttggacaatgaagatccttattggcgtgatcataacttggatcgggatgaacagccgctcaaccagtttgtccgttagcctggtgctcgtcggaattgtgacgctgtaccttggcgtaatggtgcaggccgattctggttgtgttgtctcatggaaaaataaggaactgaagtgcgggagtggaatcttcattacagacaacgtgcacacctggactgagcagtataaatttcaacccgaaagcccatccaagttggcttctgccatccagaaagcacaggaggaaggcatatgtggtattagatcggtgacaaggctcgagaatctgatgtggaagcagatcacccccgagttaaaccacattctggccgaaaatgaggtcaaactaactatcatgaccggcgatataaaggggatcatgcaagctggaaaacggagcctccgccctcagccaacagaactgaagtactcctggaagacgtggggcaaagccaagatgctttcaaccgagagtcataaccagactttcttgattgacgggccggaaacagcagagtgccccaataccaacagagcgtggaactctctggaggttgaagattatggatttggcgtgttcacaactaacatctggctcaaactgaaggagaaacaggacgctttttgtgacagcaagttaatgtccgccgcaattaaggataatagggccgtgcacgctgacatgggttactggatcgaatcagccctgaacgatacctggaaaatagagaaggccagcttcattgaggtcaagaattgccattggcctaagtctcacacgctttggtccaacggggtcttggaaagtgagatgatcatccccaaaaatctcgctggacccgtgagccaacacaattatcgtcctggctaccatacacagattgccggtccatggcacctgggcaagctagaaatggacttcgatttttgtgacgggaccactgttgtggtcaccgaggattgcggaaaccggggcccctctctgcgaacaactaccgcgtccgggaagctcatcacagaatggtgctgtagatcatgcacgctgccgcctcttaggtaccgcggagaggacggctgttggtatggtatggagattcggccattgaaagaaaaggaggaaaatctggtgaacagtttagttaccgccgggcatggacaggtggataatttcagcctcggcgtactgggtatggctctttttctggaggaaatgttgagaactagggtcggcacaaaacacgcaatactcctggtggccgtgtcgttcgtcaccctaatcactgggaacatgtcctttaaggacctgggacgcgttgtggtaatggtgggcgctacaatgaccgatgacattgggatgggagtcacgtacctcgccctgcttgcagcgttcaaagtgcgacccacttttgccgctggcttgctgttacggaagctcacctctaaggagctgatgatgacaaccatcggtattgttcttctgagccaatcaactatccctgagacaatactagaactcaccgatgccctggcattggggatgatggtgctgaaaatcgtccgtaatatggagaagtatcagttagctgtgacaattatggccatcctctgcgttcccaacgcagtgattctgcagaatgcctggaaagtcagttgtactatccttgctgtagtgtccgtttctccactgttgctcaccagctcccagcaaaagacggactggatacctctggcgctaacaattaaaggactgaaccccaccgccatcttccttactaccctctcaagaacaaataagaaaaggagctggccactgaacgaagcaatcatggctgtgggcatggtcagtattttggcctcttccctgttaaagaatgacataccgatgactggccctctcgtggccgggggactgcttaccgtatgctacgtgctgacgggtcgcagcgctgatttggagctcgaacgggcaacagacgtcaagtgggaggatcaggccgagatctcgggctcatctcccattctgagtatcaccatttccgaagacgggagcatgtctatcaaaaacgaggaagaggagcagactctaacaatactgatcagaaccggacttctcgttattagcggcctgtttccagtgtccatccccattactgcggctgcctggtatttgtgggaagtgaagaaacagagggccggtgtattatgggatgtgccttcaccaccccctatggggaaggcagagctggaagacggagcttaccgaatcaaacaaaagggcatactcggctatagtcagattggggcaggagtttacaaggagggtacattccataccatgtggcacgtaacgcgcggcgccgtgctgatgcacaaagggaagcggatcgaaccgagctgggcggatgtcaaaaaggaccttatctcttacggaggcggttggaaactggagggggagtggaaggaaggagaggaagtgcaggttttggctctagagccaggcaagaatcccagagccgtgcagactaaacctggcctgtttaagaccaacacagggaccattggagcagtctccctcgatttctcaccaggtacaagtggcagccccatcatagacaaaaaggggaaagtggtaggactgtatggcaacggtgtcgtgactaggtccggggcctacgtttctgctattgcccaaaccgaaaagtcgatcgaggataatcctgagattgaagacgatatctttcgtaagcgccggcttacgataatggacttacatccgggagcaggcaaaacaaagagatatctgcccgctattgtgagggaggccatcaaacgaggcctccggactttgatcctggcgccaacccgcgtcgtggccgcagaaatggaggaagctctcagagggctgcctattaggtaccagacacccgccatccgggctgagcacaccggacgagagattgttgaccttatgtgtcatgcaactttcaccatgagactgttgagcccagtgcgcgtccctaactataatctaataatcatggatgaagcccacttcacagaccccgcctcaattgctgcgaggggttacatctccacgcgtgtggagatgggcgaagcagccgggatctttatgactgctaccccaccgggaagtcgggatcctttcccccagtctaacgccccaattatagacgaggagagagaaatccccgagaggagctggaactccggccatgaatgggtaacagattttaagggtaaaaccgtgtggttcgttccttcaattaaggcagggaacgacatcgccgcttgcctgcgcaagaatggcaaaaaggtcattcaactctctcgaaaaacttttgatagcgagtatgtgaagacaagaaccaacgactgggatttcgtggtcacgactgacatcagtgaaatgggcgcgaattttaaagccgagcgggtaatagatccaaggcgctgtatgaagcccgtgatcttaacagacggcgaggaacgtgttattctggcagggcctatgccggtgacccactccagcgctgcccagagacggggaaggatcggtcgcaaccccaaaaatgagaacgaccagtacatttacatgggcgaaccccttgagaatgatgaagactgcgcacactggaaggaggccaagatgctgctcgataacatcaatacccctgaggggataattccctctatgttcgaaccagagcgagaaaaagtcgacgctatcgatggagagtatagattgcggggcgaagccaggaagacttttgtggacctgatgcgcagaggtgatctccctgtttggctggcgtacaaagtggcagccgaggggattaactatgctgacaggcggtggtgtttcgatggcatcaagaacaatcagatacttgaggaaaacgtcgaggtggaaatctggacaaaagagggagagcgtaagaagctaaaaccccgctggctggacgcccgaatttactcagatccattggctttaaaggaatttaaagagttcgcagccggcagaaagtccctgaccctcaatctgatcacagaaatggggaggcttcctactttcatgacgcagaaaacccgggacgctctggataacctcgccgtattgcatacagcagaggcgggaggtcgcgcctataatcacgctctgagtgaactaccggagactctggagaccctccttctgttaacattgctggccaccgtgactggcgggatttttctcttcctgatgagcggaagaggcatcggtaagatgacgcttgggatgtgctgcataattaccgcatcgatcctgctctggtacgctcagatccagccccattggattgccgcatctatcatattggaatttttcctgattgttttactaatcccagagcctgaaaagcagaggacaccccaagacaaccagctgacttatgtcgtgattgccatcctcaccgtggtcgctgcgacaatggccaatgagatgggctttcttgagaaaaccaagaaagacctgggattgggcgggatagcaactcagcagccagagtccaacatcctggatattgacctccggcctgctagcgcctggacactgtacgccgttgcaacgaccttcgtgactcccatgcttcgacactcaatcgagaatagttctgtaaacgtgtccctcacagctattgccaatcaagcgaccgtcctgatgggattgggtaagggctggccgctgagcaaaatggatatcggggtgccattactagctattggatgttactcacaggttaaccctatcaccctgacagccgcactccttctgttggtggcccactatgctataattggccccggtctgcaggcaaaggccactagagaagcgcagaagcgcgctgccgcagggatcatgaaaaatccaacggtcgacggcatcaccgtaattgatctcgaccccataccttacgatccgaagtttgagaaacaactgggacaggtgatgcttttagttctgtgcgtgacacaggtcctcatgatgaggactacctgggccttgtgtgaagctctgacactagccaccggccccatcagtactctgtgggaggggaacccaggacggttctggaatacgacaattgcagtgagcatggctaacatctttcgtggctcctatctcgccggtgcggggcttctgttctctattatgaagaataccactaacaccagaaggggaacaggcaacatcggtgaaactttgggcgagaaatggaaaagccgcctgaatgccctcgggaaatccgagtttcaaatatacaagaagtcaggaatccaggaagtcgaccggaccctggcaaaagagggcattaagcgaggggaaacagatcatcacgctgtgtctagaggaagtgccaaattaaggtggttcgttgagcgcaacatggtgacgcctgagggcaaggtagtggaccttggttgcgggcggggaggctggtcgtattactgtggtggcctgaaaaatgtcagagaagttaaggggctcaccaagggaggccccgggcatgaggaacctatcccaatgagcacttatggatggaacctagtgcgtctgcagtccggcgtcgatgtgtttttcattccccctgagaaatgcgacacattgctgtgtgatatcggtgaatcttcaccaaatcccaccgtagaggcagggaggactctccgggtgcttaacctggttgagaattggttgaacaataacacacagttctgcataaaggtgctgaatccgtacatgcctagcgtcattgagaaaatggaggctctccaacgcaagtacggaggcgccttagtgcgaaacccactgtccagaaatagtacccacgaaatgtattgggtctctaacgccagcggcaatatcgtgtcatccgttaacatgatcagtaggatgcttattaaccggtttacgatgcgccataaaaaggcgacctacgagcccgacgtagacctggggagcggaacaagaaatataggtatcgaatctgaggtgcctaacctagatattatcggcaagaggattgagaaaatcaagcaggaacacgagacttcctggcactatgaccaggatcatccatacaaaacctgggcttatcacgggtcatacgaaacaaagcagactggaagcgcatcgtctatggtcaatggcgtggttcgactcctgaccaaaccctgggacgtgttgccgacagtcacccaaatggccatgactgatacgacacctttcggtcagcagcgggtgtttaaggagaaggtagacacccgtactcaggaacccaaagaggggaccaagaaactgatgaagataacagctgagtggctctggaaagaacttggaaagaaaaagacgccaagaatgtgtacccgcgaggagttcactaggaaggtgcggagtaacgccgcactgggcgccatctttacagatgagaataaatggaagtccgctagagaggcggttgaagacagccgcttctgggagttagtcgataaagaaaggaacctgcatttggagggcaagtgcgaaacctgtgtgtataatatgatggggaaacgagagaagaagctcggagagtttggtaaagccaagggctcacgggcaatttggtacatgtggctgggggctagattcctagaatttgaggcccttggattcctgaacgaagaccactggttttccagggaaaattctctcagcggcgtggaaggtgaggggctgcacaaattgggatacatcctgcgcgatgtcagtaagaaagagggcggcactatgtatgcagacgacacagccgggtgggatacccgtattacactcgaagaccttaagaacgaggaaatggttactaatcatatggagggagaacacaagaaactggctgaggccatcttcaagttaacctaccaaaacaaagtggtacgggtgcagagacctacgcccaggggtaccgtcatggatattatatcccgccgagaccagcggggcagcgggcaagtgggaacatatggcctgaatacttttaccaacatggaggcgcagttgatcagacagatggaaggtgagggggttttcaagaatattcagcatctcacagtgactgaagagatcgcagtccaaaactggctggccagggtgggacgcgagagactatctcggatggctatctcaggcgatgactgcgtagttaaaccacttgatgacaggttcgccagtgcactgaccgctctcaacgatatgggcaagattcgtaaggacatacagcagtgggaaccctcccgagggtggaatgattggacacaggtgcctttttgcagccaccatttccacgagctgatcatgaaagacggacgcgtcttggtggtgccatgtagaaaccaagatgaattaattggtcgggccaggatctctcagggcgctgggtggtcgctgcgcgagacagcctgcctcggaaagtcatacgcacagatgtggagccttatgtattttcacagacgggacctgaggctagcggccaatgctatttgttccgccgtcccgagtcattgggttcccacctctcgaactacatggagcatccacgcaaaacatgaatggatgaccactgaggacatgctgaccgtgtggaaccgtgtatggatacaggagaatccttggatggaagataagacaccagtggactcctgggaggaaatcccctacctcggcaaaagagaggatcaatggtgcggttcattgattgggctgacgagtcgcgctacctgggccaagaacatccaggcagccattaatcaggtccggtctcttatcggaaacgaagagtatactgactacatgcctagcatgaagaggttcagacgcgaggaagaggaagcgggcgtgctgtggtga

SEQ ID NO: 14619 - RNA, 9876 nt, synthetic construct
  misc_feature 1..9876: note = derived and/or modified CDS sequence (opt3) from DENV-2__GQ868544__SS-prME
  source 1..9876: mol_type = other RNA
agcgtgggaatgatcattatgctgataccaaccgtcatggccttccacctcacaactagaaacggggagcctcatatgatcgtttccattcaggaaaagggaaaatctcttctgtttaagacggaggacggtgtgaatatgtgcaccttgatggctatggatttaggcgaactgtgtgaggacacaatcacttacaaatgcccactactcaggcaaaacgaaccggaggatattgactgttggtgcaattcaaccagtacatgggtaacctatgggacttgtacaaccacgggagagcaccggcgcgaaaagcgaagcgtggcactggtcccccatgtgggcatgggtcttgagactcgtaccgaaacatggatgtcctctgagggggcctggaaacacgcgcagagaatcgagacttggatactgaggcatcctggattcaccatcatggctgccattttggcatacacaatcggcaccacgcactttcagcgggccctcattttcatcctgctgactgctgttgcaccatcgatgacaatgcgctgcataggcatttcaaacagagattttgtggaaggggtcagcggaggtagttgggtggacatcgtactcgagcacggctcctgtgttaccactatggccaagaataagcccacattagatttcgaactgattaaaaccgaggctaagcagcctgccacgcttaggaaatattgcatcgaagcgaagttgaccaacacaactaccgagtctcggtgtccaacacaaggggagcccagcctgaaagaagaacaggacaagcgctttgtgtgcaagcattccatggtcgatcgaggatggggcaatggttgtgggctattcggaaaaggcggcatcgtgacttgcgcaatgtttacctgcaagaaaaacatggaagggaagattgtgcagcctgagaatctcgaatacacaatagtcgttaccccacactcaggagaggagcatgccgtgggtaacgacactggcaaacacgggaaggaaatcaaagtaacgccgcagagtagcattacagaggctgaactgaccggatatggcactgtgaccatggagtgttctcccagaacaggtcttgatttcaatgaaatggtcctgttgcaaatggagaacaaggcctggctcgtgcacaggcagtggtttctggacttacctctgccatggctccccggggcagatacccagggctccaattggatccagaaggagactcttgttacattcaaaaaccctcatgctaagaaacaagacgtggtcgtgctgggatcacaggaaggcgccatgcacacggcgttgaccggggccactgagatacagatgagcagtggaaatctactgtttacaggtcatctcaagtgccggctgcgtatggacaaacttcaactgaagggcatgtcttactccatgtgtaccgggaagttcaaagtagttaaggaaattgcagagacacagcacggaactatcgtgatccgcgtccagtatgagggcgatggtagcccatgcaaagtgcccttcgaaattatggacttggagaagagatacgtcctcgggaggctgatcaccgtgaacccgattgttacggaaaaagattcgcctgtgaacatagaggctgaacccccatttggcgactcttacatcattatcggagtagagcctggccagttaaagctgaattggttcaagaaagggtcctcaatcggacaaatgtttgagaccacaatgcggggtgccaagcgaatggctattctaggcgatactgcctgggacttcgggagtctcggaggcgtctttaccagcataggtaaagcactgcatcaggtgttcggggccatctatggcgctgcgttttccggagtttcttggacaatgaagattcttatcggcgtgattatcacttggatagggatgaacagccgctcaaccagtttgtccgtcagcctggtgctcgtaggaatcgtgacgctgtaccttggcgttatggtccaggcagattctggttgtgtggtgtcatggaaaaataaggaactgaagtgcgggagtggaattttcatcacagacaacgtccacacctggactgagcagtataaatttcaacccgaaagcccatccaagttggcctctgctattcagaaagcccaggaggaaggcatctgtggtataagatcggttacaaggctcgagaatctgatgtggaagcagattacccccgagttaaaccacatcctggcagaaaatgaggtgaaactaactattatgaccggcgatatcaaggggataatgcaagccggaaaacggagcctccgccctcagccaacagaactgaagtactcctggaagacgtggggcaaagctaagatgctttcaaccgagagtcataaccagactttcttgatcgacgggccggaaacagccgagtgccccaataccaacagagcatggaactctctggaggtggaagattatggatttggcgtattcacaactaacatttggctcaaactgaaggagaaacaggacgcgttttgtgacagcaagttaatgtccgctgccatcaaggataatagggcagtccacgccgacatgggttactggattgaatcagctctgaacgatacctggaaaatcgagaaggccagcttcatagaggtgaaaaattgccattggcctaagtctcacacgctttggtccaacggggttttggaaagtgagatgattatccccaagaatctcgcaggacccgtgagccaacacaattatcgtcctggctaccatacacagatcgctggtccatggcacctgggcaagctagaaatggacttcgatttttgtgacgggaccactgtcgtggttaccgaggattgcggaaaccggggcccctctctgcgaacaactaccgcctccgggaagctcattacagaatggtgctgtagatcatgcacgctgccgcctcttaggtaccgcggagaggacggctgttggtatggtatggagatccggccattgaaagaaaaggaggaaaatctggtgaacagtttagtaaccgcggggcagggacaaattgataatttcagcctcggcgtcctgggtatggccctttttctggaggaaatgttgagaactagggtgggcacaaaacatgctatactcctggtggcagtctcgttcgttaccctaatcactgggaacatgtcctttaaggacctgggacgcgtggtagtgatggtcggcgccacaatgaccgatgacattgggatgggagtgacgtacctcgctctgcttgccgcattcaaagttcgacccacttttgcggccggcttgctgttacggaagctcacctctaaggagctgatgatgacaaccatcggtattgtgcttctgagccagtcaactatccctgagacaatactagaactcaccgatgctctggccttggggatgatggtcctgaaaatcgtgcgtgacatggagaagtatcagttagcagttacaattatggctatcctctgcgtgcccaatgccgtcattctgcagaacgcatggaaagtaagttgtactatccttgccgtggtttccgtgtctccactgttgctcaccagctcccaacagaagacggactggatacctctggctctaacaattaaaggactgaatcccaccgcgatcttccttactaccctctcaagaacaaacaagaaaaggagctggccactgaatgaagccatcatggcagtcggcatggtgagtattttggcttcttccctgttaaagaacgatataccgatgactggccctctcgtagccgggggactgcttaccgtgtgctacgtcctgacgggtcgcagcgccgacttggagctcgaacgggctacagatgttaagtgggaggaccaggcagagatctcgggctcatctcccattctgagtatcaccatttccgaagatgggagcatgtctatcaaaaatgaggaagaggagcagactctaacaatactgatcagaaccggacttctcgtgattagcggcctgtttccagtgtccatccccattactgccgcggcttggtatttgtgggaagtcaagaaacaaagggccggtgtgttatgggacgttccttcaccaccccctatggggaaggcagagctggaagatggagcctaccgaatcaaacagaagggcatactcggctatagtcagattggggctggagtatacaaggagggtacattccacaccatgtggcatgtgacgcgcggcgcagtcctgatgcacaaagggaagcggatcgaaccgagctgggccgacgtgaaaaaggatcttatctcttacggaggcggttggaaactggagggggagtggaaggaaggagaggaagttcaggtgttggcgctagagccaggcaagaaccccagagctgtccaaactaaacctggcctgtttaagaccaatacagggaccattggagccgtgtccctcgacttctcaccaggtacaagtggcagccccatcatagataaaaaggggaaagtagtcggactgtatggcaacggtgtggttactaggtccggggcatacgtgtctgccattgctcagaccgaaaagtcgatcgaggacaaccctgatattgaggacgacatctttcgtaagcgccggcttacgataatggatttacacccgggagccggcaaaacaaagagatatctgcccgcaattgtcagggaagctatcaaacgaggcctccggactttgatcctggccccaacccgcgtggttgcggccgagatggaagaggcactcagagggctgcctattaggtaccagacacccgctatccgggccgaacataccggacgagagattgtggaccttatgtgtcacgctactttcaccatgagactgttgagcccagtccgcgtgcctaattataacctaataatcatggatgaggcacatttcacagaccccgcctcaattgccgctaggggttacatctccacgcgtgtagaaatgggcgaggcggcagggatctttatgactgccaccccaccgggaagtcgggatcctttcccccaatctaatgctccaattatagacgaagagagagagatccccgaaaggagctggaactccggccacgagtgggtgacagattttaagggtaaaaccgtttggttcgtcccttcaattaaggccgggaatgacatcgcagcctgcctgcgcaagaacggcaagaaggtgattcagctctctcgaaaaacttttgatagcgaatatgtgaagacaagaaccaatgactgggatttcgtcgtaacgactgacatcagtgagatgggcgctaactttaaagcggaacgggtgatagacccaaggcgctgtatgaagcccgttatcttaacagatggcgaggagcgtgtgattctggccgggcctatgccggtcacccattccagcgcagctcagagacggggaaggatcggtcgcaatcccaaaaacgaaaatgaccagtacatttacatgggcgagccccttgaaaacgatgaggactgcgcccactggaaggaagcaaagatgctgctcgataatatcaacacccctgaggggataattccctctatgttcgagccagaacgagagaaagtggacgccatcgatggagaatatagattgcggggcgaggctaggaagacttttgttgacctgatgcgcagaggtgatctccctgtgtggctggcctacaaagtcgcggcagaagggattaattatgccgacaggcggtggtgtttcgatggcatcaagaacaaccaaatacttgaggagaatgtggaagtagagatctggacaaaagaaggagagcgtaagaagctaaaaccccgctggctggacgctcgaatttactcagatccattggccttaaaggagtttaaagagttcgctgcaggcagaaagtccctgaccctcaacctgatcacagagatggggaggcttcctactttcatgacgcagaaaacccgggacgccctggacaatctcgctgtgttgcacacagccgaagcaggaggtcgcgcgtataaccatgccctgagtgagctaccggaaactctggagaccctccttctgttaacattgctggctaccgttactggcgggatttttctcttcctgatgagcggaagaggcatcggtaagatgacgcttgggatgtgctgcatagtcaccgcctcgattctgctctggtacgcacagatccagccccactggatcgctgcctctattatcttggagtttttcctgatagtgttactaattccagaacctgagaagcaaaggacaccccaggataatcagctgacttatgtggtcatcgcaattctcaccgttgtggccgctacaatggcgaacgaaatgggctttcttgagaaaaccaagaaagacctgggattgggctccatcgccactcagcaaccagaaagcaatatactggatatcgacctccggcctgcatcagcttggacactgtacgccgtagccacgaccttcgtgactcccatgcttcgacatagtattgagaactcttccgtcaatgtgagcctcacagcaatcgctaaccaggccaccgttctgatggggttgggaaagggttggccgctgtcaaaaatggatattggcgtgccattactagcgatcgggtgttacagtcaggtcaatcctattaccctgacagctgccctccttctgttggtagcacactatgccatcataggacccggcctgcaggctaaggcaactagagaggcccaaaagcgcgcggctgccggtattatgaaaaacccaacggtggacgggatcaccgttatcgatctcgaccccattccttacgatccgaagtttgaaaaacagctgggccaggtgatgcttttagtcctgtgcgtgacacaagtcctcatgatgaggactacctgggcattgtgtgaggccctgacactagctaccggacccataagcactctgtgggaaggcaatccagggcggttctggaacacgacaatcgccgtgtccatggcaaatatttttcgtggatcttatctcgctggcgccggtcttctgttcagcatcatgaagaacaccactaataccagaagggggacaggaaacattggcgagactttgggtgaaaaatggaagtcccgcctgaacgcgctcggcaaatcagagtttcagatctacaagaagtctgggatacaggaggttgaccggaccctggccaaagaaggaatcaagcgaggcgagacagatcaccatgcagtgagtagagggtcggctaaattaaggtggttcgtagaacgcaatatggtgacgcctgagggaaaggtcgttgaccttggctgcggtagagggggatggagctattactgtggcggtctgaaaaacgtgcgggaggtcaagggcctcaccaaaggcgggcccgggcacgaggaacctattccaatgtccacttatgggtggaatctagtgcgtctgcagtctggagtagatgtgtttttcatcccacctgaaaaatgcgacacattgctgtgtgacattggcgagtcaagcccaaaccccaccgttgaagccggtaggactctccgggtgcttaatctggtcgagaactggttgaataacaatacacaattctgcatcaaggtgctgaacccgtacatgccttccgtcatagagaaaatggaaaccctccagcgcaagtacgggggagcattagtgcgaaatccactgagtagaaactctacgcatgagatgtattgggttagcaatgcttcaggcaacattgtatccagtgtgaatatgatcagcaggatgcttatcaaccggtttaccatgcgccacaaaaaggccacatacgaacccgatgtcgacctgggctctgggactagaaacattggaatagagtccgaaatccctaatctagatattatcggtaagaggattgagaaaatcaagcaggagcatgaaacctcatggcactatgaccaggatcacccatacaaaacatgggcctatcatggcagctacgagactaagcaaaccgggtcggcgtctagtatggtgaacggagttgtgcgactcctgacaaaaccctgggacgtcttgccgaccgtgactcagatggctatgacggatacaacccctttcggccagcagcgggtatttaaggaaaaggtggacactcgtacccaagagcccaaagaaggtacaaagaaactgatgaagataacggcagagtggctctggaaagagcttgggaagaaaaagaccccaagaatgtgtactcgcgaagagttcacaaggaaggttcggtccaatgccgctctgggagccatctttaccgatgaaaacaaatggaaaagcgcaagagaggccgtcgaggactcacgcttctgggaattagtggataaagagaggaatctgcacttggaaggcaagtgcgagacttgtgtgtataacatgatgggcaaacgagaaaagaagctcggggagtttggaaaagctaagggttcccgggcgatttggtacatgtggctgggcgccagattcctagagtttgaagcacttgggttcctgaatgaggaccattggttttctagggaaaacagcctcagtggagtcgagggcgaaggtctgtacaaattggggtatatcctgcgcgacgtttccaagaaagagggaggcgctatgtacgccgatgacacagcaggctgggatacccgtattacactcgaggaccttaagaatgaagagatggtgactaaccacatggaaggggagcacaagaaactggccgaagctatcttcaagttaacctatcagaataaagtagtgcgggtccagagacctacgcccaggggaaccgtgatggatattataagccgccgagaccaacggggttctggccaggttgggacatacggactgaacacttttaccaatatggaggcccagttgatcagacagatggagggcgaaggtgtgttcaagaacattcaacatctcacagtcactgaggaaatcgcggtgcagaattggctggcaagggtagggcgcgagagactatcacggatggccatcagtggagatgactgcgttgtgaaaccacttgatgacaggttcgcttccgccctgaccgcactcaacgatatgggcaagattcgtaaggacatacagcagtgggagcccagccgaggctggaacgattggacgcaagtccctttttgctctcaccatttccacgaactgatcatgaaagacgggcgcgtgttggtggtcccatgtagaaatcaggacgagttaattggacgggctaggatctcgcagggtgccggctggtcactgcgcgaaacagcttgcctcggaaagagctatgcccagatgtggtcccttatgtactttcatagacgggatctgaggctagcagcgaacgccatttgtagtgctgttccgtctcactgggtgcccaccagccgaactacatggtccatccacgccaaacatgagtggatgaccactgaagacatgctgaccgtatggaatcgtgtgtggatacaagagaacccttggatggaggataagacaccagtcgaatcatgggaggaaatcccctatctcggaaaaagagaggaccagtggtgcggcagtttgattggtctgacgtctcgcgcaacctgggctaagaatatccaggccgcaattaaccaggtgcggagccttatcgggaatgaagagtacactgattacatgccttccatgaagaggttcagacgcgaggaagaggaagccggagttctgtggtga

SEQ ID NO: 14620 - RNA, 9876 nt, synthetic construct
  misc_feature 1..9876: note = derived and/or modified CDS sequence (opt3) from DENV-2__GQ868545__SS-prME
  source 1..9876: mol_type = other RNA
agcgcaggaatgatcattatgctgataccaaccgtgatggctttccacctcacaactagaaacggggagcctcatatgatcgtctccattcaggaaaagggaaaatctcttctgtttaagacggaggacggtgttaatatgtgcaccttgatggcaatggatttaggcgaactgtgtgaggacacaatcacttacaaatgcccactactcaggcaaaacgaaccggaggatattgactgttggtgcaattcaaccagtacatgggtgacctatgggacttgtacaaccacgggagagcaccggcgcgaaaagcgaagcgtagcactggtgccacatgtcggcatgggtcttgagactcgtaccgaaacatggatgtcctctgagggggcgtggaaacacgctcagagaatcgagacttggatactgaggcatcctggattcaccatcatggccgcaattttggcctacacaatcggcaccacgcactttcagcgggctctcattttcatcctgctgactgcagtggccccatcgatgacaatgcgctgcataggcatttcaaacagagattttgttgaaggggtgagcggaggtagttgggtcgacatcgtgctcgagcacggctcctgtgtaaccactatggctaagaataagcccacattagatttcgaactgattaaaaccgaggccaagcagcctgcgacgcttaggaaatattgcatcgaagcaaagttgaccaacacaactaccgagtctcggtgtccaacacaaggggagcccagcctgaaagaggaacaggacaagcgctttgtttgcaagcattccatcgtggatcgaggatggggcaatggttgtgggctattcggaaaaggcggcattgtcacttgcgccatgtttacctgcaagaaaaacatggaagggaagatagtgcagcctgagaatctcgaatacacaatcgtggtcaccccacactcaggagaggagcatgctgttggtaacgacactggcaaacacgggaaggaaattaaagtgacgccgcagagtagcgtaacagaggccgaactgaccggatatggcactgtgaccatggagtgttctcccagaacaggtcttgatttcaatgaaatggtcctgttgcaaatggagaacaaggcatggctcgtgcacaggcagtggtttctggacttacctctgccatggctccccggggctgatacccagggctccaattggatccagaaggagactcttgttacattcaaaaaccctcatgccaagaaacaagacgtggtcgtgctgggatcacaggaaggcgcgatgcacacggccttgaccggggcaactgagatacagatgagcagtggaaatctactgtttacaggtcatctcaagtgccggctgcgtatggacaaacttcaactgaagggcatgtcttactccatgtgtaccgggaagttcaaagtagttaaggaaattgctgagacacagcacggaactatcgtgatccgcgtccagtatgagggcgatggtagcccatgcaaaattcccttcgaaatcatggacttggagaagagatacgtgctcgggaggctgattaccgtcaacccgatagtgacggaaaaagattcgcctgttaacatcgaggccgaacccccatttggcgactcttacattatcatcggagtggagcctggccagttaaagctgaattggttcaagaaagggtcctcaattggacaaatgtttgagaccacaatgcggggtgctaagcgaatggccatactaggcgatactgcatgggacttcgggagtctcggaggcgtatttaccagcatcggtaaagccctgcatcaggtcttcggggctatttatggcgcggcattttccggagtgtcttggacaatgaagatccttattggcgttatcataacttggatcgggatgaacagccgctcaaccagtttgtccgtgagcctggtcctcgtgggaattgtaacgctgtaccttggcgtgatggttcaggccgattctggttgtgtcgtgtcatggaaaaataaggaactgaagtgcgggagtggaatcttcattacagacaacgtgcacacctggactgagcagtataaatttcaacccgaaagcccatccaagttggcttctgccatccagaaagcacaggaggaaggcatatgtggtattagatcggtcacaaggctcgagaatctgatgtggaagcagatcacccccgagttaaaccacattctggccgaaaatgaggttaaactaactatcatgaccggcgatataaaggggatcatgcaagctggaaaacggagcctccgccctcagccaacagaactgaagtactcctggaagacgtggggcaaagccaagatgctttcaaccgagagtcataaccagactttcttgattgacgggccggaaacagcagagtgccccaataccaacagagcgtggaactctctggaggtggaagattatggatttggcgtgttcacaactaacatctggctcaaactgaaggagaaacaggacgctttttgtgacagcaagttaatgtccgccgcaattaaggataatagggccgtacacgctgacatgggttactggatcgaatcagccctgaacgatacctggaaaatagagaaggccagcttcattgaggtcaaaaattgccattggcctaagtctcacacgctttggtccaacggggtgttggaaagtgagatgatcatccccaagaatctcgctggacccgttagccaacacaattatcgtcctggctaccatacacagattgccggtccatggcacctgggcaagctagaaatggacttcgatttttgtgacgggaccactgtggtcgtgaccgaggattgcggaaaccggggcccctctctgcgaacaactaccgcgtccgggaagctcatcacagaatggtgctgtagatcatgcacgctgccgcctcttaggtaccgcggagaggacggctgttggtatggtatggagattcggccattgaaagaaaaggaggaaaatctggttaacagtttagtgaccgccgggcatggacagatagataatttcagcctcggcgtactgggtatggctctttttctggaggaaatgttgagaactagggtcggcacaaaacacgcaatcctcctggtggccgtgtcgttcgtcaccctaattactgggaacatgtcctttaaggacctgggacgcgttgtggtaatggtgggcgctacaatgaccgatgacatcgggatgggagtcacgtacctcgccctgcttgcagcgttcaaagtgcgacccactttggccgctggcctgttactccggaagctgacctctaaggagcttatgatgacaaccattggtatcgttctgctaagccaatcaactatacctgagacaatcctcgaactgaccgatgccttggcactggggatgatggtgttaaaaattgtccgtgacatggagaagtatcagctcgctgtgacaatcatggccactctgtgcgttcccaatgcagtgattcttcagaacgcctggaaagtcagttgtaccatcctggctgtagtgtccgtttctccattgctcctgacgagctcccagcaaaagacagactggatacctctagcgctgaccattaaaggacttaatcccactgccatctttctcaccacactgtcaagaactaacaagaaaaggagctggccattgaatgaagcaatcatggctgtgggcatggtcagtattctggcctcttccttactcaagaacgatataccgatgaccggccctctggtggccgggggacttctgacggtatgctacgtgttgacaggtcgcagcgctgacctcgagctggaacgggcaaccgatgtcaagtgggaggaccaggccgagatctcgggctcatctcccattctaagtatcactatttccgaagatgggagcatgtctatcaaaaatgaggaagaggagcagacactgaccatacttatcagaactggactcctggttattagcggcttgttcccagtgtccatccccattacagcggctgcctggtatttatgggaagtgaagaaacagagggccggtgtcctgtgggacgtgccttcaccaccccctatggggaaggccgagctcgaagatggagcttaccgaatcaaacaaaagggcatactgggctatagtcagattggggcaggagtttacaaggagggtacctttcatacgatgtggcacgtaactcgcggcgccgtgcttatgcacaaagggaagcggatcgaaccgagctgggcggacgtcaaaaaggatctgatctcttacggaggcggttggaaattggagggggagtggaaggaaggagaggaagtgcaggttctagctctggagccaggcaagaaccccagagccgtgcagaccaaacctggcctcttcaagacaaataccgggacaattggagcagtctccctggacttttcaccaggtacaagtggcagccccatcatagataaaaaggggaaagtggtaggactttatggcaacggtgtcgtgaccaggtccggggcctacgtttctgctattgcccaaacggaaaagtcgatcgaggacaaccctgatattgaggacgacatcttccgtaagcgccggttaacaataatggatctgcatccgggagcaggcaaaactaagagatatctccccgctattgtgagggaagccatcaaacgaggcttgcggaccctgatcctcgcgccaacacgcgtcgtggccgcagagatggaagaggctctgagagggcttcctattaggtaccagacccccgccatccgggctgaacacactggacgagagattgttgacctgatgtgtcatgcaacctttacaatgagattgctaagcccagtgcgcgtccctaattataacctgataatcatggatgaggcccacttcacggaccccgcctcaattgctgcgaggggttacatctccactcgtgtggaaatgggcgaggcagccgggatcttcatgaccgctacaccaccgggaagtcgggatccttttccccagtctaatgccccaattatagacgaagagagagagatccccgaaaggagctggaactccggccatgagtgggtaaccgatttcaagggtaaaactgtgtggtttgttccttcaattaaggcagggaatgacatcgccgcttgcctccgcaagaacggcaagaaggtcattcaattatctcgaaaaacattcgatagcgaatatgtgaagaccagaacgaatgactgggattttgtggtcactacagacatcagtgagatgggcgcgaacttcaaagccgaacgggtaatagacccaaggcgctgtatgaagcccgtgatcctgaccgatggcgaggagcgtgttattcttgcagggcctatgccggtgacccactccagcgctgcccagagacggggaaggatcggtcgcaatcccaaaaacgaaaatgaccagtacatttacatgggcgagcccctggaaaacgatgaggactgcgcacactggaaggaagccaagatgctcttggataatatcaacactcctgaggggataattccctctatgtttgagccagaacgagagaaagtcgacgctatcgatggagaatatagactgcggggcgaggccaggaagacattcgtggacctcatgcgcagaggtgatctgcctgtttggcttgcgtacaaagtggcagccgaagggattaattatgctgacaggcggtggtgttttgatggcatcaagaacaaccagatactagaggagaatgtcgaagtggagatctggaccaaagaaggagagcgtaagaagctgaaaccccgctggttggacgcccgaatttactcagatccattagctctgaaggagttcaaagaatttgcagccggcagaaagtccctcacactgaaccttatcactgagatggggaggctgcctacgttcatgacccagaaaactcgggacgctctcgacaatttggccgtactgcatactgcagaagcgggaggtcgcgcctataaccacgctctaagtgagctgccggaaaccctcgagacacttctgttattgaccctgctcgccactgtgacgggcgggattttcctgtttcttatgagcggaagaggcatcggtaagatgaccctggggatgtgctgcataattacagcatcgatcctcttgtggtacgctcaaatccagccccattggattgccgcatctatcatactggagttctttttaattgttctactgatcccagaacctgagaagcagaggactccccaagataatcagctcacctatgtcgtgattgccatccttacagtggtcgctgcgaccatggccaacgaaatgggcttcctggagaaaactaagaaagacttgggactgggctccatagcaacacagcagccagaaagcaatatcctcgatattgacctgcggcctgcttcagcctggacgctttacgccgttgcaaccacttttgtgacacccatgctccgacacagtatcgagaactcttccgtaaatgtgagcctgaccgctattgccaaccaagcgaccgtcttgatggggctgggaaagggttggccgttatcaaaaatggatatcggcgtgccactactggctattgggtgttacagtcaggttaatcctatcacactcactgccgcacttctgttgctggtggcccactatgctataattggacccggcctccaggcaaaggccacgagagaggcgcagaagcgcgctgccgcaggtatcatgaaaaacccaaccgtcgacgggatcacagtaattgatctggaccccataccttacgatccgaagttcgaaaaacaacttggccaggtgatgttactggttctctgcgtgactcaggtcttgatgatgaggaccacatgggccctgtgtgaggctctaaccctggccactggacccatcagcacgctctgggaaggcaatccagggcggttttggaacacaaccattgcagtgtccatggctaatatcttccgtggatcttatcttgccggcgcgggtctgttgtttagcattatgaagaacactaccaatacaagaagggggactggaaacatcggcgagaccctgggtgaaaaatggaagtcccgcctcaacgccctgggcaaatcagagttccaaatatacaagaagtctgggatccaggaggtcgaccggacattagcaaaagaaggaattaagcgaggcgagacggatcatcacgctgtgagtagagggtcggccaaacttaggtggtttgttgaacgcaatatggtgacccctgagggaaaggtagtggacctgggctgcggtagagggggatggagctattactgtggcggtctcaaaaacgtccgggaggttaagggcctaactaaagggggacccggccatgaggaacctatcccaatgtccacatatgggtggaatctggtgcgtttgcagtctggagtcgatgtgttctttattccccctgaaaaatgcgacaccctgctctgtgacatcggcgagtcaagcccaaaccccactgtagaagcaggtaggacacttcgggtgctgaatttggttgagaactggctgaataacaatacccagttctgcataaaggtgctcaacccgtacatgccttccgtcattgagaaaatggaaacgttacaacgcaagtacgggggagctctggtgcgaaatccacttagtagaaactctacccacgagatgtattgggtcagcaatgcctcaggcaacatcgtgtccagtgttaatatgatcagcaggatgctgattaaccggttcacaatgcgccataaaaaggccacttacgaacccgatgtagacctaggctctgggaccagaaacataggaatcgagtccgaaattcctaatctcgatatcattggtaagaggatcgagaaaataaagcaggagcacgaaacatcatggcactatgaccaggatcatccatacaaaacttgggcgtatcacggcagctacgagaccaagcagacagggtcggcttctagtatggtgaacggagtcgtgcgactgttgaccaaaccctgggacgttctgccgactgtgacgcaaatggcaatgacagataccactccttttggccagcagcgggtcttcaaggaaaaggtggacacccgtacacaggagcccaaagaaggtacgaagaaactcatgaagatcaccgccgagtggctttggaaagagctggggaagaaaaagactccaagaatgtgtacacgcgaagagtttaccaggaaggtacggtccaatgctgccttaggagcaattttcactgatgaaaacaaatggaaaagcgccagagaggctgtggaggactcacgcttttgggaactggttgataaagagaggaagttgcatctcgaaggcaaatgcgagacatgtgtctataatatgatgggcaagcgagaaaagaaactgggggagttcggaaaggcgaaaggttcccgggccatctggtacatgtggctaggcgcaagatttcttgagttcgaagctctggggtttctcaacgaggaccactggttctctagggaaaatagcctgagtggagtggagggcgaaggtttgcacaagctggggtacattctccgcgacgtgtccaaaaaggagggaggcgccatgtatgcagatgacaccgccggctgggatacacgtatcactcttgaggacctgaagaacgaagagatggtcaccaatcatatggaaggggagcacaaaaagttagctgaagccatttttaaactgacgtaccaaaacaaggttgtgcgggtacagagacctacccccaggggaacagtgatggatataatcagccgccgagaccagcggggttctggccaagtcgggacttatggattgaataccttcacaaacatggaggcgcagctcattagacagatggagggcgaaggtgtgtttaaaaatatccagcatctgactgttaccgaggaaatcgcagtgcaaaactggctagccagggtcgggcgcgagagactttcacggatggctattagtggagatgactgcgtggtaaagccactggatgacaggttcgcctccgcactcacggctctgaatgatatgggcaagatacgtaaagacatccagcagtgggagcccagccgaggctggaacgattggacacaggttcctttctgctctcaccattttcacgaattgattatgaaggacgggcgcgtgttagtcgtgccatgtagaaaccaagacgagctgatcggacgggccaggatttcgcagggtgctggctggtcactccgcgaaaccgcctgccttgggaaaagctacgcacagatgtggtccctgatgtatttccacagacgggatctaaggctggcggccaatgctatctgtagtgccgtgccgtctcattgggtccccactagccgaacaacctggtccatacacgcaaagcatgagtggatgactaccgaagacatgctcacagtttggaaccgtgtgtggatccaggagaatccttggatggaggataaaacgccagtagaatcatgggaggaaattccctacttgggaaagagagaggaccaatggtgcggcagtctgatcggtcttacctctcgcgctacttgggccaagaacattcaggcagccatcaatcaggtgcggagcctgatagggaacgaagagtatacagattacatgccttccatgaaaaggtttagacgcgaggaagaggaagcgggagtcctctggtga

SEQ ID NO: 14621 - RNA, 9876 nt, synthetic construct
  misc_feature 1..9876: note = derived and/or modified CDS sequence (opt3) from DENV-2__GQ868543__SS-prME
  source 1..9876: mol_type = other RNA
agcgccggaatgatcattatgctgatccccaccgtgatggctttccacctcaccactagaaacggggagcctcatatgatcgtcggtattcaagaaaagggtaaatcccttctgtttaagacggaggacggagttaatatgtgcaccttgatggcaatggatttaggggaactgtgtgaggacacaatcacttacaaatgcccactactcaggcaaaacgaaccggaggatattgactgttggtgcaattctacctcaacatgggtgacctatggaacttgtacaaccacgggcgagcaccggcgcgaaaagcgaagtgtagccctggtgccccatgtcggtatggggcttgagactcgtaccgaaacatggatgagctccgagggagcgtggaaacacgctcagagaatcgagacttggatactgaggcatcctggcttcaccatcatggccgcaattttggcctacacaatcggcaccacgcactttcagcgggctctcattttcatcctgctgactgcagtggccccatctatgacaatgcgctgcatagggatttcgaacagagattttgttgaaggagtgtcaggtggcagctgggtcgacatcgtgctcgagcacgggagttgtgtaaccactatggctaagaataagcccacattagatttcgaactgattaaaaccgaggccaagcagcctgcgacgcttaggaaatattgcatcgaagcaaagttgaccaacacaactaccgagtcccggtgtccaacacaaggagagccctctctgaaagaggaacaggacaagcgctttgtttgcaagcatagcatggtggatcgaggctggggtaatgggtgtggactattcggcaaaggcgggatcgtcacttgcgccatgtttacctgcaagaaaaacatggaaggaaagattgtgcagcctgagaatctcgaatacacaatagtggtcaccccacactccggtgaggagcatgctgttggcaacgacactgggaaacacggaaaggaaatcaaagtgacgccgcagtcaagtattacagaggccgaactgaccggctatggtactgtaaccatggagtgtagccccagaacagggcttgatttcaatgaaatggtgctgttgcaaatggagaacaaggcatggctcgtccacaggcagtggtttctggacttacctctgccatggctccccggcgctgataagcagggatctaattggatccagaaagagacccttgtgactttcaagaaccctcatgccaaaaagcaagacgttgtggtcctgggctcccaggaaggggcgatgcacacagccttgacgggagcaaccgagatacagatgtcaagcggtaatctactgtttactggccatctcaaatgccggctgcgtatggacaaacttcaactgaaggggatgagttactctatgtgtacaggaaaattcaaggtggtaaaagaaattgctgagacccagcacggcacaatcgttatccgcgtgcagtatgagggtgatgggtccccatgcaagattcccttcgaaatcatggacttggagaaaagatacgtcctcggcaggctgattactgtgaacccgatagtcaccgaaaaggatagccctgtgaacatcgaggccgaacccccatttggagactcgtacattatcatcggcgttgagcctgggcagttaaagctgaattggttcaaaaagggatcttccattggtcaaatgtttgagacgaccatgcggggcgctaaacgaatggccatactaggggatacagcatgggacttcggatcactcggcggtatgtttacaagtatcgggaaggccctgcatcaggtgttcggcgctatttatggagcggcatttagcggcgtatcctggaccatgaaaatccttattggggtcatcataacatggatcggaatgaactctcgcagcacttcattgagtgtgtccctggttctcgtgggcattgtcaccctgtaccttggtgtgatggtacaggccgatagcgggtgtgtggtttcttggaagaataaggaactgaaatgcggatcaggcatcttcattacggacaacgtccacacatggaccgagcagtataagtttcaacccgaaagtccaagcaaattggcttccgccatccagaaggcacaggaggaaggtatatgtggcattagatctgtgactaggctcgagaatctgatgtggaaacagatcacacccgagttaaaccacattctggccgaaaatgaggtgaagctaaccatcatgactggggatataaaaggaatcatgcaagctggcaagcggtcgctccgccctcagccaaccgaactgaagtacagctggaaaacatgggggaaggccaaaatgctttccacggagtcacataaccagaccttcttgattgacggaccggaaactgcagagtgccccaatacaaacagagcgtggaatagtctggaggtcgaagattatggctttggtgttttcaccacaaacatctggctcaagctgaaagagaagcaggacgctttttgtgactctaagttaatgagcgccgcaattaaagataatagggccgtgcacgctgacatggggtactggatcgaatccgccctgaacgatacttggaagatagagaaagcatcattcattgaggtgaagaattgccattggcctaaaagccacaccctttggtctaacggagtattggaatccgagatgatcatcccaaagaacctcgctggccccgtcagtcaacacaattatcgtcctggttaccatacgcagattgccggcccatggcacctggggaagctagaaatggacttcgatttttgtgacggaacaaccgtggttgtgactgaggattgcggcaaccgggggcccagcctgcgaaccacaactgcgtctggaaaactcatcaccgaatggtgctgtagatcctgcacactgccgcctcttaggtaccgcggcgaggacggttgttggtatgggatggagattcggccattgaaggaaaaagaggaaaatctggtcaactcattagtgacggccggacatggccaggttgataatttcagtctcggtgtgctgggcatggctctttttctggaggaaatgttgagaaccagggtagggactaagcacgcaatactcctggtcgccgtgagcttcgtgacactaatcaccggaaacatgtcgtttaaagacctgggccgcgtcgttgtgatggtaggggctactatgacagatgacattggaatgggcgtgacctacctcgccctgcttgcagcgttcaaggtccgacccacgtttgccgctggtttgctgttacggaagctcacttccaaagagctgatgatgaccacaatcgggattgtgcttctgtctcaaagcaccatccctgagactatactagaactcacagatgccctggcattgggaatgatggttctgaagatcgtgcgtaatatggagaaatatcagttagctgtcaccattatggccatcctctgcgtgcccaacgcagttattctgcagaatgcctggaaggtgtcatgtacaatccttgctgtcgtaagtgtgtccccactgttgctcacttctagccagcagaagaccgactggatacctctggcgctaacgattaagggcctgaaccccacagccatcttccttaccactctctccagaaccaataaaaagaggtcatggccactgaacgaagcaatcatggctgttggcatggtgagcattttggccagttctctgttaaagaatgacataccgatgacagggcctctcgtcgccggaggtctgcttactgtgtgctacgtactgaccggccgctccgctgatttggagctcgaacgggcaacggacgtgaaatgggaggatcaggccgagatcagcgggtcgtcacccattctgtctatcacaattagtgaagacggatccatgagcatcaagaacgaggaagaggagcagaccctaactatactgatcagaacaggccttctcgtcatttctggtctgtttccagttagcatccccattaccgcggctgcctggtatttgtgggaagtgaaaaagcagagggcaggggtgttatgggatgtcccttccccaccccctatgggaaaagccgagctggaagacggcgcttaccgaatcaagcaaaagggcatactcgggtattcacagattggagcaggagtgtacaaagagggcactttccatacaatgtggcacgttacccgcggggccgtactgatgcacaagggaaaacggatcgaaccgagttgggcggatgtgaagaaagaccttatcagctacggcggtgggtggaagctggagggagagtggaaggaaggcgaggaagtccaggtgttggctctagagccaggcaaaaatcccagagccgttcagacgaagcctgggctgtttaaaactaacaccggaacaattggtgcagtgtctctcgatttctccccaggcacctcagggagtcccatcatagacaagaaaggaaaggtcgtgggcctgtatggtaacggggtagtcacaaggagcggagcctacgtgtccgctattgcccaaactgaaaagtctatcgaggataatcctgagattgaagacgatatctttcgtaaacgccggcttaccataatggacttacatccgggcgcaggcaagacgaaaagatatctgcccgctattgttagggaggccatcaagcgagggctccggacattgatcctggcgccaactcgcgtggtcgccgcagaaatggaggaagctctcagaggactgcctattaggtaccagacccccgccatccgggctgagcacacaggtcgagagattgtggaccttatgtgtcatgcaaccttcactatgagactgttgtcgccagttcgcgtgcctaactataatctaataatcatggatgaagcccacttcaccgaccccgccagcattgctgcgaggggctacatctcaacacgtgtcgagatgggggaagcagccggaatctttatgacggctactccaccgggctcccgggatcctttcccccagagtaacgccccaattatagacgaggagagagaaatccccgagaggtcttggaatagcggtcatgaatgggtgaccgattttaaagggaagacagtatggttcgtgccttccattaaggcaggaaacgacatcgccgcttgcctgcgcaaaaatggcaagaaagttattcaactctcacgaaagacctttgattctgagtatgtcaaaactagaacaaacgactgggatttcgtggtgaccacggacatcagcgaaatgggcgcgaattttaaggccgagcgggtcatagatccaaggcgctgtatgaaacccgtaatcttaactgacggggaggaacgtgtgattctggcaggacctatgccggttacacacagttccgctgcccagagacggggtaggatcggccgcaacccaaagaatgagaacgaccagtacatttacatgggggaaccccttgagaatgatgaagactgcgcacactggaaggaggccaaaatgctgctcgataacatcaatacccctgagggaataattcccagcatgttcgaaccagagcgagaaaaggtggacgctatcgatggcgagtatagattgcggggtgaagccaggaaaacctttgtcgacctgatgcgcagaggggatctccctgtgtggctggcgtacaaggttgcagccgagggcattaactatgctgacaggcggtggtgtttcgatggaatcaaaaacaatcagatacttgaggaaaacgtggaggtcgaaatctggactaaggagggcgagcgtaagaaactaaagccccgctggctggacgcccgaatttactctgatccattggctttaaaagaatttaaggagttcgcagccgggagaaaatcactgacactcaatctgatcaccgaaatgggaaggcttcctacattcatgactcaaaagacgcgggacgctctggataacctcgccgtgttgcataccgcagaggcgggtggccgcgcctataatcacgctctgtccgaactaccggagacactggagactctccttctgttaaccttgctggccacagtaaccgggggaatttttctcttcctgatgagtggcagaggtatcgggaagatgactcttggcatgtgctgcataattacggcaagcatcctgctctggtacgctcagatccagccccattggattgccgcatcgatcatattggaatttttcctgattgtgttactaatcccagagcctgaaaaacagaggacaccccaagacaaccagctgacatatgttgtcattgccatcctcactgtggtggctgcgaccatggccaatgagatgggatttcttgaaaagactaaaaaggacctgggcttggggtctatagcaacccagcagccagagtccaacatcctggatattgacctccggcctgctagcgcctggactctgtacgccgtcgcaacaacgttcgttacccccatgcttcgacactcaatcgagaatagttctgtgaacgtatccctcactgctattgccaatcaagcgacagtgctgatgggattgggtaaaggctggccgctgagcaagatggatatcggggtcccattactagctattggatgttactcacaggtgaaccctatcaccctgaccgccgcactccttctgttggttgcccactatgctataattggccccggtctgcaggcaaaggccacaagagaagcgcagaaacgcgctgccgcagggatcatgaagaatccaactgtggacggcatcacggtcattgatctcgaccccataccttacgatccgaaatttgagaagcaactgggacaggtaatgcttttaatcctgtgcgtgacccaggttctcatgatgaggacaacttgggccttgtgtgaagctctgaccctagtgacaggccccattagtaccctgtgggaggggaacccaggacggttctggaatactacgatcgccgtcagcatggcaaacatttttcgtggctcctatctcgctggtgccgggcttctgttctctatcatgaaaaatacaaccaacactagaaggggaaccggcaacataggtgaaacattgggcgagaagtggaaaagccgcctgaatgcgctcgggaagtccgagtttcaaatctacaagaaatcaggcattcaggaagtggaccggactctggccaaggagggcatcaaacgaggggaaaccgatcatcacgcagtctctagaggaagtgctaagttaaggtggttcgtggagcgcaacatggttacacctgagggcaaagtggtagaccttggttgcgggcggggaggctggtcgtattactgtggtggcctgaagaatgtgagagaagtcaaggggctcacgaaaggaggccccgggcatgaggaacctattccaatgagcacctatggatggaacctagttcgtctgcagtccggcgtggatgtctttttcataccccctgagaagtgcgacactttgctgtgtgatataggtgaatcttcaccaaatcccacagtggaggccgggaggaccctccgggtacttaacctggtggagaattggttgaacaataacactcagttctgcattaaagttctgaatccgtacatgcctagcgtgatcgaaaagatggaggcactccaacgcaaatacggaggcgctttagtccgaaacccactgtccagaaatagtacacacgaaatgtattgggtgtctaacgccagcggcaatatcgtctcatccgtgaacatgattagtaggatgcttataaaccggtttaccatgcgccataagaaggccacgtacgagcccgacgttgacctggggagcggaaccagaaatatcggtattgaatctgagatccctaacctagatattatcggcaaaaggatagagaagatcaaacaggaacacgagacatcctggcactatgaccaggatcatccatacaagacttgggcgtatcacgggtcatacgaaaccaaacagacaggaagcgcttcgtctatggtaaatggcgtggtccgactcctgactaagccctgggacgtgttgccgaccgttacacaaatggcaatgaccgatactacgcctttcggtcagcagcgggtgtttaaggagaaagtcgacacacgtacccaggaacccaaggaggggactaaaaagctgatgaaaattaccgccgagtggctctggaaggaacttggcaaaaagaagacaccaagaatgtgtacgcgcgaggagttcaccaggaaagtgcggagtaacgctgccctgggcgcaatctttactgatgagaataagtggaaatccgccagagaggctgtagaagacagccgcttctgggagttagtggataaggaaaggaacctgcatttggagggcaaatgcgaaacatgtgtttataatatgatggggaagcgagagaagaaactcggagagtttggtaaggcgaaaggctcacgggccatttggtacatgtggctgggggcaagattcctagaatttgaggctcttggattcctgaacgaagaccactggttttccagggaaaattctctcagcggcgtcgaaggtgaggggctgcacaagttgggatacatcctgcgcgatgtgagtaaaaaggagggcggcgccatgtatgcagacgacaccgccgggtgggatactcgtattacactcgaagaccttaagaacgaggaaatggtgaccaatcatatggagggagaacacaaaaagctggctgaggccatattcaaattaacataccaaaacaaggtcgttcgggtgcagagacctactcccaggggtaccgtaatggatatcatttcccgccgagaccagcggggcagcgggcaagtgggaacgtatggcctgaatacctttacaaacatggaggcgcagttgatcagacagatggaaggtgagggggtcttcaaaaatatccagcatctcactgtgaccgaagaggttgcagtgcaaaactggctggccagggtcggacgcgagagactatctcggatggctatttcaggcgatgactgcgtggtaaagccacttgatgacaggttcgccaacgcactgacagctctcaatgatatgggcaagatacgtaaagacatccagcagtgggaacccagtaaggggtggaacgattggactcaggttcctttttgctcccaccatttccacgagctgattatgaaagacggacgagtgttggtcgtgccatgtcgcaatcaagatgaattaatcggtagagcccggattagccagggcgctgggtggtctctgagggagaccgcctgcctcggaaagtcgtacgcacagatgtggtcacttatgtattttcaccgcagagacctgcggctagcggccaacgctatctgtagcgccgtgccgtcccattgggtccccacgagtaggacaacctggtctatacacgcaaaacatgaatggatgactacagaggacatgctgaccgtttggaatcgagtgtggatccaggagaacccttggatggaagataagactccagtagagagctgggaagagattccctacctcggcaagcgtgaagaccaatggtgcggttccttgatcgggctgacctcaagagctacatgggccaaaaatattcaggcagccatcaaccaggtgcgcagtcttataggaaatgaggagtatacggattacatgccttctatgaagcggttcaggagagaagaggaagaggcgggcgtcctgtggtga

SEQ ID NO: 14622 - RNA, 9876 nt, synthetic construct
  misc_feature 1..9876: note = derived and/or modified CDS sequence (opt3) from DENV-2__EU482544__SS-prME
  source 1..9876: mol_type = other RNA
accgccggcgtgatcattatgctgatacccacagtcatggctttccacctcactacgagaaacggggagcctcatatgatcgttggaaggcaggaaaagggtaaaagccttctgtttaagaccgaggacggcgtgaatatgtgcacattgatggcaattgatttaggggaactgtgtgaggacactatcacctacaaatgcccactactccggcaaaacgaaccggaggatattgactgttggtgcaattccacatctacctgggtaacttatggaacatgtaccacgactggcgagcaccgccgagaaaagcgttcagtggccctggtcccccatgtgggtatggggcttgagaccagaacagaaacttggatgagtagcgagggagcgtggaaacacgttcagaggatcgagacctggatactgcggcatcctggcttcacaatcatggctgccattttggcatacaccatcggcacgactcactttcagcgcgccctcattttcatcctgctgacagctgtggcaccatccatgaccatgagatgcatagggatttctaacagggattttgtcgaaggagtgtcgggtggctcatgggtagacatcgttctcgagcacgggagctgtgtgactacaatggccaagaataagcccaccttagatttcgaactgattaaaacggaggctaagcagcctgccacccttcggaaatattgcatcgaagcgaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggattgtgacctgcgcaatgtttacatgcaaaaagaatatggaaggaaaagtggtcctccctgagaacctggaatacaccatagttatcactccacacagcggtgaggagcatgccgtgggcaatgacacggggaagcacggaaaagaaattaagatcacaccgcagtcctcaataaccgaggctgaacttactggctatggtaccgtaacaatggagtgtagtcccaggaccgggctggatttcaacgaaatggtgttgctccagatggaggacaaagcctggctggtccaccggcaatggtttttagatctgcctctcccatggcttcccggcgcagacactcagggaagcaattggattcagaaggagacactggtgacgttcaagaaccctcatgctaaaaagcaggacgttgtggtcttgggctctcaagaaggggccatgcacaccgcgctaactggagccacagagatccagatgtcctcaggtaatctgctctttaccggccatctgaaatgccgtcttcgcatggataagctgcagttgaaagggatgagctacagtatgtgtacaggaaagttcaagatcgtgaaagaaattgcagagactcaacacggcaccatcgtaattagagttcagtatgagggtgacgggtctccatgcaagatacccttcgaaatcatggatctcgagaaaaggcatgtgctgggccggttaattacggtcaacccgatcgtgaccgaaaaggactcccctgtcaacatcgaggctgaacccccatttggagatagctacattataatcggcgtggagcctgggcagctgaaactaaattggttcaagaagggatcgtctattggtcagatgtttgagacaactatgcgaggcgccaaacgcatggctatcctcggggacaccgcctgggatttcggatccctgggcggtgtttttacatcaattgggaaggcacttcaccaagtgttcggcgccatctacggagctgcgtttagtggcgtaagctggactatgaaaatattgatcggggtcattatcacctggattggaatgaactccagatctacgagcctgtcagtgagtctcgttctggtgggcgtcgtgacactttatctgggtgtaatggtgcaggcagacaccgggtgtgttgtctcctggaagaataaagaattgaagtgcggaagcggcatcttcataactgataacgtgcacacatggaccgagcagtacaagtttcagcccgaatctccatcaaaactcgccagtgctattcaaaaggcccatgaggaaggtatctgtggcattaggagcgtgactcggctggagaatttaatgtggaaacagatcacccccgagctgaaccacatactatccgaaaatgaggtcaagctcacaatcatgacgggggacattaaaggaatcatgcaggcaggcaagcgctctctgagacctcagccaaccgaacttaaatattcgtggaagacttgggggaaggccaaaatgttgagcacagagtcccataaccaaaccttcctgattgatggaccggaaacagctgagtgccccaatactaacagggcctggaattcactcgaggttgaagactacggctttggtgtgttcagtaccaacatctggctgaagttacgtgagaaacaggacgtgttttgtgattctaagctgatgagcgcagcgataaaagacaatcgggctgtacacgccgatatggggtattggattgaatccgcacttaacgacacgtggaagatggagaaggcctcattcatcgagatcaaaagctgccactggcctaagtctcatacattgtggtccaatggagtcctcgaaagtgagatgattatcccaaaaaacttcgctggccccgtgagccagcacaactaccgacctggttatcatacccagactgccggcccatggcacctggggaagctagaaatggattttgacttctgtgagggaaccacagttgtggtcactgaagattgcggcaatagagggccctctctgaggaccacaacggcatccggaaaactcattaccgagtggtgctgtcgctcatgcactctgccgcctcttcggtacagaggcgaggacggttgttggtacgggatggaaataaggccattgaaggagaaggaagagaacctggtgaatagtttagttacagctggacatggccaaatcgataactttagcctcggtgtgctgggcatggcccttttcctggaagagatgttgcgcacccgagtagggactaaacacgcgattctcctggtcgccgtgtcgtttgtgacactaatcaccggaaatatgtccttccgggacctgggccgtgtcatggttatggtgggggctacgatgactgatgacattggaatgggcgtaacctatctcgcactgcttgccgcttttaaggtgagacccacattcgccgcaggtttgctgttaaggaaactcacctctaaggagctgatgatggcgactatcgggatagcccttctgagccagtcaacaatccctgaaaccattctagagctcacagatgctctggccttgggaatgatggtcctgaaaatcgtgcgcaacatggaaaagtaccagttagcagttactattatggctatcagttgcgtgcccaatgccgtcatactccaaaacgcatggaaggtgtcctgtaccattctggccgctgtttctgtgagcccacttctgttgacgtcctcacagcagaaagcggactggatccctctcgccctgacaatcaagggcctaaatcccaccgcaatttttctgactacccttagccggacaagtaaaaagagatcttggccactcaacgaggctgtcatggccgtaggcatggtgtccatactggccagctcgttgctgaaaaatgacatcccgatgactgggcctttagttgctggaggtctcctgaccgtgtgctatgtccttacgggcaggtcagcagatctggaattggagcgagccgcggacgtgaagtgggaggatcaggctgaaatttctgggagttcccccatcctcagcattacaatctctgaggacggaagcatgtccataaaaaacgaagaggaggaacacaccctgactatcctaattcgcacaggcctgcttgtaatctcaggtgtgttcccagtcagtattcccatcaccgccgcagcctggtacctctgggaggttaagaagcaacgggctggggtgctgtgggatgtgcctagcccaccccctgtcggaaaagcagaattggaggacggcgcctatagaataaagcagaggggcatttttgggtactctcagatcggagcgggtgtgtataaagaaggcactttccatacaatgtggcacgttacccgtggggctgtattaatgcatcgcggaaagcggatcgagccgtcctgggccgatgtgaaaaaggacctgatttcatacggcggtgggtggaagctcgagggagaatggaaagagggcgaagaggtccaggtgctggcacttgaaccaggcaagaatcccagagccgttcaaacgaaacctgggctgtttaagactaacaccggaacaatcggtgctgtgagtttggatttcagcccaggcacctccgggtctcccatagtcgacaggaaaggaaaggtggtaggcctatacggtaatggggtcgtgacacgatcgggagcctatgttagcgcaattgctcagactgagaagtcaatcgaggataaccctgaaattgaggacgatatcttccggaaaaagcgcctgaccataatggacctccacccgggcgccggcaaaacgaagagatacctgcccgcgattgtgagggaagccatcaaacgggggcttcgaacattaatcctggcaccaactagagtcgtggctgccgagatggaagaggctctccgcggattgcctattaggtatcagacccccgcaatccgtgccgagcatacaggtcgggaaattgttgacctgatgtgtcacgccacctttactatgagactcctgtccccagtgagggtccctaactacaatcttataatcatggatgaggctcacttcaccgaccccgcgagtattgcagcccgcggctatatctctacacgagtggaaatgggggaggctgccggaatctttatgacggcaactccaccgggcagcagagatcctttcccccagtccaacgccccaattatggacgaggaacgggagatacccgaaaggtcatggaattctggtcatgagtgggtaaccgattttaaggggaagacagtgtggttcgttcctagcatcaaagctggaaacgacattgcggcctgcctgcgcaagaatggcaaaaaggtcatccaattgagtcgtaaaacctttgattccgaatacgtgaagactagagcaaacgactgggatttcgtggtcacaaccgacattagcgagatgggcgctaattttcgggccgagagggtaatcgatccacgccgatgtatgaagcccgtgatactaacggacggggaagagagagttatcctggcaggacctatgccggtgactcactcttcagccgctcagcggaggggtcgcattggcagaaacccaaaaaatgaaaacgaccagtatatctacatgggggagcccctcgaaaatgatgaggactgcgcccattggaaggaggcgaaaatgttactggataacattaatacacctgaaggaatcataccctccatgttcgagccagaaagggagaaggtcgacgcaattgatggcgaataccggcttcgtggtgaggcccgcaaaacctttgtggacctgatgcgaagaggggatctccctgtttggttggcttatagggtggccgctgagggcatcaactacgcagaccggcgctggtgtttcgatggaattaagaataaccaaatcctggaagagaacgtcgaagtggagatatggaccaaagagggcgaaagaaagaagctcaaacccaggtggctggacgcccggatctatagtgatccacttgctctaaaggagttcaaagaatttgccgcagggcgaaagagcctgactttgaatttaattacagagatgggaagactgcctaccttcatgacacagaaagcgcgcgacgccctcgataacctggctgtacttcacactgccgaagtgggtggcagggcatacaatcacgctctgtcggagctcccggagacgttggaaaccctgctactgctcacacttctggccactgttaccgggggaatctttttattcttgatgtctggcaagggtattgggaagatgacactgggcatgtgctgcatcataaccgcatccattctcctgtggtatgcccagatccagccccattggatcgctgcgagcattatccttgagtttttcctgatagtcctcttgattccagaacctgagaaacaacggactccccaggacaaccagctgacgtacgtggtgatcgccattttaaccgtcgttgcagctacaatggccaatgaaatgggatttctagagaagactaaaaaggacctgggcctcgggtcaatcaccacacaggagagtgaatctaacatacttgatatcgacctgcgtccagcctccgcatggaccttgtatgctgtggccactacattcgtaacgcctatgctgagacacagcattgagaattcaagtgtgaacgtcagcctcaccgcgatcgctaatcaagccactgtgctgatgggacttggtaggggctggcccctctccaaaatggatattggggttccgctgttggcaatcggatgttactctcaggtgaacccaattacactgaccgccgctttactactgctcgtcgcacattacgccatcataggccctggtcttcaggcgaaggctacccgcgaagcccagaagcggacagcagccgggattatgaaaaatcccactgtagacggcatcacggtgatcgatctggagccaattccctatgaccctaagtttgaaaaacaattgggacaggttatgctgctcgtgctgtgcgtcacccaggtgcttatgatgcgaacaacttgggctttatgtgaggccctgaccctcgcaacaggcccgataagcaccttgtgggaggggaaccccggaagattctggaatactacgatcgctgtctccatggccaacatttttaggggctcatacctggcgggtgccgggctactgttctctatcatgaagaatacaaccaacactcgccggggaaccggcaatattggtgaaacactcggcgagaaatggaagagtagacttaacgcactggggaagtcggaatttcagatctataaaaagagcggaatacaagaggtggatcgtactttggctaaagagggcatcaagaggggggaaaccgaccaccatgccgtttcccggggatctgcaaaactgcgctggttcgtggagcgaaacatggtaacaccagaaggcaaggtggtcgatctcggttgcgggagaggaggctggtcatactattgtggtggcctgaaaaatgttagggaggtgaaggggttaacgaagggaggccctgggcacgaagagcccattcctatgagcacctacggatggaaccttgtccggctgcagtccggcgtggacgtattctttactccacccgagaaatgcgatacactcctatgtgacatcggtgaaagttctcctaatccaaccattgaggctgggcgcactctgagagtgttgaacctggttgaaaattggctcaacaataacacacagttctgcgtgaaggtccttaatccctatatgccgagcgtgatcgagaaaatggaaaccctgcaaaggaagtacggaggcgccttggtccgaaaccctctgtcacggaattccacgcacgagatgtactgggtgagtaacgccaccggcaatatagttagctctgtaaacatgatttcccgtatgctcatcaatagatttacaatgaaacataagaaggcgacttatgagccagatgtggacttagggtcaggaacccgcaacatcggtattgaaaacgagatacccaatctggacatcattggcaaaaggatcgaaaagattaaacaggagcacgaaacaagctggcattacgatcaggaccacccttataagacttgggcttaccacgggtcgtatgagaccaaacagacaggatctgcaagttccatggtcaacggcgtggttaagcttctgaccaagccatgggatgtggtccccatggtgactcaaatggccatgacggacacaaccccgttcggtcagcagcgggtatttaaagagaaggtggatactagaacccaggaacctaaagaggggacaaagaaactaatgcgcatcacggctgaatggctctggaaggagctgggaaagaaaaagacccccaggatgtgtactcgagaggaattcacacggaaagttagaagcaatgccgcattgggcgccatatttaccgacgagaacaagtggaaatcagctagggaagcggtcgaggattcccgcttctgggaactggtggaccgtgagcggaatctccatcttgagggcaagtgcgaaacttgtgtgtacaacatgatggggaaaagagagaagaagctgggagaatttggtaaagccaagggctctagggcaatctggtatatgtggttaggggctcgcttcctggagtttgaagccttgggattcctcaatgaggatcactggtttagccgaggcaacagtctgtccggtgtcgagggggaaggactacataaacttggctacattctgcgggacgttagcaagaaagagggcggggcaatgtacgccgatgacacagctggatgggacaccagaatcacactcgaagatctgaagaatgaggaaatggtgactaaccacatgaagggtgagcataaaaagttggccgaggcgattttcaaactgacctatcaaaataaggtagtgagggtccagcgcccaacgcctagaggcaccgtgatggacatcatttctcggaaagatcagagggggtcaggacaggttggcacatacggtctcaacactttcaccaatatggaagcacaacttatacgtcagatggagggggaaggaatctttaagagtattcagcgactgacagtgactgaggagatcgccgtccaaaactggttagctcgcgtgggcagagaacggctgtccaggatggccatcagcggcgacgattgcgtagttaagcccttggacgatcgcttcgcatctgctctcaccgccctgaatgacatggggaaagtgagaaaggatattcagcagtgggagccatcgcggggatggaacgactggacgcaggtccccttttgctcacaccacttccatgaactagtgatgaaagatggtagggtgcttgtcgttccttgtcgaaaccaagacgagctgataggccgtgctagaatcagccagggggccggatggtccctcaaggaaacagcatgcctgggcaaaagttatgcgcagatgtggaccttgatgtactttcaccgccgggatttaaggctggccgctaatgccatttgttctgcagtgccaagccattgggtaccgacttccagaacaacctggtcaatccacgctaagcacgagtggatgactaccgaggacatgctcgccgtgtggaaccgcgtctggattcaggaaaatccctggatggaggacaagacacctgtggaaagttgggaggaagttccatatcttggtaaacgggaggatcaatggtgcgggtctctgatcggactaacgagcagggcaacctgggccaagaacatacagactgcgatcaatcaggtgcgatccctgattggcaacgaggaatacacagactatatgccctcaatgaaaagattccggaaggaggaagaggaagctggcgtcctctggtga

SEQ ID NO: 14623 - RNA, 9876 nt, synthetic construct
  misc_feature 1..9876: note = derived and/or modified CDS sequence (opt3) from DENV-2__EU482545__SS-prME
  source 1..9876: mol_type = other RNA
accgcaggcgtgatcgtcatgctgattcccacagctatggcattccacctcactacgcgtaacggggagcctcatatgatagttggaaggcaggaaaagggtaagagccttctgtttaagaccgaggacggcgtgaatatgtgcacattgatggcaatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccataatgatcactccacacagcggtgaggagcatgctgtcggcaatgacacggggaagcacggaaaagaaattaagatcacaccgcagtcctcaataaccgaggccgaactgactggctatggtaccgttacaatggagtgtagtcccaggaccgggcttgatttcaacgaaatggtgctgttgcaaatggaggacaaagcatggctcgtacaccggcagtggtttctggatttacctctgccatggctccccggcgctgacactcagggaagcaattggattcagaaggagacacttgtgacgttcaagaaccctcatgccaaaaagcaagacgtcgtggttctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtgaaagaaattgctgagactcagcacggcaccatcgtcattagagtgcagtatgagggtgacgggtctccatgcaagatacccttcgaaatcatggatttggagaaaaggcatgtactcggccggctgattacggttaacccgatcgtgaccgaaaaggactcccctgtcaacatcgaggccgaacccccatttggagatagctacattataatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtctttacatcagtggggaaggccctgcaccaggttttcggcgctatttacggagcggcatttagtggcgtgagctggactatgaaaatccttataggggtaatcattacctggatcggaatgaactccagatctacgagcttgtcagtcagtctggtgctcgttggcgtggtcacactgtatcttggtgccatggtgcaggctgactccgggtgtgtagtgagctggaagaataaagaactgaagtgcggatctggcattttcatcaccgataacgttcacacttggacagagcagtacaagtttcaacccgaatcaccaagtaaattggccagcgcaatacagaaggcccatgaggaaggtatttgtggcatcaggtccgtcacccggctcgagaatctgatgtggaaacagattactcccgagttaaaccacatcctgtctgaaaatgaggtgaagctaaccataatgacaggggacatcaaaggaattatgcaggctggcaagcgctcgctcagacctcaaccaacggaactgaaatatagctggaagacctgggggaaggccaaaatgctttccactgagtcacataaccagacattcttgatcgatggaccggaaaccgcagagtgccccaatacaaacagggcgtggaatagtctggaggtggaagactacggctttggtgtcttcactaccaacatttggctcaagctgcgtgagaaacaggacgtattttgtgattctaagttaatgagcgctgccatcaaagacaatcgggcagtgcacgccgatatggggtattggatagaatccgctctgaacgacacgtggaagatggagaaggcctcattcattgaggtgaaaagctgccactggcctaagtctcatacactttggtccaatggagtattggaaagtgagatgatcatccccaagaatttcgcaggccccgtcagccagcacaactaccgacctggttatcatacccaaactgctggcccatggcacctcgggaagctggaaatggattttgacttctgtgagggaaccacagtggttgtgactgaagattgcggcaatagagggccctctctaaggaccacaacggcctccggaaaactgattaccgagtggtgctgtcgctcatgcactctcccgcctctgcggtacagaggcgaggacggttgttggtacgggatggaaatcaggccacttaaggagaaggaagagaacttggtcaatagtctggtgacagcgggacatggccagattgataactttagcttaggtgttctcggcatggccctgttccttgaagagatgctgcgcacccgagtggggactaaacacgctatattgctcgtagcagtctcgtttgtgacactgatcaccggaaatatgtccttccgggacctaggccgtgtgatggtcatggttggggccacgatgactgatgacattggaatgggcgtgacctatctggctctcctggccgcatttaaggtaagacccacattcgcggccggtcttttgctgaggaaattaacctctaaggagctcatgatggctactatcgggattgccctgcttagccagtcaacaatccctgaaaccatactggagctaacagatgcactcgctctgggaatgatggccttgaaaatcgtgaagaacatggaaaagtaccaactggcagtcactattatggccatcagttgcgtgcccaatgctgttattttacagaacgcgtggaaagtgtcctgtaccatcctcgccgcagtctctgtgagcccactgcttctgacgtcctcacagcagaaggctgactggatacctttggccctcacaattaaaggcctgaatcccaccgccatctttctaactaccctgagccgcacaagtaagaaacggtcttggccacttaacgaggctatcatggcagttggcatggtgtccattctcgccagctcgctgttgaagaatgacataccgatgactgggcctctggtcgcgggaggtttactcaccgtatgctatgtgctgacgggcagatcagctgatcttgaactggagagggccgcagacgttaaatgggaggatcaagccgaaatctctgggagttcccccattttgagcatcacaatttctgaggacggaagcatgtccatccgaaacgaagaggaggaacagaccctcactatactgatccgcacaggcctactggtgatttcaggtgtcttcccagtgagtatccccgtaaccgctgcagcctggtacctttgggaggtgaagaagcagcgggcgggggtcctctgggatgttcctagcccaccccctgtgggaaaagctgaactggaggacggcgcctatagaattaagcagaggggcatcttggggtactctcaaataggagccggtgtgtataaagaaggcacttttcacacaatgtggcatgtcacccgtggggcagtgttaatgcaccgcggaaagcggattgagccgtcctgggctgatgttaaaaaggacctggtatcatacggcggtgggtggaagctcgagggagaatggaaagagggcgaagaggtgcaggtcctggcccttgaaccaggcaagaatcccagagcagtgcagacgaaacctgggatcttcaagactaacaccggaacaatcggtgctgttagtctggattttagcccaggcacctccgggtctcccattgtggacaggaaaggaaaggtcgtgggcttgtacggtaatggggtagtcacacgatcgggagcctatgtgagcgcgatcgcccagactgagaagtcaatagaggataaccctgaaattgaggacgatatcttccggaaaaagcgcctaaccattatggacctgcatccgggcgcaggcaaaacgaagagatacctccccgctatcgttagggaagccataaaacgggggctgcgaacacttattttagctccaactagagtggtcgcagccgagatggaagaggccctgcgcggactccctatcaggtatcaaacccccgctatccgtgcggagcacacaggtcgggaaattgtggacttgatgtgtcatgcaaccttcactatgagactgctctccccagttagggtgcctaactacaatctgatcattatggatgaggcccactttaccgaccccgctagtatagccgcacgcggctatatctctacacgagtcgaaatgggggaggccgctggaattttcatgacggcgactccaccgggcagcagagatccttttccccagtccaacgccccaatcatggacgaggaacgggagatccccgaaaggtcatggaactctggtcacgagtgggtgaccgatttcaaggggaagacagtatggtttgtgcctagcattaaagcaggaaacgacatagctgcctgccttcgcaagaatggcaaaaaggttatccagctgagtcgtaaaaccttcgattccgaatacgtcaagactagagcaaacgactgggattttgtggtgacaaccgacattagcgagatgggcgccaatttcaaggctgagcgggtcatcgatccaaggcgctgtatgaaacccgtaattttgacggacggggaagaacgagtgatcctagccggacctatgccggttactcattcttcagcggcacaaagacggggtaggataggccgcaacccaaagaatgaaaacgaccagtatatctacatgggggagcccctggaaaatgatgaggactgcgcccactggaaagaggctaagatgctcttagataacattaatacacctgaaggaatcattccctccatgtttgagccagaaagagagaaagtggacgccatcgatggcgaatacaggctgcggggtgaggctcgtaagaccttcgtcgaccttatgcgccgaggggatctgcctgtgtggctcgcatataaagttgccgctgagggcataaactacgccgacagaaggtggtgttttgatggaattaagaataaccagatcttggaagagaacgtggaagtcgagatttggaccaaggagggcgaacggaaaaagctgaaaccccgctggctcgacgcaagaatctatagtgatccactggcgcttaaggagttcaaagagttcgccgctgggagaaagagcctaactctgaatttgataacagagatgggacggttacctacctttatgacacagaaggcccgaaacgcactggacaatctcgctgtgctgcatactgccgaagccggtggcaaagcctacaaccacgctctttcggagctgccggagacgctcgaaaccttgctgctactgacactccttgcgactgtaaccgggggaatcttcctgtttttaatgtctggcaagggtattgggaaaatgacattgggcatgtgctgcatcattaccgcctccatcctgctctggtatgcacaaatacagccccactggattgctgccagcatcatcctggagttctttcttattgtgctgctcatcccagaacctgagaagcagagaactccccaggataatcaattgacgtacgttgtcatagccattctgaccgtggtggcagctacaatggccaacgaaatgggattcttagagaaaactaagaaggacctaggcctggggtcaatcaccacacaggagagtgaatctaatattctcgacatcgatcttcgcccagcgtccgcttggaccctgtatgccgtcgcaactacatttgttacgcctatgttgaggcatagcatagagaactcaagtgtgaatgtaagcctgaccgccatcgctaaccaggcaactgtgctcatgggactgggtaaaggctggcccctttccaagatggacattggggtcccgctcctggccatcggatgttactctcaggtgaatccaattacattgaccgcggctctgttactactggttgcccactacgcaatcattggccctggtctccaagccaaagctacccgggaagcccagaagcgtgcagctgccgggatcatgaaaaaccccacagtggatggcataactgtcattgaccttgagccaatcccctatgatcctaagttcgaaaagcagctgggacaggtaatgttgctgatcctctgcgtgacgcaagttctgatgatgagaaccacatgggcgctttgtgaggccttaactctggcaaccggcccgattagcacactctgggaggggaatcccggaaggttttggaacaccactatagctgtgtccatggccaatatcttccgcggctcatacttggccggtgctgggctgctattttctattatgaaaaacacgacaaatacccggcgaggaactggcaacatcggtgaaaccctgggcgagaagtggaaaagtagactcaacgcccttgggaagtcggagttccagatttataaaaagagcggaatccaggaggtcgacaggacactggccaaagagggcataaagcgcggggaaactgatcatcacgcggtgtcccggggatctgctaagttgagatggtttgtcgagcgtaatatggtgaccccagaaggcaaagttgtggacctgggttgcgggaggggaggctggtcatactattgtggtggcctcaagaacgtacgggaggtgaaagggctgacaaagggaggccctgggcatgaagaaccaatccctatgagcacgtacggatggaatttagtccgccttcaatccggcgttgatgtgttcttcaccccacccgagaaatgcgacactctgctctgtgatattggtgaaagttctcctaacccaacaatcgaggcagggcgaaccctaagagtcctgaatttggtggaaaactggctgaataacaatactcagttttgcattaaggtactcaacccctatatgccgagcgtgatcgagaagatggaaacacttcagaggaaatacggaggcgccctggttcggaatcctttgtcacgcaactccacccacgagatgtactgggtgagtaatgctacgggcaacatagtcagctctgtgaatatgatttccagaatgctgatcaacaggttcaccatgaagcacaaaaaggccacatatgagccagacgtcgatctcgggtcaggaactcgaaacatcggtattgaaagcgagatacccaatttagacatcattggcaaacggatcgaaaagattaagcaggagcatgaaacctcgtggcactacgaccaagatcatccttataaaacatgggcataccacgggtcttatgagactaagcagaccggaagtgcctccagcatggtgaacggcgttgtacgtctgcttacaaaaccatgggacgtggtccccatggtgacccagatggctatgactgatacgacaccgtttggtcagcaaagagttttcaaggagaaagtggacacccgcactcaggaacctaaggaggggaccaagaaactgatgaagatcacagcggaatggctatggaaagagctcggaaagaaaaagacgcccaggatgtgtacccgggaggaatttactagaaaagtccgctcaaatgccgcactgggcgctatattcacagatgagaacaagtggaagtccgccagggaagcagtggaggacggccgattttgggaattggtagatcgggagagaaatctgcacctcgaggggaaatgcgaaacctgtgtgtacaacatgatgggaaagagggagaagaaacttggtgagttcggcaaagccaaagggtctcgcgctatctggtatatgtggctgggagccagatttttagagttcgaagcgctgggctttttgaatgaggaccattggttcagccggggtaacagtctctccggggttgagggagaaggcctgcacagactaggctacattcttagggatgtcagcaagaaagaagggggagcaatgtacgccgacgatactgctggttgggacacacgcatcaccctggaagacctcaagaatgaggaaatggtgacaaaccatatgaaaggcgagcacaagaaactggccgaggcaatttttaagttgacttatcagaataaggtggtccgagttcagcggccaacccctagagggacggtgatggatatcatttctaggcgcgaccaaagaggatcaggccaggtaggtacctacgggctgaacacattcactaatatggaagctcagctcatacggcaaatggagggagaaggcatcttcaaaagtattcagcatcttaccgtgacagaggagatcgccgtccagaactggctggctagggtgggccgtgaacgattatcccgcatggccatcagcggggatgactgcgttgtgaagcccattgatgacagatttgcatctgcgctgactgccttgaatgatatgggaaaagtccggaaggacatacagcaatgggagccatcgaggggttggaacgattggacccaggtgcccttctgctcacaccactttcatgaactcgtaatgaaagacggccgcgttctggtggtcccttgtagaaaccaggatgagctaatcgggcgggctaggattagccagggagccggctggtcccttaaggaaacggcatgcctgggtaagagttatgctcaaatgtggacactcatgtacttccaccgacgtgacctgagattggccgcaaatgccatctgttctgcggtgccaagccattgggtgccgacctcccgcactacatggtcaattcacgctaaacacgagtggatgaccactgaggatatgttagccgtctggaaccgggtttggatccaggaaaatccctggatggaggacaagacccctgtggaaagttgggaggaagtaccatatctggggaaaagggaggaccagtggtgcggatctctcataggccttacaagcagagcaacgtgggccaagaacatccagaccgctattaatcaagtgcgctccctgatcggcaacgaggaatacactgattatatgccctcaatgaaacggtttaggcgagaggaagaggaagccggggtcctatggtga

SEQ ID NO: 14624 - RNA, 9876 nt, synthetic construct
  misc_feature 1..9876: note = derived and/or modified CDS sequence (opt3) from DENV-2__EU482546__SS-prME
  source 1..9876: mol_type = other RNA
accgccggagtgatcgtcatgctgattcccacagttatggctttccacctcactacgaggaatggggagcctcatatgatagtgggaaggcaggaaaagggtaaaagccttctgtttaagaccgaggacggcatcaatatgtgcacattgatggcaattgatttaggggaactgtgtgaggacactatcacctacaaatgcccactactcaagcaaaacgaaccggaggatattgactgttggtgcaattccacatctacctgggtgacttatggaacatgtaccacgactggcgagcaccggcgcgaaaaacgatcagtggccctggtcccccatgtgggtatggggcttgagacccgtacagaaacttggatgagtagcgagggagcgtggaagcacgttcagagaatcgagacctggatactgaggcatcctggcttcacaatcatggctgccattttggcatacaccatcggcacgactcactttcagcgggccctcattttcatcctgctgacagctgtggcaccatccatgaccatgcgctgcatagggatttctaacagagattttgtcgaaggagtgtcgggtggctcatgggtagacatcgttctcgagcacgggagctgtgtgactacaatggccaagaataaacccaccttagatttcgaactgattaagacggaggctaaacagcctgccacccttaggaagtattgcatcgaagcgaaattgacaaacactaccacagagagtcggtgtccaactcaaggagagccctccctgaatgaagaacaggacaagcgctttatctgcaagcattctatggtcgatcgaggctggggtaacgggtgtggactattcggcaaaggcgggattgtgacctgcgcaatgtttacatgcaagaaaaatatggaaggaaaggtggtccagcctgagaacctcgaatacaccatagttatcactccacacagcggtgaggagcatgccgtgggcaatgacacggggaaacacggaaaggaaattaaaatcacaccgcagtcctcaataaccgaggctgaactgactggctatggtaccgtaacaatggagtgtagtcccagaaccgggcttgatttcaacgaaatggtgctgttgcaaatggaggacaaggcctggctcgtccacaggcagtggtttctggatttacctctgccatggctccccggcgcagacactcagggaagcaattggattcagaaggagacacttgtgacgttcaaaaaccctcatgctaagaaacaagacgttgtggtcctgggctctcaggaaggggccatgcacaccgcgttgactggagccacagagatccagatgtcctcaggtaatctactgtttaccggccatctcaagtgccggctgcgtatggataaacttcaactgaaggggatgagctacagtatgtgtacaggaaagttcaaaatcgtgaaggaaattgcagagactcagcacggcaccatcgtaattcgcgttcagtatgagggtgacgggtctccatgcaaaatacccttcgaaatcacggatttggagaagagacatgtgctcggcaggctgattaccgtcaacccgatcgtgacagaaaaagactcccctgtcaacatcgaggctgaacccccatttggagatagctacattataatcggcgtggagcctgggcagttaaagctgaattggttcaagaaaggatcgtctattggtcaaatgtttgagactaccatgcggggcgccaagcgaatggctatcctaggggacacagcctgggatttcggatccctcggcggtgtttttacttcaattgggaaagcactgcaccaggtgttcggcgccatctacggagctgcgtttagtggcgtaagctggaccatgaagatacttatcggggtcattatcacgtggattggaatgaactcccgctctactagcttgtcagtgagtctggttctcgtgggcgtcgtgaccctgtatcttggtgcaatggtacaggccgactccgggtgtgtggttagctggaaaaataaggaactgaagtgcggatctggcatcttcataactgataacgtccacacatggaccgagcagtacaaatttcaacccgaatcaccaagtaagttggctagcgccattcagaaagcacatgaggaaggtatctgtggcattagatccgtgactaggctcgagaatctgatgtggaagcagatcacccccgagttaaaccacatactgtctgaaaatgaggtgaaactaacaatcatgacgggggacattaagggaatcatgcaggccggcaaacggtcgctccgccctcaaccaaccgaactgaagtatagctggaagacttgggggaaagctaagatgctttccacagagtcacataaccagaccttcttgattgatggaccggaaacagccgagtgccccaatactaacagagcatggaatagtctggaggtcgaagactacggctttggtgttttcaccacgaacatctggctcaaactgagggagaagcaggacgcgttttgtgattctaaattaatgagcgctgccataaaggacaatcgtgcagtgcacgccgatatggggtattggattgaatccgctctgaacgacacatggaagatggagaaagcctcattcatcgaggtaaagagctgccactggcctaaatctcataccctttggtccaatggagtattggaaagtgagatgatcattccaaagaacttcgcaggccccgtcagccagcacaaccatcggcctggttaccacactcaaaccgctggcccatggcatctcgggaaactggaaatggattttgacttctgtgagggaacaactgtggttgtgaccgaagattgcggcaatcgagggccctctctaagaacaacgaccgcctccggaaagctgatcactgagtggtgctgtaggtcatgcacactcccgcctctgcgctatcggggcgaggacggttgttggtacgggatggaaattagaccacttaaggagaaagaagagaacttggtcaatagtctggtgaccgcgggacacggccagatagataactttagcttaggtgttctcggcatggccctgttccttgaagagatgctgaggactcgcgtggggacaaagcacgctatcttgctcgtagcagtctcgtttgtgaccctgattacgggaaatatgtccttccgagacctaggccgggtgatggtcatggttggggccactatgaccgatgacatcggaatgggcgtgacatacctggctctcctggccgcatttaaagtacgtcccaccttcgcggccggtcttttgctgagaaagttaacttctaaagagctcatgatggctacaattgggatcgccctgcttagccagtcaaccatacctgaaacaatcctggagctaactgatgcactcgctctgggaatgatggtgttgaagattgtcaggaacatggaaaagtatcaactggccgtgaccatcatggcaattagttgcgttcccaatgccgtgatcttacagaacgcttggaaagtctcctgtacgatactcgcggccgtgtctgttagcccactgcttctgacatcctcacagcagaaggcagactggattcctttggctctcaccatcaaaggcctgaatcccactgccatctttctaaccacactgagccgcacaagtaagaaacggtcttggccacttaacgaggccattatggctgtgggcatggtctccatactcgcaagctcgctgttgaagaatgacatcccgatgaccgggcctctggtagccggaggtttactcacggtgtgctacgttctgacaggcagatcagcggatcttgaactggagagggctgccgacgtgaaatgggaggatcaagcagaaatttctgggagttcccccatcttgagcattaccatctctgaggacggaagcatgtccataaagaacgaagaggaggaacagactctcacaatcctgattcgaaccggcctactggtcatctcaggtgtgttcccagtaagtattcccatcactgccgctgcatggtatctttgggaggtgaagaaacagcgcgccggggtcctctgggatgttcctagcccaccccctgtgggaaaggcggaactggaggacggcgcttaccggataaaacagagaggctttttggggtattctcaaattggagccggtgtgtacaaggaaggcacattccataccatgtggcacgtcacgagaggggcagtgttaatgcatcgtggaaaacgcatcgagccgtcctgggccgatgttaagaaggacctgatctcatatggcggtgggtggaaactcgagggagaatggaaggagggcgaagaggtacaggtgctggctcttgaaccaggcaaaaatccccgggccgtccagactaagcctgggatttttaaaaccaacacaggaaccatcggtgcagtgagtctggatttcagcccaggcacatccgggtctcccatagttgacagaaagggaaaggtggtcggcttgtacggtaatggggtggtaactaggtcgggagcttacgtcagcgccattgcgcagaccgagaaatcaatcgaggataaccctgaaattgaggacgatatcttccgaaagaaacggctaacgataatggacctgcacccgggcgccggcaagacaaaacgctatctccccgcaattgtgagagaagctatcaagagggggctgcggactcttatcttagccccaacccgagttgtggctgcagagatggaagaggccctgagaggactccctattcgctaccaaacacccgccatcagggctgagcataccggtcgtgaaattgtcgacttgatgtgtcacgcgacttttaccatgcggctgctctccccagtgagagttcctaactataatctgataatcatggatgaggcacacttcacagaccccgccagtattgctgccaggggctacatctctacgcgcgtggaaatgggggaggcagccggaatctttatgactgctaccccaccgggcagccgagatcctttcccccagtccaacgcgccaattatggacgaggaaagagagatacccgaacggtcatggaactctggtcatgagtgggtcacagattttaaggggaaaaccgtgtggttcgtacctagcatcaaggccggaaacgacattgcagcttgccttaggaaaaatggcaagaaagtgatccagctgagtcgcaagacttttgattccgaatatgttaagacacgtgccaacgactgggatttcgtcgtgaccacggacattagcgagatgggcgcaaattttaaagccgagagagtgatcgatccacggaggtgtatgaagcccgtcatattgactgacggggaggaacgcgtaatcctagctggacctatgccggtgacacactcttcagccgcgcaacgaagaggtcggattggcaggaaccccaaaaatgaaaacgaccagtacatctatatgggggagcccctggaaaatgatgaggactgcgcacattggaaggaggccaaaatgctcttagataacattaatacccctgaaggaatcataccctccatgttcgagccagaacgcgagaaggttgacgctattgatggcgaatacagactgaggggtgaggcccggaaaacctttgtggaccttatgcgtcgcggggatctgcctgtctggctcgcttacaaggtggcagccgagggcatcaactatgctgaccgaaagtggtgtttcgatggaattaaaaataaccagatcttggaagagaacgttgaagtggagatatggactaaggagggcgaaaggaaaaagctgaaacccagatggctcgacgcccggatctacagtgatccactggcacttaaggagttcaaggaatttgcggccgggcgcaaaagcctaacactgaatttgattaccgagatgggaagattacctacattcatgactcagaaggctaggaacgccctggacaatctcgcagtcctgcacacggctgaagccggtggccgggcatataaccacgccctttcggagctgccggagaccctcgaaacattgctgctactgactctccttgctaccgtgacagggggaatctttctgttcttaatgtctggcaaaggtattgggaagatgaccttgggcatgtgctgcatcataactgcgtccattctgctctggtacgcccaaatccagccccattggatcgcagctagcattatcctggagtttttccttatagtactgctcattccagaacctgagaaacagcgaacgccccaggataatcaattgacctatgtggttatcgccattctgacagtcgtggccgcaactatggctaacgaaatgggatttttagagaagaccaagaaagacctaggcctggggtcaatcacaacccaggagagtgaatctaatatactcgacatcgatcttagaccagcctccgcgtggactctgtacgctgtggccacaacgttcgtcacccctatgttgcgccacagcattgagaactcaagtgttaatgtgagcctgactgcaatcgccaaccaggctacagtactcatgggactgggtaagggctggcccctttccaaaatggacattggggtgccgctcctggcaatcggatgttattctcaggtcaatccaattaccttgaccgccgcgctgttactactggtggctcattacgccatcataggccctggtctccaagcaaaggccacaagggaagctcagaaacgggccgcagctgggattatgaagaaccccactgttgatggcatcacggtgatcgaccttgagccaattccctacgatcctaagtttgaaaaacagctgggacaggtcatgttgctgatactctgcgtaacccaagtgctgatgatgcgtacaacttgggccctttgtgaggcgttaaccctggccacaggcccgatcagcaccctctgggaggggaatcccggaagattctggaacactacgattgcagtttccatggctaatatctttaggggctcatatttggccggtgcagggctgctattctctattatgaagaacacaaccaatactcgccggggaaccggcaacatcggtgaaacactgggcgagaaatggaagagtcgactcaacgctcttgggaaatcggaatttcagatatacaagaaaagcggaatccaggaggtggacagaactctggccaaggagggcattaagagaggggaaaccgatcaccatgccgtctcccgcggatctgcgaaattgcggtggttcgtggagagaaatatggtcacaccagaaggcaaggtggttgacctgggttgcgggcgtggaggctggtcatattactgtggtggcctcaaaaacgtgagggaggtaaaggggctgacgaaaggaggccctgggcacgaggaaccaatccctatgagcacctatggatggaatttagtgcggcttcaatccggcgtcgatgttttctttactccacccgagaagtgcgacacactgctctgtgatattggtgaaagttctcctaacccaaccatcgaggctgggcgcactctacgagtgctgaatttggtcgaaaactggctgaataacaatacacagttctgcataaaggtgctcaacccctacatgccgagcgtaattgagaaaatggaaacccttcagagaaagtatggaggcgcactggtgaggaatcctttgtcacggaactccacgcacgagatgtactgggttagtaatgccaccggcaacatcgtgagctctgtcaatatgatctcccgcatgctgattaacagatttacaatgaaacataagaaagctacttacgagccagacgtggatctcgggtcaggaaccaggaacataggtatcgaaagcgagattcccaatttagacatcattggcaagcgaatcgaaaagataaaacaggagcacgaaacatcgtggcattatgaccaagatcacccttacaagacttgggcctatcacgggtcttacgagaccaaacagacaggaagtgcatccagcatggtcaacggcgtggttcggctgcttaccaagccatgggacgtagtgcccatggtcactcagatggccatgacggatacaaccccgttcggtcagcaacgtgtgtttaaagagaaggttgacactagaacccaggaacctaaggaggggaccaaaaagctgatgaaaatcacggctgaatggctatggaaggagctcggcaaaaagaaaacaccccgcgtgtgtactagggaggagttcacacggaaggtcagatcaaatgcggccctgggcgcaatttttaccgatgagaacaagtggaaatccgctcgcgaagccgtggaggacggcaggttctgggaattggtagatcgagagcggaatctgcatctcgaggggaagtgcgaaacttgtgtgtataacatgatgggaaaaagagagaagaaacttggtgaatttggcaaggcaaaggggtctagggccatctggtacatgtggctgggagctcgcttcttagagtttgaagccctgggcttcttgaatgaggaccactggtttagccgtggtaacagtctctccggggttgagggagaaggcctgcatcggctaggctatattcttagagatgtcgggaaaaaggagggaggtgcgatgtacgcagacgatacagccggctgggacaccaggatcacactggaagacctcaaaaatgaggaaatggtgactaaccacatgaagggggagcataaaaagctggctgaggccattttcaagttgacctaccagaataaagtggtccgcgttcagcgaccaacgcctcggggaaccgtgatggatataatcagcagaagggaccaacgcggctctggtcaggtagggacatatggactgaacactttcaccaatatggaagcacagctcattagacaaatggagggcgaaggcatctttaagtcaatccagcaccttacagctactgaggagattgccgtgcagaactggctggctcgggtcgggagggaacgtttaagtcgaatggccatatccggagatgactgcgtggttaaacccatcgatgaccgcttcgcaagcgcgctgaccgccttgaatgatatgggtaaggtgagaaaagacattcagcaatgggagccatctcggggctggaacgattggacgcaggtccccttttgctcgcaccatttccacgaactcgtgatgaaggacgggagggtactggttgtgccttgtcgcaaccaggatgagctaatcggaagggctcggatttcacagggcgccggttggagccttaaggaaacagcatgcctggggaaatcctacgctcaaatgtggaccctcatgtattttcataggcgagacctgcgtttggccgcaaatgccatctgtagtgcggtcccatctcactgggtgccgactagcagaacaacctggtccatacacgctaagcatgagtggatgactaccgaggatatgttagccgtgtggaaccgcgtctggatccaggaaaatccctggatggaggacaaaacacctgttgaatcatgggaggaagtgccatacctgggaaagcgggaggaccagtggtgcggcagtctcattggccttacgtctagggcaacctgggccaaaaacatccagactgctattagccaagtaagatccctgatcgggaatgaggaatatacagattacatgccctcaatgaagcgcttccggagggaggaagaggaagccggagtgctatggtga

SEQ ID NO: 14625 - RNA, 9876 nt, synthetic construct
  misc_feature 1..9876: note = derived and/or modified CDS sequence (opt3) from DENV-2__EU482550__SS-prME
  source 1..9876: mol_type = other RNA
accgccggcgtgatcattatgctgatacccacagctatggcattccacctcactacgaggaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgtgcagaggatcgagacctggattctgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttatctgcaagcattctatggtggatagaggctggggtaacgggtgtggattattcggcaagggcgggattgtcacatgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctgactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggtacgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcatcaagttttcggcgctatctatggagcggcatttagtggcgtgagctggactatgaaaatattgatcggggtaattatcacctggattggaatgaactccagatctacgagcctgtcagtcagtctcgtgctggttggcgtggtcacactttacctgggtgtgatggtacaggccgactccgggtgtgtggttagctggaagaataaagaattgaagtgcggatctggcatcttcataaccgataacgtccacacttggacagagcagtataagtttcagcccgaatcaccaagtaaactcgctagcgccattcaaaaggcacacgaggaaggtatctgtggcattaggtccgtgacccggctggagaatttaatgtggaaacagatcactcccgagctgaaccatatactatctgaaaatgaggtgaagctcaccatcatgacaggggacattaaaggaatcatgcaggccggcaagcgctcgctgagacctcagccaacggaacttaaatacagctggaagacctgggggaaggctaaaatgttgtccactgagtcacacaaccaaacattcctgattgatggaccggaaaccgccgagtgccccaatacaaacagggcatggaatagtctcgaggtcgaagactatggctttggtgttttctctactaacatctggctgaagttacgtgagaaacaggacgtgttttgtgatagcaagctgatgtccgcggctataaaagacaatcgggccgtgcatgcagatatggggtactggattgaatcagcccttaacgacacctggaagatggagaaggctagcttcatcgaggtaaaatcttgccactggcctaagtcccacacgttgtggagtaatggagtcctcgaaagcgagatgatcattcccaaaaatttcgccggccccgtgtctcagcataactatcgacctggttaccacacacagaccgcaggcccatggcatctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtatgggatggaaattaggccattgaaggagaaggaagagaacctggtgaatagcttagttactgccggacacggccaaatagataacttttcgctcggtgtgctgggcatggcgcttttcctggaagagatgttgcgcacacgagtagggaccaaacatgccatcctcctggtcgctgtgtcctttgtgactctaattacaggaaatatgtctttccgggacctgggccgtgtcatggttatggtgggggcaaccatgacggatgacatcggaatgggcgtaacttacctcgccctgcttgctgcctttaaggtgagacccaccttcgcagcgggtttgctgttaaggaaactcacaagcaaggagctgatgatggccaccattgggatcgcacttctgtcacagagtactatacctgaaacaatcctagagctcaccgatgccctggcattgggaatgatggtcctgaaaattgtgcgcaacatggaaaagtatcagttagctgttacaatcatggccattctctgcgtgcccaatgcagtcatcctgcaaaacgcctggaaggtgtcctgtactatacttgctgcggtttctgtgagcccactgttgctcacctcctcacagcagaaagccgactggattcctctggcactaacgatcaagggcctgaatcccacagctatctttcttaccactctcagccggaccagtaaaaagagatcttggccactgaacgaggccgtcatggccgtaggcatggtgtccattttggctagctcgctgctcaaaaatgacataccgatgacagggcctctagttgcaggaggtctgcttactgtgtgctacgtcctgaccggcaggtcagccgatttggaactcgagcgagcggctgacgtgaagtgggaggatcaggccgaaatctctgggagttcccccattctgagcatcacgatttctgaggacggaagcatgtccatcaaaaacgaagaggaggaacaaacactaaccatactgatccgcactggccttctcgtaatttcaggtgtgttcccagtcagtatccccattacagcagccgcttggtatctgtgggaggttaagaagcagcgggcaggggtgttgtgggatgtgcctagcccaccccctgtcggaaaagccgaattagaggacggcgcgtacagaatcaagcagaggggcatatttgggtattctcagattggagctggtgtgtacaaagaaggcaccttccacactatgtggcacgttacacgtggggccgtactgatgcatcgcggaaagcggatcgagccgtcctgggcagatgtgaaaaaggacctcatctcatacggcggtgggtggaagctggagggagaatggaaagagggcgaagaggtccaagtgcttgccctggaaccaggcaagaatcccagagctgttcagaccaaacctgggttgtttaagacgaacactggaaccattggtgccgtgagtctagatttcagcccaggcacatccgggtctcccatcgtcgacaggaaaggaaaggtggtaggcctgtatggtaatggggtcgtgacccgatcgggagcatacgttagcgctatagcccagacagagaagtcaattgaggataaccctgaaatcgaggacgatattttccggaaaaagcgcctcactatcatggacctgcacccgggcgcgggcaaaaccaagagatatcttcccgccatagtgagggaagcaattaaacgggggttacgaacgctgatcctcgctccaacaagagtcgtggccgctgagatggaagaggcattgcgcggactgcctatcaggtaccagactcccgccattcgtgccgagcataccggtcgggaaatcgttgacctcatgtgtcacgctacatttaccatgagactgctttccccagtgagggtccctaactataatctgattataatggatgaggcgcatttcactgaccccgcaagtatcgccgctcgcggctacatttctacccgagtggaaatgggggaggccgcaggaatctttatgacagccacgccaccgggcagcagagatcctttcccccaatccaacgctccaatcatggacgaggaacgggagattcccgaaaggtcatggaactctggtcacgagtgggtaactgattttaaggggaagaccgtgtggttcgttcctagcataaaagcgggaaacgacatcgccgcatgcttgcgcaagaatggcaaaaaggtcattcagctaagtcgtaaaacatttgattccgaatatgtgaagaccagagctaacgactgggatttcgtggtcactacagacatcagcgagatgggcgccaattttcgggcagagagggtaattgatccacgccgatgtatgaagcccgtgatcctgaccgacggggaagagagagttatactcgccggacctatgccggtgacgcactcttcagctgcccagcggaggggtcgcatcggcagaaaccccaaaaatgaaaacgaccaatacatttacatgggggagcccttagaaaatgatgaggactgcgcgcattggaaggaggcaaaaatgctgcttgataacatcaatactcctgaaggaattatcccctccatgttcgagccagaaagggagaaggtcgacgccatagatggcgaatatcggctgcgtggtgaggctcgcaaaacatttgtggacctcatgcgaagaggggatttgcctgtttggctggcctacagggtggctgcagagggcattaactatgccgaccggcgctggtgtttcgatggaatcaagaataaccagattctcgaagagaacgtcgaagtggagatctggaccaaagagggcgaaagaaagaagctgaaacccaggtggcttgacgctcggatatacagtgatccactagccctgaaggagttcaaagaatttgcagcggggcgaaagagcttgaccttaaatctgatcactgagatgggaagactccctacattcatgacccagaaagcccgcgacgctctggataaccttgccgtactgcacacagcagaagtgggtggcagggcttataatcatgccctctcggagttgccggagactctggaaacgctactgctccttaccctgttagcaacagttactgggggaatatttttgttcctgatgtctggcaagggtatcgggaagatgaccctcggcatgtgctgcattatcacagcctccatactgctttggtacgctcagattcaaccccactggatcgcggccagcatcattctggagtttttcctcatcgtcttgctgataccagaacctgagaaacagcggaccccacaggacaaccagttaacttatgtggtgattgcaatcctaacggtcgttgctgccaccatggccaatgaaatgggatttctggagaagaccaaaaaggacctcggccttgggtcaattatcactcaagagagtgaatctaacatactggatatcgacttgcgtccagcatccgcttggaccctgtacgccgtggcgacaaccttcgtaactcctatgctcagacacagcattgaaaattcaagtgtgaacgtcagcctgacagctatcgccaatcaggcaacggtgcttatgggactcggtaggggctggcccctgtccaaaatggatattggggttccgttgctggccatcggatgttactctcaggtgaacccaattaccttaactgctgcactactgctccttgtcgcccattatgcgatcataggccctggtctgcaggctaaggccacacgcgaagcacaaaagcgggccgctgccgggattatgaaaaatcccaccgtagacggcatcaccgtgatcgatttggagccaattccctacgaccctaagtttgaaaaacagctgggacaggttatgctcctggtgctttgcgtcacacaggtgttaatgatgcgaactacgtgggcactgtgtgaggctctcaccttggccacaggcccgataagcactctgtgggaggggaaccccggaagattctggaataccacaatcgcggtctccatggccaacatttttaggggctcatatctagctggtgctgggctactcttctctatcatgaagaataccactaacacgcgccggggaacaggcaatattggtgaaacccttggcgagaaatggaagagtagactgaacgccttggggaagtcggaatttcaaatctacaaaaagagcggaatacaggaggtggatcgtactctggcaaaagagggcatcaagagaggggaaaccgaccaccatgctgtttcccggggatctgccaaactccgctggttcgtggagcgaaacatggtaacaccagaaggcaaggtggtcgatctgggttgcgggagaggaggctggtcatattactgtggtggccttaaaaatgttagggaggtgaaggggctaactaagggaggccctgggcacgaggaaccaattcctatgagcacctatggatggaacctggtccggctccagtccggcgtggacgtattctttacaccacccgagaaatgcgatacgctactgtgtgacatcggtgaaagttctcctaatccaaccattgaggccgggcgcactttgagagtgctgaacctcgttgaaaattggcttaacaataacacacaattctgcatcaaggtgctgaatccctacatgccgagcgtcatagagaaaatggaaaccttgcagaggaagtacggaggcgcgctggtgcgaaaccctctctcaagaaattccactcatgagatgtattgggtcagtaacgctacaggcaatattgtgagctctgttaacatgatctcccgtatgttaatcaatagatttaccatgaaacacaagaaggcaacgtacgagccagatgtagacctggggtcaggaacccgcaacattggtatagaaaacgagatccccaatcttgacattatcggcaaaaggattgaaaagatcaaacaggagcacgaaacaagctggcattatgatcaggaccacccttacaagacttgggcctatcatgggtcgtacgagaccaaacaaacaggatctgctagttccatggtgaacggcgtcgtgaagctgctaactaagccatgggatgttgtgcccatggtcacccagatggccatgacagacaccactccgttcggtcagcagcgggtgtttaaagagaaggtagatacgagaacacaagaacctaaagaggggaccaagaaactcatgcgcataactgcagaatggctgtggaaggagttgggaaagaaaaagacccccaggatgtgtacacgagaggagttcacgcggaaagtgagaagcaatgccgctctgggcgcgatctttaccgacgagaacaagtggaaatcagccagggaagcagttgaggattcccgcttctgggaactcgtcgaccgtgagcggaatcttcacctggagggcaagtgcgaaacttgtgtgtataacatgatggggaaaagagagaagaagttaggagaatttggtaaagctaagggctctagggccatttggtacatgtggctgggggcacgcttcttggagtttgaagccctcggattcctgaatgaggatcactggtttagccgaggcaacagtctatccggtgtggagggggaaggacttcataaactgggctacatcctccgggacgtcagcaagaaagagggcggggctatgtatgccgatgacacagcgggatgggacaccagaattactctggaagatttgaagaatgaggaaatggttacaaaccacatgaagggtgagcataaaaagctggcagaggccatcttcaaactcacctaccagaataaggtggtaagggtgcagcgcccaacacctagaggcactgtcatggacattatatctcggaaagatcagagggggtcaggacaagtgggcacctatggtcttaacacgttcaccaatatggaagctcagctgatccgtcagatggagggggaaggaatttttaagagtatccaacacttaacagttactgaggagatcgccgtgcagaactggctggcacgagtcggccgcgaaagattgtcccggatggctattagcggcgacgattgcgtggtaaagcccctcgacgataggttcgcctctgctctgaccgccctaaatgacatggggaaagttcgcaaggatatacagcagtgggagccatcgagaggatggaacgactggacacaagtgcccttttgctcacatcacttccacgaacttgtcatgaaagatggtcgggtgctggtggtcccttgtaggagccaggacgagctcatcggccgagcacgtatttcccagggggcgggatggagtctgaaggaaactgcctgcttgggcaaatcttacgctcagatgtggaccttaatgtattttcatagacgcgatctgcggctcgccgcaaacgctatctgtagcgccgttccatcccactgggtgccgacgtcaaggacaacctggagtattcatgcaaagcacgagtggatgactacagaggacatgcttgccgtatggaatagagtgtggatccaagaaaacccctggatggaggacaagaccctggtcgaatcttgggaggaagtgccttacctaggtaaacgcgaggatcagtggtgcgggagcctgataggactcacttcccgggcgacctgggctaagaatatccagacagccattaaccaggttaggtcattgatcggcaatgaggaatatacggactacatgccaagcatgaaacgattcagaaaggaggaagaggaagcaggcgtgctgtggtga

SEQ ID NO: 14626 - RNA, 9876 nt, synthetic construct
  misc_feature 1..9876: note = derived and/or modified CDS sequence (opt3) from DENV-2__EU482551__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaaccatggccgcaatcttggcctacacgattggcactacacactttcagcgcgttctcatcttcattctgctgaccgctgtggcaccatccatgactatgagatgcatcgggatatctaacagggattttgtcgaaggagtgtcgggtggctcatgggtagacattgttctcgagcacgggagctgtgtgacaaccatggccaagaataagcccacgttagatttcgaactgatcaaaaccgaggctaagcagcctgccacacttcggaaatattgcattgaagcgaagttgactaacaccacaactgagagtcgctgtccaacccaaggagagccctccctgaatgaagagcaggacaaacgatttatctgcaagcattctatggtcgatagaggctggggtaacgggtgtggactattcggcaagggcgggatcgtgacatgcgcaatgtttacctgcaaaaagaatatggaaggaaaagtggtcctccctgagaacctggaatacactattgttataacgccacacagcggtgaggagcatgccgtgggcaatgacacagggaagcacggaaaagaaatcaagattaccccgcagtcctcaatcactgaggctgaacttaccggctatggtacagtaaccatggagtgtagtcccaggactgggctggatttcaacgaaatggtgttgctccagatggaggacaaagcctggctggtccaccggcaatggtttttagatctgcctctcccatggcttcccggcgcagacacacagggaagcaattggatacagaaggagacgctggtgaccttcaagaaccctcatgctaaaaagcaggacgttgtggtcttgggctctcaagaaggggccatgcacactgcgctaacaggagccaccgagattcagatgtcctcaggtaatctgctctttacaggccatctgaaatgccgtcttcgcatggataagctgcagttgaaagggatgagctacagtatgtgtactggaaagttcaagatcgtgaaagaaatcgcagagacccaacacggcacgattgtaatcagagttcagtatgagggtgacgggtctccatgcaagattcccttcgaaataatggatctcgagaaaaggcatgtgctgggccggttaatcaccgtcaacccgattgtgacagaaaaggactcccctgtcaacatcgaggctgaacccccatttggagatagctacatcattataggcgtggagcctgggcagctgaaactaaattggttcaagaagggatcgtctatcggtcagatgtttgagactaccatgcgaggcgccaaacgcatggctattctcggggacacagcctgggatttcggatccctgggcggtgtttttacttcaatcgggaaggcacttcaccaagtgttcggcgccatttacggagctgcgtttagtggcgtaagctggaccatgaaaatcttgataggggtcatcattacgtggatcggaatgaactccagatctacaagcctgtcagtgagtctcgttctggtgggcattgtcaccctttatctgggtgtgatggtacaggcagacactgggtgtgtggtttcctggaagaataaagaattgaagtgcggaagcggcatcttcataacagataacgtccacacctggactgagcagtacaagtttcagcccgaatctccatcaaaactcgccagtgctattcaaaaggcccatgaggaaggtatctgtggcattaggagcgtgacccggctggagaatttaatgtggaaacagatcacacccgagctgaaccacatactatccgaaaatgaggtgaagctcacgatcatgaccggggacattaaaggaatcatgcaggcaggcaagcgctctctgagacctcagccaactgaacttaaatattcgtggaagacatgggggaaggccaaaatgttgagcaccgagtcccataaccaaacattcctgattgatggaccggaaactgctgagtgccccaataccaacagggcctggaattcactcgaggtcgaagactacggctttggtgttttcagtacgaacatctggctgaagttacgtgagaaacaggacgtgttttgtgattctaagctgatgagcgcagcgataaaagacaatcgggctgtgcacgccgatatggggtattggattgaatccgcacttaacgacacatggaagatggagaaggcctcattcatcgagatcaaaagctgccactggcctaagtctcataccttgtggtccaatggagtactcgaaagtgagatgattatcccaaaaaacttcgctggccccgtcagccagcacaactaccgacctggttatcatactcagaccgccggcccatggcacctggggaagctagaaatggattttgacttctgtgagggaacaactgtggttgtgaccgaagattgcggcaatagagggccctctctgaggacaacgaccgcatccggaaaactcattactgagtggtgctgtcgctcatgcacactgccgcctcttcggtacagaggcgaggacggttgttggtacgggatggaaataaggccattgaaggagaaggaagagaacctggtcaatagtttagtgaccgctggacatggccaaatcgataactttagcctcggtgttctgggcatggcccttttcctggaagagatgttgcgcactcgagtggggacaaaacacgcgattctcctggtagccgtctcgtttgtgaccctaatcacgggaaatatgtccttccgggacctgggccgtgtgatggtcatggttggggctactatgaccgatgacattggaatgggcgtgacatatctcgcactgcttgccgcttttaaggtaagacccaccttcgccgcaggtttgctgttaaggaaactcacttctaaggagctgatgatggcgacaatcgggatagcccttctgagccagtcaaccatccctgaaacaattctagagctcactgatgctctggccttgggaatgatggtgctgaaaatcgtccgcaacatggaaaagtaccagttagcagtgaccattatggctatcagttgcgttcccaatgccgtgatactccaaaacgcatggaaggtctcctgtacgattctggccgctgtgtctgttagcccacttctgttgacatcctcacagcagaaagcggactggatccctctcgccctgaccatcaagggcctaaatcccactgcaatttttctgaccacacttagccggactagtaaaaagagatcttggccactcaacgaggctgtgatggccgtcggcatggtatccatactggccagctcgttgctgaaaaatgacatcccgatgaccgggcctttagtggctggaggtctcctgacggtttgctatgtgcttacaggcaggtcagcagatctggaattggagaaggccgcggacgtcaaatgggaggatcaggctgaaatttctgggagttcccccatcctcagcattaccatctctgaggacggaagcatgtccataaagaacgaagaggaggaacacactctgacaatcctaattcgaaccggcctgcttgtgatctcaggtgtattcccagtgagtattcccatcactgccgcagcctggtacctctgggaggtcaagaaacaacgcgctggggttctgtgggatgtgcctagcccaccccctgtgggaaaggcagaattggaggacggcgcctatcggataaaacagagaggcatttttgggtactctcagatcggagcgggtgtctataaggaaggcacattccataccatgtggcacgtgacgaggggggctgttttaatgcatcgtggaaaacgcatcgagccgtcctgggccgatgtaaagaaggacctgatttcatacggcggtgggtggaaactcgagggagaatggaaggagggcgaagaggtgcaggtcctggcacttgaaccaggcaaaaatccccgggccgtgcaaactaagcctgggctgtttaaaaccaacacaggaaccatcggtgctgttagtttggatttcagcccaggcacatccgggtctcccatagtggacagaaagggaaaggtcgtgggcctatacggtaatggggtagtcactaggtcgggagcctatgtgagcgcaattgctcagaccgagaaatcaatcgaggataaccctgaaattgaggacgatatcttccgaaagaaacggctgacgataatggacctccacccgggcgccggcaagacaaaacgctacctgcccgcgattgttagagaagccatcaagagggggcttcggactttaatcctggcaccaacccgagtggtcgctgccgagatggaagaggctctcagaggattgcctattcgctatcagacacccgcaatcagggccgagcataccggtcgtgaaattgtggacctgatgtgtcacgccacttttaccatgcggctcctgtccccagttagagtgcctaactacaatcttataatcatggatgaggctcacttcacagaccccgcgagtattgcagccaggggctatatctctacgcgcgtcgaaatgggggaggctgccggaatctttatgactgcaaccccaccgggcagccgagatcctttcccccagtccaacgccccaattatggacgaggaaagagagatacccgaacggtcatggaattctggtcatgagtgggtgacagattttaaggggaaaaccgtatggttcgtgcctagcatcaaggctggaaacgacattgcggcctgcctgaggaaaaatggcaagaaagttatccaattgagtcgcaagacttttgattccgaatacgtcaagacacgtgcaaacgactgggatttcgtggtgaccacggacattagcgagatgggcgctaattttagagccgagcgggtcatcgatccaaggcgctgtatgaaacccgtaatactaactgacggggaagagcgagtgatcctggcaggacctatgccggttacacactcttcagccgctcagagacggggtaggattggccgcaacccaaagaatgaaaacgaccagtatatctacatgggggagcccctcgaaaatgatgaggactgcgcccattggaaagaggcgaagatgttactggataacattaatacccctgaaggaatcataccctccatgttcgagccagaaagagagaaagtggacgcaattgatggcgaatacaggcttcggggtgaggcccgtaagacctttgtcgacctgatgcgccgaggggatctccctgtgtggttggcttatagagttgccgctgagggcatcaactacgcagacaggcggtggtgtttcgatggaattaaaaataaccaaatcctggaagagaacgtggaagtcgagatatggactaaggagggcgaacgcaagaaactcaagcccagatggctggacgccaggatctatagtgatccacttgctctaaaagagttcaaggaatttgccgcagggcggaaaagcctgacattgaatttaattaccgagatgggacgactgcctacattcatgactcagaaggcgagagacgccctcgataacctggctgtgcttcacacggccgaagtaggtggccgcgcatacaatcacgctctgtcggagctcccggagaccttggaaacactgctactgctcactcttctggccaccgtgacagggggaatctttttattcttgatgtctggcaagggtattgggaaaatgaccctgggcatgtgctgcatcataactgcatccattctcctgtggtatgcccagatccagccccattggatcgctgcgagcattatccttgagtttttcctgatagttctcttgattccagaacctgagaagcaaaggacgccccaggacaaccagctgacctacgtcgtgatcgccattttaacagtggtcgcagctactatggccaatgaaatgggatttctagagaaaaccaagaaagacctgggcctcgggtcaatcacaacccaggagagtgaatctaacatacttgatatcgacctgcggccagcctccgcatggactttgtatgctgttgccacaacgttcgtgacccctatgctgcgtcacagcattgagaattcaagtgtaaacgtgagcctcactgcgatcgctaatcaagccacagtcctgatgggacttggtagaggctggcccctctccaagatggatattggggtgccgctgttggcaatcggatgttactctcaggttaacccaattaccctgaccgccgctttactactgctcgtggcacattacgccatcataggccctggtcttcaggcgaaggctacaagggaagcccagaaacgcactgcagccgggattatgaagaatcccacggtcgacggcatcaccgtaatcgatctggagccaattccctatgaccctaaatttgaaaagcaattgggacaggtgatgctgctcgttctgtgcgtgacacaggtccttatgatgcggactacctgggctttatgtgaggccctgacactcgcaaccggcccgataagcactttgtgggaggggaaccccggacgattctggaatacgacaatcgctgtgtccatggccaacatttttagaggctcatacctggcgggtgccgggctactgttctctatcatgaaaaataccactaacaccaggcgcggaacaggcaatattggtgaaactctcggcgagaagtggaagagtcggcttaacgcactggggaaatcggaatttcagatctataagaaaagcggaatacaagaggtcgatagaaccttggctaaggagggcatcaaacgtggggaaacagaccaccatgccgtgtccaggggatctgcaaagctgcggtggttcgttgagcgcaacatggtgacgccagaaggcaaagtagtggatctcggttgcgggcgaggaggctggtcatactattgtggtggcctgaagaatgtcagagaggttaaggggttaaccaaaggaggccctgggcacgaagagcccattcctatgagcacttacggatggaaccttgtgaggctgcagtccggcgtcgacgtgttctttacaccacccgagaagtgcgataccctcctatgtgacatcggtgaaagttctcctaatccaactattgaggctgggcggacactgcgcgtattgaacctggtggaaaattggctcaacaataacacccagttctgcgttaaagtgcttaatccctatatgccgagcgtcatcgagaagatggaaacgctgcaaagaaaatacggaggcgccttggtgaggaaccctctgtcacgaaattccacccacgagatgtactgggtcagtaacgccacaggcaatatagtgagctctgttaacatgatttcccggatgctcatcaatcgttttactatgaagcataagaaagcgacctatgagccagatgtagacttagggtcaggaacaagaaacatcggtattgaaaacgagatacccaatctggacatcattggcaagcgcatcgaaaaaattaagcaggagcacgaaactagctggcattacgatcaggaccacccttataaaacctgggcttaccacgggtcgtatgagacaaagcagaccggatctgcaagttccatggtgaacggcgtcgtgaagcttctgactaaaccatgggatgttgtgcccatggtcacgcaaatggccatgacagacaccactccgttcggtcagcagagggtgtttaaggagaaagtagatacccggacacaggaacctaaggaggggacgaaaaagctaatgagaatcaccgctgaatggctctggaaggagctgggaaaaaagaaaactccccgcatgtgtacaagggaggaattcacccgaaaggtgcggagcaatgccgcattgggcgccatatttactgacgagaacaaatggaagtcagctagagaagcggttgaggattccaggttctgggaactggtcgaccgcgagcgtaatctccatcttgagggcaaatgcgaaacatgtgtgtacaacatgatggggaagcgggagaagaaactgggagaatttggtaaggccaaaggctctagagcaatctggtatatgtggttaggggctaggttcctggagtttgaagccttgggattcctcaatgaggatcactggtttagccgcggcaacagtctgtccggtgtggagggggaaggactacataagcttggctacattctgcgagacgtcagcaaaaaggagggcggggcaatgtacgccgatgacaccgctggatgggacacacggatcactctcgaagatctgaagaatgaggaaatggttaccaaccacatgaaaggtgagcataagaaattggccgaggcgattttcaagctgacgtatcaaaataaagtggtaagagtgcagaggccaacccctcgcggcacagtcatggacatcatttctagaaaggatcagcgggggtcaggacaggtgggcacttacggtctcaacaccttcacaaatatggaagcacaacttataaggcagatggagggggaaggaatctttaagagtattcagcgtctgactgttaccgaggagatcgccgtgcaaaactggttagctcgagtcggccgcgaaagactgtcccggatggccatcagcggcgacgattgcgtggtaaaacccttggacgataggttcgcatctgctctcacggccctgaatgacatggggaaggttcgcaaagatattcagcagtgggagccatcgagaggatggaacgactggacacaggtgcccttttgctcacaccacttccatgaactagtcatgaaggatggtcggatgcttgtggtgccttgtaggaaccaagacgagctgataggccgagctcgtatcagccagggggccggatggtccctcaaagaaaccgcatgcctgggcaagagttatgcgcagatgtggactttgatgtactttcacagacgcgatttacggctggccgctaatgccatttgttctgcagtcccaagccattgggttccgacatccaggaccacttggtcaatccacgctaagcacgagtggatgaccacagaggacatgctcgccgtgtggaacagagtatggattcaggaaaatccctggatggaggacaaaacgcctgtggaaagttgggaggaagtcccatatcttggtaagcgcgaggatcaatggtgcgggtctctgatcggactaaccagccgggcaacttgggccaaaaacatacagacagcgatcaatcaggtgaggtccctgattggcaacgaggaatacaccgactatatgccctcaatgaagcgattcagaaaagaggaagaggaagctggcgttctctggtga

SEQ ID NO: 14627 - RNA, 9876 nt, synthetic construct
  misc_feature 1..9876: note = derived and/or modified CDS sequence (opt3) from DENV-2__EU482552__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaactgggaaggcccttcaccaagttttcggcgctatttacggagcggcatttagtggcgtgagctggaccatgaaaatcttgataggggtaatcattacgtggatcggaatgaactccagatctacaagcctgtcagtcagtctcgtgctggttggcgtggtcaccctttatctgggtgtgatggtacaggccgacactgggtgtgtggtttcctggaagaataaagaattgaagtgcggaagcggcattttcatcacagataacgtccacacctggactgagcagtacaagtttcagcccgaatctccatcaaaactcgctagtgccatacaaaaggcacatgaggaaggtatttgtggcatcaggagcgtgacccggctggagaatttaatgtggaaacagattacacccgagctgaaccacatcctatccgaaaatgaggtgaagctcacgataatgaccggggacatcaaaggaattatgcaggccggcaagcgctctctgagacctcagccaactgaacttaaatattcgtggaagacatgggggaaggctaaaatgttgagcaccgagtcccataaccaaacattcctgatcgatggaccggaaactgccgagtgccccaataccaacagggcatggaattcactcgaggtcgaagactacggctttggtgttttcagtacgaacatttggctgaagttacgtgagaaacaggacgtgttttgtgattctaagctgatgagcgcggctatcaaagacaatcgggccgtgcacgcagatatggggtattggatagaatccgcccttaacgacacatggaagatggagaaggcttcattcattgagatcaaaagctgccactggcctaagtctcataccttgtggtccaatggagtactcgaaagtgagatgatcattccaaaaaacttcgccggccccgtcagccagcacaactaccgacctggttatcatactcagaccgcaggcccatggcacctggggaagctagaaatggattttgacttctgtgagggaacaactgtggttgtgaccgaagattgcggcaatagagggccctctctgaggacaacgaccgcttccggaaaactcatcactgagtggtgctgtcgctcatgcacactgccgcctcttcggtacagaggcgaggacggttgttggtacgggatggaaattaggccattgaaggagaaggaagagaacctggtcaatagtttagtgaccgccggatatggccaaatagataactttagcctcggtgttctgggcatggcgcttttcctggaagagatgttgcgcactcgagtggggacaaaacatgccatcctcctggtagctgtctcgtttgtgaccctaattacgggaaatatgtccttccgggacctgggccgtgtgatggtcatggttggggcaactatgaccgatgacatcggaatgggcgtgacatacctcgccctgcttgctgcctttaaggtaagacccaccttcgcagcgggtttgctgttaaggaaactcacttctaaggagctgatgatggccacaattgggatcgctcttctgagccagtcaaccatacctgaaacaatcctagagctcactgatgccctggcattgggaatgatggtgctgaaaattgtccgcaacatggaaaagtatcagttagctgtgaccatcatggccattagttgcgttcccaatgcagtgatcctccaaaacgcctggaaggtctcctgtacgatactggctgcggtgtctgttagcccacttctgttgacatcctcacagcagaaagccgactggattcctctcgcactgaccatcaagggcctaaatcccactgctatctttctgaccacacttagccggactagtaaaaagagatcttggccactcaacgaggccattatggccgtgggcatggtctccatactggctagctcgttgctgaaaaatgacatcccgatgaccgggcctttagtagcaggaggtctcctgacggtgtgctacgttcttacaggcaggtcagccgatctggaattggagcgagcggctgacgtgaagtgggaggatcaggccgaaatttctgggagttcccccatcctcagcattaccatctctgaggacggaagcatgtccataaaaaacgaagaggaggaacacactctgacaatcctaattcgcaccggcctgcttgtcatctcaggtgtgttcccagtaagtattcccatcactgcagccgcttggtatctctgggaggtgaagaagcaacgggcaggggtcctgtgggatgttcctagcccaccccctgtgggaaaagccgaattggaggacggcgcgtacagaataaagcagaggggcatttttgggtattctcagatcggagctggtgtgtacaaagaaggcacattccacaccatgtggcatgtcacgcgtggggccgtgttaatgcaccgcggaaagcggatcgagccgtcctgggcagatgttaaaaaggacctgatttcatacggcggtgggtggaagctcgagggagaatggaaagagggcgaagaggtacaggtgctggcccttgaaccaggcaagaatcccagagctgtccaaactaaacctgggctgtttaagaccaacacaggaaccatcggtgccgtgagtttggatttcagcccaggcacatccgggtctcccatagttgacaggaaaggaaaggtggtcggcctatatggtaatggggtggtaactcgatcgggagcatacgtcagcgctattgcccagaccgagaagtcaatcgaggataaccctgaaattgaggacgatatcttccggaaaaagcgcctgacgataatggacctccatccgggcgcgggcaaaacaaagagatatctgcccgccattgtgagggaagcaatcaaacgggggcttcgaactttaatcctggctccaaccagagttgtggccgctgagatggaagaggcactccgcggattgcctattaggtaccagacacccgccatccgtgccgagcacaccggtcgggaaattgtcgacctgatgtgtcatgctacttttaccatgagactcctgtccccagtgagggttcctaactataatcttataatcatggatgaggcgcacttcacagaccccgcaagtattgccgctcgcggctacatctctacgcgagtggaaatgggggaggccgcaggaatctttatgactgccaccccaccgggcagcagagatcctttcccccagtccaacgctccaattatggacgaggaacgggagatacccgaaaggtcatggaattctggtcacgagtgggtcacagattttaaggggaagaccgtgtggttcgtacctagcatcaaagcgggaaacgacattgccgcatgcctgcgcaagaatggcaaaaaggtgatccaattgagtcgtaaaacttttgattccgaatatgttaagacaagagctaacgactgggatttcgtcgtgaccacggacattagcgagatgggcgccaattttcgggcagagagggtgatcgatccacgccgatgtatgaagcccgtcatactaactgacggggaagagagagtaatcctggccggacctatgccggtgacacattcttcagctgcccagcggaggggtcgcattggcagaaacccaaaaaatgaaaacgaccagtacatctacatgggggagcccctcgaaaatgatgaggactgcgcgcactggaaggaggcaaaaatgttactggataacattaatacccctgaaggaatcataccctccatgttcgagccagaaagggagaaggttgacgccattgatggcgaatatcggcttcgtggtgaggctcgcaaaacctttgtggacctgatgcgaagaggggatctccctgtctggttggcctacagggtggctgcagagggcatcaactatgccgaccggcgctggtgtttcgatggaattaagaataaccaaatcctggaagagaacgttgaagtggagatatggactaaagagggcgaaagaaagaagctcaaacccaggtggctggacgctcggatctacagtgatccacttgccctaaaggagttcaaagaatttgcagcggggcgaaagagcctgacattgaatttaattaccgagatgggaagactgcctacattcatgactcagaaagcccgcgacgctctcgataacctggccgtccttcatacggcagaagtgggtggcagggcttataatcacgccctgtcggagctcccggagaccttggaaacactgctactgctcactcttctggcaaccgtaacagggggaatctttttattcttgatgtctggcaagggtattgggaagatgaccctgggcatgtgctgcatcataactgcctccattctcctgtggtacgctcagatccagccccactggatcgcggccagcattatccttgagtttttcctgatagtgctcttgattccagaacctgagaaacaacggacgccccaggacaaccagctgacctatgttgtcatcgcaattttaacagtggtggctgccactatggccaatgaaatgggatttctagagaagaccaaaaaggacctgggcctcgggtcaatcacaacccaggagagtgaatctaacatacttgatatcgacctgcgtccagcatccgcttggactttgtacgccgtcgcgacaacgttcgttacccctatgctgagacatagcattgagaattcaagtgtgaacgtaagcctcactgctatcgccaatcaagcaacagtgctgatgggacttggtaggggctggcccctctccaaaatggatattggggtcccgctgttggccatcggatgttactctcaggtgaacccaattaccctgaccgctgcattactactgctcgttgcccactatgcgatcataggccctggtcttcaggctaaggccacacgcgaagcacagaagcggactgccgctgggattatgaaaaatcccacggtggacggcatcaccgtcatcgatctggagccaattccctacgaccctaagtttgaaaaacaattgggacaggtaatgctgctcgtgctgtgcgttacacaggtgcttatgatgcgaactacctgggccttatgtgaggcactgacactcgctaccggcccgataagcactttgtgggaggggaaccccggaagattctggaatacgacaatcgccgtctccatggcgaacatttttaggggctcatatctggccggtgcagggctactgttctctatcatgaagaataccactaacacccgccggggaacaggcaatattggtgaaactctcggcgagaaatggaagagtagacttaacgctctggggaagtcggaatttcagatctacaaaaagagcggaatacaagaggtggatcgtaccttggccaaagagggcatcaagaggggggaaacagaccatcacgcagtctcccggggatctgctaaactgcgctggttcgtggagcgaaacatggttacgccagaaggcaaggtggtagatctcggttgcgggagaggaggctggtcatattactgtggtggcctgaaaaatgtgagggaggtcaaggggttaaccaagggaggccctgggcatgaagagcccattcctatgagcacttatggatggaaccttgttcggctgcagtccggcgtggacgtcttctttacaccacccgagaaatgcgataccctcctatgtgacatcggtgaaagttctcctaatccaactattgaggccgggcgcacactgagagtgttgaacctggtagaaaattggctcaacaataacacccagttctgcgtgaaggttcttaatccctacatgccgagcgtgatcgagaaaatggaaacgctgcaaaggaagtacggaggcgccttggtccgaaaccctctgtcacggaattccacccacgagatgtattgggtgagtaacgcgacaggcaatatagtcagctctgtgaacatgatttcccgtatgctcatcaatagatttactatgaaacacaagaaggctacctacgagccagatgttgacttagggtcaggaacacgcaacatcggtattgaaaacgagatacccaatctggacatcattggcaaaaggatcgaaaagattaaacaggagcatgaaactagctggcactatgatcaggaccatccttacaagacctgggcatatcacgggtcgtacgagacaaaacagaccggatctgccagttccatggtaaacggcgtggtcaagcttctgactaagccatgggatgtggttcccatggtgacgcaaatggctatgacagacaccactccgttcggtcagcagcgggtctttaaagagaaggtggataccagaacacaggaacctaaagaggggacgaagaaactaatgcgcatcaccgccgaatggctctggaaggagctgggaaagaaaaagactcccaggatgtgtacacgagaggaattcacccggaaagtaagaagcaatgcagccttgggcgctatatttactgacgagaacaagtggaaatcagcgagggaagccgtggaggattcccgcttctgggaactggttgaccgtgagcggaatctccaccttgagggcaagtgcgaaacatgtgtctataacatgatggggaaaagagagaagaagctgggagaatttggtaaagcaaagggctctagggctatctggtacatgtggttaggggcccgcttcctggagtttgaagcattgggattcctcaatgaggatcattggtttagccgaggcaacagtctgtccggtgtggagggggaaggactacacaaacttggctacattctgcgggacgtgagcaagaaagagggcggggccatgtatgctgatgacaccgccggatgggacacaagaatcactctcgaagatctgaagaatgaggaaatggtcaccaaccatatgaagggtgagcacaaaaagttggcggaggcaattttcaaactgacgtaccaaaataaggttgtgagggtacagcgcccaacccctagaggcacagtgatggacatcatttctcggaaagatcagagggggtcaggacaggtcggcacttatggtctcaacaccttcacaaatatggaagcccaacttatacgtcagatggagggggaaggaatctttaagagtattcagcgactgactgtgaccgaggagatcgctgttcaaaactggttagcccgcgtgggcagagaacggctgtccaggatggcaatcagcggcgacgattgcgtcgtgaagcccttggacgatcgcttcgcttctgccctcacggctctgaatgacatggggaaagtaagaaaggatattcagcagtgggagccatcgcggggatggaacgactggacacaggttcccttttgctcacatcacttccacgaactagtgatgaaagatggtagggtccttgtggtgccttgtcgaaaccaagacgagctgataggccgtgccagaatcagccagggggcaggatggtccctcaaggaaaccgcgtgcctgggcaaaagttacgcccagatgtggactttgatgtattttcatcgccgggatttaaggctggctgccaatgcaatttgttctgctgtcccaagccactgggttccgacatccagaaccacttggtcaatccatgccaagcacgagtggatgaccacagaggacatgctcgcagtgtggaaccgcgtatggattcaggaaaatccctggatggaggacaagacgcctgtggaaagttgggaggaagtcccataccttggtaaacgggaggatcaatggtgcgggtctctgatcggactaaccagcagggccacttgggcgaagaacatacagacagctatcaatcaggtgcgatccctgattggcaacgaggaatataccgactacatgccctcaatgaaaagattccggaaggaggaagaggaagccggcgttctctggtga

SEQ ID NO: 14628 - RNA, 9876 nt, synthetic construct
  misc_feature 1..9876: note = derived and/or modified CDS sequence (opt3) from DENV-2__EU482554__SS-prME
  source 1..9876: mol_type = other RNA
accgccggagtgatcattatgctgatacccacagctatggcattccacctcactacgcggaatggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactgctccggcaaaacgaaccggaggatattgactgttggtgcaattccacatctacctgggtgacttatggaacatgtaccacgactggcgagcaccgccgagaaaagcgttcagtcgcgctggtgccccatgtcggtatggggcttgagaccagaacagaaacttggatgagtagcgagggagcttggaaacacgtgcagaggatcgagacctggattctgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttatctgcaagcattctatggtggatagaggctggggtaacgggtgtggactattcggcaagggcgggattgtaacctgcgccatgtttacatgcaaaaagaatatggaaggaaccgtggtgctccctgagaacctggaatacactatagtcatcacgccacacagcggtgaggagcatgctgttggcaatgacacagggaaacacggaaaggaaattaaaatcaccccgcagtcctcaataactgaggccgaacttaccggctatggtacagtgaccatggagtgtagtcccaggactgggctggatttcaacgaaatggtattgctccagatggaggacaaggcatggctggtgcaccggcaatggtttttagatctgcctctcccatggcttcccggcgctgacacacagggaagcaattggattcagaaagagacgctggtcaccttcaagaaccctcatgccaagaaacaggacgtggttgtgttgggctctcaagaaggggcgatgcacactgccctaacaggagcaaccgagatccagatgtcctcaggtaatctgctctttacaggccatctgaagtgccgtcttcgcatggataaactgcagttgaaggggatgagctacagtatgtgtactggaaaattcaagatcgtcaaggaaattgctgagacccaacacggcacgatcgtgattagagtacagtatgagggtgacgggtctccatgcaaaatacccttcgaaatcatggatctcgagaagaggtacgttctgggccggttaattaccgtgaacccgatcgtcacagaaaaagactcccctgtgaacatcgaggccgaacccccatttggagatagctacattataatcggcgtcgagcctgggcagctgaagctaaattggttcaaaaagggatcgtctattggtcagatgtttgagactaccatgcgaggcgctaagcgcatggccatcctcggggacacagcatgggatttcggatccctgggcggtgtgtttacttcaattgggaaagcccttcatcaagttttcggcgctatctatggagcggcatttagtggcgtgagctggaccatgaagatattgatcggggtaattatcacgtggattggaatgaactccagatctacaagcctgtcagtcagtctcgtgctggttggcgtggtcaccctttacctgggtgtgatggtacaggccgactccgggtgtgtggttagctggaaaaataaggaattgaaatgcggatctggcatcttcataactgataacgtccacacatggaccgagcagtataagtttcagcccgaatcaccaagtaagctcgctagcgccattcaaaaagcacacgaggaaggtatctgtggcattaggtccgtgactcggctggagaatttaatgtggaagcagatcacccccgagctgaaccatatactatctgaaaatgaggtgaaactcacaatcatgacgggggacattaagggaatcatgcaggccggcaaacgctcgctgagacctcagccaaccgaacttaagtacagctggaaaacttgggggaaggctaagatgttgtccacagagtcacacaaccaaaccttcctgattgatggaccggaaacagccgagtgccccaatactaacagggcatggaatagtctcgaggtcgaagactatggctttggtgttttctctaccaacatctggctgaaattacgtgagaagcaggacgtgttttgtgatagcaaactgatgtccgcggctataaaggacaatcgggccgtgcatgcagatatggggtactggattgaatcagcccttaacgacacgtggaaaatggagaaggctagcttcatcgaggtaaagtcttgccactggcctaaatcccacacattgtggagtaatggagtcctcgaaagcgagatgatcattccaaagaacttcgccggccccgtgtctcagcataactatcgacctggttaccacacccagactgcaggcccatggcatctggggaaactagaaatggattttgacttctgtgagggaaccacagttgtggtcactgaagattgcggcaatagagggccctccctgaggaccacaacggcttcaggaaagctcatcaccgagtggtgctgtcgcagttgcactctgccgcctcttcggtacagaggcgaggacggttgttggtatgggatggaaattaggccattgaaagagaaggaagagaacctggtgaatagcttagttacagccggacacggccaaatagataacttttcgctcggtgtgctgggcatggcgcttttcctggaagagatgttgcgcacccgagtagggactaagcatgccatcctcctggtcgctgtgtcctttgtgacactaattaccggaaatatgtctttccgggacctgggccgtgtcatggttatggtgggggcaacgatgactgatgacatcggaatgggcgtaacctacctcgccctgcttgctgcctttaaagtgagacccacattcgcagcgggtttgctgttaaggaagctcaccagcaaagagctgatgatggccactattgggatcgcacttctgtcacagagtacaatacctgaaaccatcctagagctcacagatgccctggcattgggaatgatggtcctgaagattgtgcgcaacatggaaaaatatcagttagctgttactatcatggccattctctgcgtgcccaatgcagtcatcctgcaaaacgcctggaaggtgtcctgtaccatacttgctgcggtttctgtgagcccactgttgctcacgtcctcacagcagaaggccgactggattcctctggcactaacaatcaaaggcctgaatcccaccgctatctttcttactaccctcagccggacaagtaagaaaagatcttggccactgaacgaggccgtcatggccgtaggcatggtgtccattttggctagctcgctgttaaagaatgacataccgatgactgggcctctcgttgcaggaggtctgcttaccgtgtgctacgtcctgacgggcaggtcagccgatttggaactcgagcgagcggctgacgtgaaatgggaggatcaggccgaaatctctgggagttcccccattctgagcatcacaatttctgaggacggaagcatgtccatcaagaacgaagaggaggaacaaaccctaactatactgatccgcacaggccttctcgtaatttcaggtgtgttcccagtcagtatccccattaccgcagccgcttggtatctgtgggaggttaaaaagcagcgggcaggggtgttgtgggatgtgcctagcccaccccctgtcggaaaggccgaattagaggacggcgcgtacagaatcaaacagaggggcatatttgggtattctcagattggagctggtgtgtacaaggaaggcactttccacacaatgtggcacgttacccgtggggccgtactgatgcatcgcggaaaacggatcgagccgtcctgggcagatgtgaagaaagacctcatctcatacggcggtgggtggaagctggagggagaatggaaggagggcgaagaggtccaagtgcttgccctggaaccaggcaaaaatcccagagctgttcagacgaagcctgggttgtttaaaactaacaccggaacaattggtgccgtgagtctagatttcagcccaggcacctccgggtctcccatcgtcgacaggaagggaaaagtggtaggcctgtatggtaatggggtcgtgacacgatcgggagcatacgttagcgctatagcccagactgagaagtcaattgaggataaccctgaaatcgaggacgatattttccggaagaaacgcctcaccatcatggacctgcacccgggcgcgggcaagacgaaaagatatcttcccgccatagtgagggaagcaattaagcgggggttacgaacactgatcctcgctccaactagagtcgtggccgctgagatggaagaggcattgcgcggactgcctatcaggtaccagacccccgccattcgtgccgagcatacaggtcgggaaatcgttgacctcatgtgtcacgctacctttactatgagactgctttccccagtgagggtccctaactataatctgattataatggatgaggcgcatttcaccgaccccgcaagtatcgccgctcgcggctacatttctacacgagtggaaatgggggaggccgcaggaatctttatgacggccactccaccgggcagcagagatcctttcccccaatccaacgctccaatcatggacgaggaacgggagattcccgaaaggtcatggaactctggtcacgagtgggtaaccgattttaaagggaagacagtgtggttcgttcctagcataaaggcgggaaacgacatcgccgcatgcttgcgcaaaaatggcaagaaagtcattcagctaagtcgtaagacctttgattccgaatatgtgaaaactagagctaacgactgggatttcgtggtcacaaccgacatcagcgagatgggcgccaattttcgggcagagagggtaattgatccacgccgatgtatgaagcccgtgatcctgacggacggggaagagagagttatactcgccggacctatgccggtgactcactcttcagctgcccagcggaggggtcgcatcggcagaaacccaaagaatgaaaacgaccaatacatttacatgggggagcccttagaaaatgatgaggactgcgcgcattggaaagaggcaaagatgctgcttgataacatcaatacacctgaaggaattatcccctccatgttcgagccagaaagggagaaagtcgacgccatagatggcgaatatcggctgcgtggtgaggctcgcaagacctttgtggacctcatgcgaagaggggatttgcctgtttggctggcctacagggtggctgcagagggcattaactatgccgaccggcgctggtgtttcgatggaatcaaaaataaccagattctcgaagagaacgtcgaagtggagatctggaccaaggagggcgaaaggaagaaactgaaacccaggtggcttgacgctcggatatacagtgatccactagccctgaaagagttcaaggaatttgcagcggggcgaaagagcttgactttaaatctgatcacagagatgggaagactccctaccttcatgacacagaaggcccgcgacgctctggataaccttgccgtactgcacactgcagaagtgggtggcagggcttataatcatgccctctcggagttgccggagacgctggaaaccctactgctccttacactgttagcaactgttaccgggggaatatttttgttcctgatgtctggcaaaggtatcgggaagatgacactcggcatgtgctgcattatcaccgcctccatactgctttggtacgctcagattcaaccccactggatcgcggccagcatcattctggagtttttcctcatcgtcttgctgataccagaacctgagaagcagcggactccccaggacaaccagttaacgtatgtggtgattgcaatcctaaccgtcgttgctgccacaatggccaatgaaatgggatttctggagaaaactaagaaagacctcggccttgggtcaattatcacccaagagagtgaatctaacatactggatatcgacttgcgtccagcatccgcttggacactgtacgccgtggcgaccactttcgtaacacctatgctcagacacagcattgaaaattcaagtgtgaacgtcagcctgacggctatcgccaatcaggcaaccgtgcttatgggactcggtaggggctggcccctgtccaagatggatattggggttccgttgctggccatcggatgttactctcaggtgaacccaattactttaacagctgcactactgctccttgtcgcccattatgcgatcataggccctggtctgcaggctaaagccacccgcgaagcacaaaagcgggccgctgccgggattatgaagaatcccaccgtagacggcatcacagtgatcgatttggagccaattccctacgaccctaaatttgaaaagcagctgggacaggttatgctcctggtgctttgcgtcactcaggtgttaatgatgcgaacgacctgggcactgtgtgaggctctcacattggccactggcccgataagcaccctgtgggaggggaaccccggaagattctggaatacaaccatcgcggtctccatggccaacatttttaggggctcatatctagctggtgctgggctactcttctctatcatgaaaaatactacgaacacacgccggggaaccggcaatattggtgaaactcttggcgagaagtggaaaagtagactgaacgccttggggaagtcggaatttcaaatctacaagaaaagcggaatacaggaggtggatcgtaccctggcaaaggagggcatcaaaagaggggaaacagaccaccatgctgtttcccggggatctgccaagctccgctggttcgtggagcgaaacatggtaactccagaaggcaaagtggtcgatctgggttgcgggagaggaggctggtcatattactgtggtggcttaaagaatgttagggaggtgaaagggcttaccaagggaggccctgggcacgaagaacccattcctatgagcacatatggatggaacctggtccggctccagtccggcgtggacgtattctttacgccacccgagaagtgcgataccctactgtgtgacatcggtgaaagttctcctaatccaactattgaggccgggcgcacattgagagtgctgaacctcgttgaaaattggcttaacaataacacccaattctgcatcaaagtgctgaatccctacatgccgagcgtcatagagaagatggaaactttgcagaggaaatacggaggcgcgctggtgcgaaaccctctctcaagaaattccacacatgagatgtattgggtcagtaacgctaccggcaatattgtgagctctgttaacatgatctcccgtatgttaatcaatagatttacgatgaagcacaaaaaggcaacctacgagccagatgtagacctggggtcaggaacacgcaacattggtatagaaaacgagatccccaatcttgacattatcggcaagaggattgagaaaatcaagcaggagcacgaaactagctggcattatgatcaggaccacccttacaaaacctgggcctatcatgggtcgtacgagacaaagcaaactggatctgctagttccatggtgaacggcgtcgtgcggctgctaaccaaaccatgggatgttgtgcccatggtcacacagatggccatgaccgacactacgccgttcggtcagcagagagtgtttaaggagaaggtagatacacgcacccaagaacctaaagaggggactaagaaactcatgaggataaccgcagaatggctgtggaaggagttgggcaaaaagaagacaccccgaatgtgtacgcgggaggagttcaccagaaaagtgaggagcaatgccgctctgggcgcgatctttactgacgagaacaagtggaaatcagcccgcgaagcagttgaggattcccgtttctgggaactcgtcgaccgggagagaaatcttcacctggagggcaagtgcgaaacatgtgtgtataacatgatggggaaaagggagaagaaattaggagaatttggtaaggctaagggctctcgcgccatttggtacatgtggctgggggcacgattcttggagtttgaagccctcggattcctgaatgaggatcactggtttagccggggcaacagtctatccggtgtggagggggaaggacttcataaactgggctacatcctcagagacgtcagcaagaaagagggcggggctatgtatgccgatgacaccgcgggatgggacactaggattacactggaagatttgaagaatgaggaaatggttaccaaccacatgaaaggtgagcataagaagctggcagaggccatcttcaaactcacataccagaataaggtggtacgcgtgcagagaccaactcctcggggcaccgtcatggacattatatctaggaaagatcagcgtgggtcaggacaagtgggcacgtatggtcttaacaccttcacaaatatggaagctcagctgatccgacagatggagggggaaggaatttttaagagtatccaacacttaactgttaccgaggagatcgccgtgcagaactggctggcacgcgtcggcagagaacggttgtccaggatggctattagcggcgacgattgcgtggtaaaacccctcgacgatcgcttcgcctctgctctgacagccctaaatgacatggggaaggttagaaaggatatacagcagtgggagccatcgcggggatggaacgactggactcaagtgcccttttgctcacatcacttccacgaacttgtcatgaaagatggtagggtgctggtggtcccttgtcgaagccaggacgagctcatcggccgtgcaagaatttcccagggggcgggatggagtctgaaggaaaccgcctgcttgggcaaatcttacgctcagatgtggacgttaatgtattttcatcgccgggatctgaggctcgccgcaaacgctatctgtagcgccgttccatcccactgggtgccgacatcaagaaccacttggagtattcatgcaaagcacgagtggatgacaaccgaggacatgcttgccgtatggaatcgcgtgtggatccaagaaaacccctggatggaggacaaaactctggtcgaatcttgggaggaagtgccttacctaggtaagcgggaggatcagtggtgcgggagcctgataggactcacctccagggcgacatgggctaagaatatccagacggccattaaccaggttcgatcattgatcggcaatgaggaatataccgactacatgccaagcatgaaaagattccggaaggaggaagaggaagcaggcgtgctgtggtga

SEQ ID NO: 14629 - RNA, 9876 nt, synthetic construct
  misc_feature 1..9876: note = derived and/or modified CDS sequence (opt3) from DENV-2__EU482556__SS-prME
  source 1..9876: mol_type = other RNA
accgccggcgtgatcattatgctgataccaacagctatggctttccacctcactacgaggaacggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtcgcgctggtgccccatgtcggtatggggcttgagaccagaacagaaacttggatgagtagcgagggagcttggaaacacgtgcagaggatcgagacctggattctgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggactgttcggcaagggcgggattgtaacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggtaagccacgaaatggtgttgctccagatggaggataaagcatggctggtccatcggcaatggttcttagacctgcctctcccatggcttcccggcgctgatactcagggatctaactggattcagaaggagacactggtgacgtttaagaatcctcacgccaaaaagcaggacgttgtggtcttgggctcccaagaaggggcgatgcataccgccctgactggagcaacagagatccagatgtcaagcggtaacctactcttcaccggccacctgaaatgccgtcttcgcatggacaagctgcagttgaaagggatgagttactctatgtgtacaggaaagtttaagatcgtgaaagaaattgctgagactcaacatggcaccatcgtaattagagttcagtatgagggtgatgggtccccatgcaagatacccttcgaaatcatggacctcgagaaaaggcacgtgctgggccggttaattacggtcaatccgatcgtgaccgaaaaggatagccctgtcaacatcgaggccgaacccccattcggagactcgtacattataatcggcgtggagcctgggcagctgaaactaaactggtttaagaagggatcttccattggtcagatgttcgagacaactatgcgaggcgctaaacgcatggccgttctcggggataccgcatgggactttggatcactgggcggtgtgttcacaagtatcgggaaggcccttcaccaagtatttggcgctatttacggagcggcattcagcggcgtctcctggactatgaaaatcttgataggggtgatcattacctggatcggaatgaactctagaagcacgtcactgagtgtttccctcgtgctggtcggcgtggtaacactttatctgggtgtgatggttcaggccgataccgggtgtgtcgtgagctggaagaacaaagaattgaagtgcggatctggcatttttatcactgacaatgtgcatacatggaccgagcagtacaagttccagcccgaatcaccaagtaaactcgctagcgccatacaaaaggcacacgaggaaggtatttgtggcatcaggtccgtcactcggctggagaacttaatgtggaaacagattacccccgagctgaatcatatcctatctgaaaacgaggttaagctcacaataatgacgggggatatcaaaggaattatgcaggccggcaagcgctcgctgagacctcagccaaccgaacttaaatatagctggaagacttgggggaaggctaaaatgttgtccacagagtcacacaatcaaacctttctgatcgacggaccggaaacagccgagtgccccaacactaatagggcatggaacagtctcgaggtggaagattacggcttcggtgtgttttctaccaatatttggctgaagttacgtgagaaacaggacgtattctgtgacagcaagctgatgtccgcggctatcaaagataaccgggccgtccacgcagacatggggtattggatagaatcagcccttaatgatacgtggaagatggagaaggctagctttattgagatcaaatcttgccattggcctaagtcccacacattgtggagtaacggagtgctcgaaagcgagatgatcattcccaaaaatttcgccggccccgtttctcagcataactaccgacctggttatcacacccagactgcaggcccatggcatctggggaagctagaaatggacttcgatttttgtgagggaaccacagtggtcgtgactgaagactgcggcaacagagggccctccctgaggaccacaacggcttcaggaaaactcatcaccgagtggtgctgtcgcagttgcactctgccgcctcttcggtacagaggcgaggatggttgttggtacgggatggaaattaggccattgaaggagaaggaagagaatctggttaacagcttagtgacagccggacacggccaaatagacaatttctcgctcggtgtactgggcatggcgctttttctggaagagatgttgcgcacccgagtcgggactaaacacgccatcctcctggtggctgtgtccttcgtcacactaattaccggaaacatgtcttttcgggatctgggccgtgttatggtgatggtaggggcaacgatgactgacgatatcggaatgggcgtgacctatctcgccctgcttgctgccttcaaggtcagacccacatttgcagcgggtttgctgttaaggaaactcaccagcaaggagctgatgatggccactattgggatcgcacttctgtcacagagtacaatacctgaaaccatcctagagctcacagacgccctggcattgggaatgatggtgctgaaaattgttcgcaatatggaaaagtaccagttagctgtgactatcatggccatttcctgcgtccccaacgcagtgatcctccaaaatgcctggaaggtttcttgtaccatactggctgcggtgagcgtctccccacttctgttgacgtcaagccagcagaaagccgattggattcctctcgcactgacaatcaagggcctaaaccccaccgctatcttcctgactacccttagtcggacatctaaaaagagatcctggccactcaatgaggccgtaatggccgtgggcatggttagcattctggcttcgtcattgctgaaaaacgacataccgatgactgggcctttagtggcaggaggtctcctgaccgtctgctatgtgcttacgggcaggtctgccgacctggaattggagcgagcggctgatgtaaagtgggaggaccaggccgaaatcagtgggtccagccccattctctctatcacaattagcgaggatggatccatgtcaatcaaaaatgaagaggaggaacataccctgactatactaatccgcacaggcctgcttgtgattagtggtgtctttccagttagcatccccattaccgcagccgcttggtacctctgggaggtgaagaagcaacgggcaggggtgctgtgggacgtcccttctccaccccctgtgggaaaagccgaattggaggatggcgcgtatagaatcaagcagaggggcatattcgggtactcccagattggagctggtgtttataaagaaggcacttttcacacaatgtggcatgtaacccgtggggccgtgttaatgcaccgcggaaagcggatcgagccgtcatgggcagacgtcaaaaaggatctgatcagttacggcggtgggtggaagctcgagggagaatggaaagagggcgaagaggtgcaggttctggcccttgaaccaggcaagaaccccagagctgtgcaaacgaaacctgggctgttcaagactaataccggaacaattggtgccgtcagcttggacttttccccaggcacctctgggtcgcccatcgtggataggaaaggaaaggtagtcggcctatacggtaacggggtggttacacgaagcggagcatatgtgtcagctatagcccagactgagaagtccattgaggacaatcctgaaatcgaggatgacattttccggaaaaagcgcctgaccatcatggatctccatccgggcgcgggcaaaacgaagagatacctgcccgccatagtcagggaagcaattaaacgggggcttcgaacattaatcctggctccaactagagtggttgccgctgagatggaagaggcactccgcggattgcctatcaggtatcagacccccgccattcgtgccgagcacacaggtcgggaaatcgtggacctgatgtgtcacgctaccttcactatgagactcctgagtccagtcagggtgcctaactacaaccttattataatggacgaggcgcattttaccgatcccgcatctatcgccgctcgcggctatattagcacacgagtagaaatgggggaggccgcaggaatcttcatgacggccactccaccgggctccagagacccttttccccagtcaaatgctccaatcatggatgaggaacgggagattcccgaaaggtcttggaacagcggtcacgagtgggtgaccgacttcaaggggaagacagtttggtttgtccctagtataaaagcgggaaatgatatcgccgcatgcctgcgcaagaacggcaaaaaggtgattcaattgtcccgtaaaaccttcgacagcgaatacgtgaagactagagctaatgattgggactttgtcgtaacaaccgatatctctgagatgggcgccaacttccgggcagagagggtgattgacccacgccgatgtatgaagcccgttatcctaacggatggggaagagagagtgatactggccggacctatgccggtcactcattcatccgctgcccagcggaggggtcgcatcggcagaaatcccaaaaatgaaaatgaccagtatatttacatgggggagcccctcgaaaacgacgaggattgcgcgcactggaaggaggcaaaaatgttactggacaatatcaacacacctgaaggaattatccccagtatgtttgagccagaaagggagaaggtggatgccatagacggcgaataccggcttcgtggtgaggctcgcaaaaccttcgttgatctgatgcgaagaggggacctccctgtgtggttggcctatagggtcgctgcagagggcattaattacgccgatcggcgctggtgttttgacggaatcaagaacaatcaaattctggaagagaacgtggaagtagagatctggaccaaagagggcgaaagaaagaagctcaaacccaggtggctggatgctcggatatatagcgacccacttgccctaaaggagttcaaagagttcgcagcggggcgaaagtcgctgactttgaacttaatcacagagatgggaagactgcctaccctcatgacacagaaagcccgcgatgctctggacaatcttgccgtgctgcacactgcagaagttggtggcagggcttacaaccatgccctctctgagttgccggagacgctggaaaccctactgctccttacactgttagcaactgtcaccgggggaatatttttgttcctgatgtccggcaagggtatcgggaagatgacactcggcatgtgctgcattatcaccgccagcatactgctttggtatgctcagattcagccccactggatcgcggcctcaatcattctggagtttttcctcatcgtgttgctgataccagaacctgagaaacaacggactccccaggataatcagttaacgtacgtggtcattgcaatcctaaccgttgtggctgccacaatggccaacgaaatgggatttctggagaagactaaaaaggacctcggccttgggagtattaccacacaggagtctgaatccaatatcctggacatagatttgcgtccagcaagcgcttggaccctgtatgccgtagcgactacattcgtgacgcctatgctcagacattcaatcgagaacagtagcgtcaatgtgtccctgaccgctattgccaaccaagcaactgttcttatgggactcggtaggggctggcccctgtctaaaatggacatcggggtgccgttgctggccattggatgttacagccaggtcaatccaatcacattaaccgctgcactactgctccttgtagcccactacgcgattatcggccctggtctgcaggctaaggccacccgcgaagcacagaagcggacagccgctgggataatgaaaaaccccactgtggatggcattacggttatcgacttggagccaatcccctatgatcctaagtttgaaaaacaactgggacaggtgatgctcctggtcctttgcgtgacccaggtcttaatgatgcgaacaacttgggccctgtgtgaggcactcaccttggctacaggcccgatttccaccctgtgggaggggaatcccggaagattctggaacactacgatagccgtgtcaatggcgaatatctttaggggctcttacctagccggtgcagggctactcttcagtattatgaagaacacaaccaatactcgccggggaaccggcaacatcggtgaaacacttggcgagaaatggaagtcgagactgaatgctttgggaaagagcgaatttcagatttataaaaagtccggaatccaagaggttgaccgtactctggccaaagagggcataaagagaggggaaaccgatcatcacgcagtgtctcggggatcagctaaactccgctggttcgtagagcgaaacatggtgacaccagaaggcaaggtcgttgacctgggttgcgggagaggaggctggagctactattgtggtggccttaaaaacgtgagggaggtcaaggggctaacgaagggaggccctgggcacgaagaaccaatccctatgtccacctacggatggaatctggtgcggctccagagtggcgtagatgtgtttttcactccacccgagaaatgcgacacactactgtgtgatattggtgaatctagccctaacccaaccatcgaggccgggcgcactttgagagttctgaatctcgtggaaaactggcttaataacaatacacagttctgcgtcaaggtgctgaacccctatatgccgtcagtcattgagaaaatggaaaccttgcaaaggaagtacggaggcgccctggtgcgaaatcctctctcccggaacagtacgcatgagatgtactgggttagcaatgcgaccggcaacatcgtatcttccgtgaatatgatatcacgtatgttaattaacagatttacaatgaaacacaagaaggctacttatgagccagacgtcgatctggggagcggaacccgcaatatcggtatcgaaaacgagattcccaaccttgacataatcggcaaaaggattgaaaagatcaaacaggagcatgaaacatcgtggcactacgaccaggatcacccttataagacttgggcataccatgggtcttatgagaccaaacagacaggaagtgcctccagcatggtgaatggcgttgtgaagctgctaaccaagccatgggacgtcgtgcccatggtaactcaaatggctatgacggatacaaccccgttcggtcagcagcgggtgtttaaagagaaggttgacactagaacccaggaacctaaagaggggacaaagaaactcatgcgcattacggccgaatggctgtggaaggagttgggaaagaaaaagacccccaggatgtgtactcgagaggagttcacacggaaagtcagatcaaacgcagccctgggcgctatctttaccgatgagaataagtggaaatccgcgagggaagccgtggaggactctcgcttctgggaactcgtggatcgtgagcggaaccttcacctggagggcaagtgcgaaacttgtgtctacaatatgatggggaaaagagagaagaagttaggagaatttggtaaagcaaagggcagcagggctatatggtatatgtggctgggggcccgcttcttggagtttgaagcactcggattcctgaacgaggaccattggtttagtcgaggcaattccctaagcggtgttgagggggaaggacttcacaaactgggctacatcctccgggatgtgtctaagaaagagggcggggccatgtacgctgacgatacagccggatgggacaccagaattacactggaagacttgaagaacgaggaaatggtaactaatcatatgaagggtgagcacaaaaagctggcggaggcaatcttcaaactcacctatcaaaacaaggtggtcagggtgcagcgcccaacgcctagaggcaccgttatggatattatctcacggaaagaccagagggggagtggacaggtgggcacatacggtcttaatacttttaccaacatggaagcccaactgattcgtcagatggagggggaaggaatattcaagtccatccagcgattaacagtcactgaggagattgctgtgcaaaattggctggtacgcgttggcagagaacggttgagcaggatggccgtgtctggcgatgactgcgtcgtgaagcccctcgatgaccgcttcgcatcggctctgaccgccctaaacgatatggggaaagtgagaaaggacatccagcagtgggagccatcacggggatggaatgattggacgcaggtccccttttgcagccaccatttccacgaacttgttatgaaagacggtagggtgctggtagtgccttgtcgaaaccaagatgagctcatcggccgtgctagaatttcccagggggccggatggagtctgaaggaaacagcatgcttgggcaaatcttatgcgcagatgtggaccttaatgtactttcatcgccgggacctgaggctcgccgctaacgccatatgtagcgcagtcccatcccactgggtgccgacttcaagaacaacctggagtatccacgctaagcatgagtggatgactaccgaggatatgcttgccgtttggaatcgcgtgtggattcaggaaaacccctggatggaggacaagacacctgtcgaatcttgggaggaagtgccatatctgggtaaacgggaggaccaatggtgcgggagcctaatcggactgacgtccagggcaacctgggccaagaatattcagactgcgatcaaccaggtacgatcactcataggcaatgaggaatacacagattatatgcccagcatgaaaagattccggaaggaggaagaggaagctggcgttttgtggtga

SEQ ID NO: 14630 - RNA, 9876 nt, synthetic construct
  misc_feature 1..9876: note = derived and/or modified CDS sequence (opt3) from DENV-2__EU529693__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaaccatggccgcaatcttggcctacacgattggcactacacactttcagcgcgctctcatcttcattctgctgaccgcagttgccccatccatgactatgagatgcatcgggatatctaacagggattttgtggaaggagtctcgggtggctcatgggtggacattgtactcgagcacgggagctgtgttacaaccatggctaagaataagcccacgttagatttcgaactgatcaaaaccgaggccaagcagcctgcgacacttcggaaatattgcattgaagcaaagttgactaacaccacaactgagagtcgctgtccaacccaaggagagccctccctgaatgaagagcaggacaaacgatttatctgcaagcattctatggtggatagaggctggggtaacgggtgtggactattcggcaagggcgggatcgtcacatgcgccatgtttacctgcaaaaagaatatggaaggaaaagtggtgctccctgagaacctggaatacactattgtcataacgccacacagcggtgaggagcatgctgttggcaatgacacagggaagcacggaaaagaaatcaagattaccccgcagtcctcaatcactgaggccgaacttaccggctatggtacagtgaccatggagtgtagtcccaggactgggctggatttcaacgaaatggtattgctccagatggaggacaaagcatggctggtgcaccggcaatggtttttagatctgcctctcccatggcttcccggcgctgacacacagggaagcaattggatacagaaggagacgctggtcaccttcaagaaccctcatgccaaaaagcaggacgtggttgtgttgggctctcaagaaggggcgatgcacactgccctaacaggagcaaccgagattcagatgtcctcaggtaatctgctctttacaggccatctgaaatgccgtcttcgcatggataagctgcagttgaaagggatgagctacagtatgtgtactggaaagttcaagatcgtcaaagaaatcgctgagacccaacacggcacgattgtgatcagagtacagtatgagggtgacgggtctccatgcaagattcccttcgaaataatggatctcgagaaaaggcatgttctgggccggttaatcaccgtgaacccgattgtcacagaaaaggactcccctgtgaacatcgaggccgaacccccatttggagatagctacatcattataggcgtcgagcctgggcagctgaaactaaattggttcaagaagggatcgtctatcggtcagatgtttgagactaccatgcgaggcgctaaacgcatggccattctcggggacacagcatgggatttcggatccctgggcggtgtgtttacttcaatcgggaaggcccttcaccaagttttcggcgctatttacggagcggcatttagtggcgtgagctggaccatgaaaatcttgataggggtaatcattacgtggatcggaatgaactccagatctacaagcctgtcagtcagtctcgtgctggttggcattgtgaccctttatctgggtgtcatggtgcaggccgacactgggtgtgtagtgtcctggaagaataaagaattgaagtgcggaagcggcatcttcataacagataacgttcacacctggactgagcagtacaagtttcagcccgaatctccatcaaaactcgctagtgccattcaaaaggcacatgaggaaggtatctgtggcattaggagcgtcacccggctggagaatttaatgtggaaacagatcacacccgagctgaaccacatactatccgaaaatgaggtgaagctcacgatcatgaccggggacattaaaggaatcatgcaggccggcaagcgctctctgagacctcagccaactgaacttaaatattcgtggaagacatgggggaaggctaaaatgttgagcaccgagtcccataaccaaacattcctgattgatggaccggaaactgccgagtgccccaataccaacagggcatggaattcactcgaggtggaagactacggctttggtgtcttcagtacgaacatctggctgaagttacgtgagaaacaggacgttttttgtgattctaagctgatgagcgcggctataaaagacaatcgggccgtgcacgcagatatggggtattggattgaatccgcccttaacgacacatggaagatggagaaggcttcattcatcgagatcaaaagctgccactggcctaagtctcataccttgtggtccaatggagtgctcgaaagtgagatgattatcccaaaaaacttcgccggccccgtaagccagcacaactaccgacctggttatcatactcagaccgcaggcccatggcacctggggaagctagaaatggattttgacttctgtgagggaacaactgtcgtggttaccgaagattgcggcaatagagggccctctctgaggacaacgaccgcttccggaaaactcattactgagtggtgctgtcgctcatgcacactgccgcctcttcggtacagaggcgaggacggttgttggtacgggatggaaataaggccattgaaggagaaggaagagaacctggtgaatagtttagtcaccgccggacatggccaaatcgataactttagcctcggtgtgctgggcatggcgcttttcctggaagagatgttgcgcactcgagttgggacaaaacacgccattctcctggtggctgtatcgtttgtcaccctaatcacgggaaatatgtccttccgggacctgggccgtgtgatggtgatggtcggggcaactatgaccgatgacattggaatgggcgttacatatctcgccctgcttgctgcctttaaggtgagacccaccttcgcagcgggtttgctgttaaggaaactcacttctaaggagctgatgatggccacaatcgggatagctcttctgagccagtcaaccatccctgaaacaattctagagctcactgatgccctggcattgggaatgatggtactgaaaatcgtgcgcaacatggaaaagtaccagttagctgtcaccattatggccatcagttgcgtgcccaatgcagttatactccaaaacgcctggaaggtgtcctgtacgattctggctgcggtctctgtgagcccacttctgttgacatcctcacagcagaaagccgactggatccctctcgcactgaccatcaagggcctaaatcccactgctatttttctgaccacacttagccggactagtaaaaagagatcttggccactcaacgaggccgttatggccgtgggcatggtctccatactggctagctcgttgctgaaaaatgacatcccgatgaccgggcctttagtagcaggaggtctcctgacggtgtgctatgttcttacaggcaggtcagccgatctggaattggagcgagcggctgacgtgaagtgggaggatcaggccgaaatttctgggagttcccccatcctcagcattaccatctctgaggacggaagcatgtccataaaaaacgaagaggaggaacacactctgacaatcctaattcgcaccggcctgcttgtcatctcaggtgtgttcccagtaagtattcccatcactgcagccgcttggtacctctgggaggtgaagaagcaacgggcaggggtcctgtgggatgttcctagcccaccccctgtgggaaaagccgaattggaggacggcgcgtatagaataaagcagaggggcatttttgggtactctcagatcggagctggtgtgtataaagaaggcacattccataccatgtggcacgtcacgcgtggggccgtgttaatgcatcgcggaaagcggatcgagccgtcctgggcagatgttaaaaaggacctgatttcatacggcggtgggtggaagctcgagggagaatggaaagagggcgaagaggtacaggtgctggcccttgaaccaggcaagaatcccagagctgtccaaactaaacctgggctgtttaagaccaacacaggaaccatcggtgccgtgagtttggatttcagcccaggcacatccgggtctcccatagttgacaggaaaggaaaggtggtcggcctatacggtaatggggtggtaactcgatcgggagcatatgtcagcgctattgcccagaccgagaagtcaatcgaggataaccctgaaattgaggacgatatcttccggaaaaagcgcctgacgataatggacctccacccgggcgcgggcaaaacaaagagatacctgcccgccattgtgagggaagcaatcaaacgggggcttcgaactttaatcctggctccaaccagagttgtggccgctgagatggaagaggcactccgcggattgcctattaggtatcagacacccgccatccgtgccgagcataccggtcgggaaattgtcgacctgatgtgtcacgctacttttaccatgagactcctgtccccagtgagggttcctaactacaatcttataatcatggatgaggcgcacttcacagaccccgcaagtattgccgctcgcggctatatctctacgcgagtggaaatgggggaggccgcaggaatctttatgactgccaccccaccgggcagcagagatcctttcccccagtccaacgctccaattatggacgaggaacgggagatacccgaaaggtcatggaattctggtcatgagtgggtcacagattttaaggggaagaccgtgtggttcgtacctagcatcaaagcgggaaacgacattgccgcatgcctgcgcaagaatggcaaaaaggtgatccaattgagtcgtaaaacttttgattccgaatacgttaagacaagagctaacgactgggatttcgtcgtgaccacggacattagcgagatgggcgccaattttcgggcagagagggtgatcgatccacgccgatgtatgaagcccgtcatactaactgacggggaagagagagtaatcctggccggacctatgccggtgacacactcttcagctgcccagcggaggggtcgcattggcagaaacccaaaaaatgaaaacgaccagtatatctacatgggggagcccctcgaaaatgatgaggactgcgcgcattggaaggaggcaaaaatgttactggataacattaatacccctgaaggaatcataccctccatgttcgagccagaaagggagaaggttgacgccattgatggcgaataccggcttcgtggtgaggctcgcaaaacctttgtggacctgatgcgaagaggggatctccctgtctggttggcctatagggtggctgcagagggcatcaactacgccgaccggcgctggtgtttcgatggaattaagaataaccaaatcctggaagagaacgttgaagtggagatatggactaaagagggcgaaagaaagaagctcaaacccaggtggctggacgctcggatctatagtgatccacttgccctaaaggagttcaaagaatttgcagcggggcgaaagagcctgacattgaatttaattaccgagatgggaagactgcctacattcatgactcagaaagcccgcgacgctctcgataacctggccgtccttcacacggcagaagtgggtggcagggcttacaatcacgccctgtcggagctcccggagaccttggaaacactgctactgctcactcttctggcaaccgtaacagggggaatctttttattcttgatgtctggcaagggtattgggaagatgaccctgggcatgtgctgcatcataactgcctccattctcctgtggtatgctcagatccagccccattggatcgcggccagcattatccttgagtttttcctgatagtgctcttgattccagaacctgagaaacaacggacgccccaggacaaccagctgacctacgttgtcatcgcaattttaacagtggtggctgccactatggccaatgaaatgggatttctagagaagaccaaaaaggacctgggcctcgggtcaatcacaacccaggagagtgaatctaacatacttgatatcgacctgcgtccagcatccgcttggactttgtatgccgtcgcgacaacgttcgttacccctatgctgagacacagcattgagaattcaagtgtgaacgtaagcctcactgctatcgccaatcaagcaacagtgctgatgggacttggtaggggctggcccctctccaaaatggatattggggtcccgctgttggccatcggatgttactctcaggtgaacccaattaccctgaccgctgcattactactgctcgttgcccattacgcgatcataggccctggtcttcaggctaaggccacacgcgaagcacagaagcggactgccgctgggattatgaaaaatcccacggtggacggcatcaccgtcatcgatctggagccaattccctatgaccctaagtttgaaaaacaattgggacaggtaatgctgctcgtgctgtgcgttacacaggtgcttatgatgcgaactacctgggccttatgtgaggcactgacactcgctaccggcccgataagcactttgtgggaggggaaccccggaagattctggaatacgacaatcgccgtctccatggcgaacatttttaggggctcatacctggccggtgcagggctactgttctctatcatgaagaataccactaacacccgccggggaacaggcaatattggtgaaactctcggcgagaaatggaagagtagacttaacgctctggggaagtcggaatttcagatctataaaaagagcggaatacaagaggtggatcgtaccttggccaaagagggcatcaagaggggggaaacagaccaccatgcagtctcccggggatctgctaaactgcgctggttcgtggagcgaaacatggttacgccagaaggcaaggtggtagatctcggttgcgggagaggaggctggtcatactattgtggtggcctgaaaaatgtgagggaggtcaaggggttaaccaagggaggccctgggcacgaagagcccattcctatgagcacttacggatggaaccttgttcggctgcagtccggcgtggacgtcttctttacaccacccgagaaatgcgataccctcctatgtgacatcggtgaaagttctcctaatccaactattgaggccgggcgcacactgagagtgttgaacctggtagaaaattggctcaacaataacacccagttctgcgtgaaggttcttaatccctatatgccgagcgtgatcgagaaaatggaaacgctgcaaaggaagtacggaggcgccttggtccgaaaccctctgtcacggaattccacccacgagatgtactgggtgagtaacgcgacaggcaatatagtcagctctgtgaacatgatttcccgtatgctcatcaatagatttactatgaaacataagaaggctacctatgagccagatgttgacttagggtcaggaacacgcaacatcggtattgaaaacgagatacccaatctggacatcattggcaaaaggatcgaaaagattaaacaggagcacgaaactagctggcattacgatcaggaccacccttataagacctgggcataccacgggtcgtatgagacaaaacagaccggatctgccagttccatggtaaacggcgtggtcaagcttctgactaagccatgggatgtggttcccatggtgacgcaaatggctatgacagacaccactccgttcggtcagcagcgggtctttaaagagaaggtggataccagaacacaggaacctaaagaggggacgaagaaactaatgcgcatcaccgccgaatggctctggaaggagctgggaaagaaaaagactcccaggatgtgtacacgagaggaattcacccggaaagtaagaagcaatgcagccttgggcgctatatttactgacgagaacaagtggaaatcagcgagggaagccgtggaggattcccgcttctgggaactggttgaccgtgagcggaatctccatcttgagggcaagtgcgaaacatgtgtctacaacatgatggggaaaagagagaagaagctgggagaatttggtaaagcaaagggctctagggctatctggtatatgtggttaggggcccgcttcctggagtttgaagcattgggattcctcaatgaggatcactggtttagccgaggcaacagtctgtccggtgtggagggggaaggactacataaacttggctacattctgcgggacgtgagcaagaaagagggcggggccatgtacgctgatgacaccgccggatgggacacaagaatcactctcgaagatctgaagaatgaggaaatggtcaccaaccacatgaagggtgagcataaaaagttggcggaggcaattttcaaactgacgtatcaaaataaggttgtgagggtacagcgcccaacccctagaggcacagtgatggacatcatttctcggaaagatcagagggggtcaggacaggtcggcacttacggtctcaacaccttcacaaatatggaagcccaacttatacgtcagatggagggggaaggaatctttaagagtattcagcgactgactgtgaccgaggagatcgctgttcaaaactggttagcccgcgtgggcagagaacggctgtccaggatggcaatcagcggcgacgattgcgtcgtgaagcccttggacgatcgcttcgcttctgccctcacggctctgaatgacatggggaaagtaagaaaggatattcagcagtgggagccatcgcggggatggaacgactggacacaggttcccttttgctcacaccacttccatgaactagtgatgaaagatggtaggatgcttgtcgtgccttgtcgaaaccaagacgagctgataggccgtgccagaatcagccagggggcaggatggtccctcaaggaaaccgcgtgcctgggcaaaagttatgcccagatgtggactttgatgtactttcaccgccgggatttaaggctggctgccaatgcaatttgttctgctgtgccaagccattgggtcccgacatccagaaccacttggtcaatccacgccaagcacgagtggatgaccacagaggacatgctcgcagtttggaaccgcgtgtggattcaggaaaatccctggatggaggacaagacgcctgtagaaagttgggaggaagtgccatatcttggtaaacgggaggatcaatggtgcgggtctctgatcggactaaccagcagggccacttgggcgaagaacatacagacagctatcaatcaggtccgatccctgattggcaacgaggaatacaccgactatatgccctcaatgaaaagattccggaaggaggaagaggaagccggcgtgctctggtga

SEQ ID NO: 14631 - RNA, 9876 nt, synthetic construct
  misc_feature 1..9876: note = derived and/or modified CDS sequence (opt3) from DENV-2__EU482557__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgaggtaaaatcttgccactggcctaagtcccatacgttgtggagtaatggagtcctcgaaagcgagatgatcattccaaaaaacttcgccggccccgtgtctcagcacaactaccgacctggttatcatacacagaccgcaggcccatggcacctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtacgggatggaaattaggccattgaaggagaaggaagagaacctggtgaatagcttagttactgccggacatggccaaatagataacttttcgctcggtgtgctgggcatggcgcttttcctggaagagatgttgcgcacacgagtagggaccaaacacgccatcctcctggtcgctgtgtcctttgtgactctaattacaggaaatatgtctttccgggacctgggccgtgtcatggttatggtgggggcaaccatgacggatgacatcggaatgggcgtaacttatctcgccctgcttgctgcctttaaggtgagacccaccttcgcagcgggtttgctgttaaggaaactcacaagcaaggagctgatgatggccaccattgggatcgctcttctgtcacagagtactatacctgaaacaatcctagagctcaccgatgccctggcattgggaatgatggtcctgaaaattgtgcgcaacatggaaaagtaccagttagctgttacaatcatggccatttcctgcgtgcccaatgcagtcatcctccaaaacgcctggaaggtgtcttgtactatactggctgcggttagcgtgtccccacttctgttgacctcaagccagcagaaagccgactggattcctctcgcactgacgatcaagggcctaaatcccacagctatctttctgaccactcttagtcggacctctaaaaagagatcctggccactcaacgaggccgtcatggccgtaggcatggtgagcattctggcttcgtcattgctgaaaaatgacataccgatgacagggcctttagttgcaggaggtctcctgactgtgtgctatgtccttaccggcaggtctgccgatctggaattggagcgagcggctgacgtgaagtgggaggatcaggccgaaatcagtgggtccagccccattctctctatcacgattagcgaggacggatccatgtcaatcaaaaacgaagaggaggaacacacactgaccatactaatccgcactggcctgcttgtaattagtggtgtgttcccagtcagcatccccattacagcagccgcttggtacctctgggaggttaagaagcaacgggcaggggtgctgtgggatgtgccttctccaccccctgtcggaaaagccgaattggaggacggcgcgtatagaatcaagcagaggggcatatttgggtactcccagattggagctggtgtgtataaagaaggcaccttccatactatgtggcacgttacacgtggggccgtattaatgcatcgcggaaagcggatcgagccgtcatgggcagatgtgaaaaaggacctgatcagttacggcggtgggtggaagctcgagggagaatggaaagagggcgaagaggtccaggtgctggcccttgaaccaggcaagaatcccagagctgttcaaaccaaacctgggctgtttaagacgaacactggaaccattggtgccgtgagcttggatttctccccaggcacatctgggtcgcccatcgtcgacaggaaaggaaaggtggtaggcctatacggtaatggggtcgtgacccgaagcggagcatatgtttcagctatagcccagacagagaagtccattgaggataaccctgaaatcgaggacgatattttccggaaaaagcgcctgactatcatggacctccacccgggcgcgggcaaaaccaagagatacctgcccgccatagtgagggaagcaattaaacgggggcttcgaacgttaatcctggctccaacaagagtcgtggccgctgagatggaagaggcactccgcggattgcctatcaggtatcagactcccgccattcgtgccgagcataccggtcgggaaatcgttgacctgatgtgtcacgctacatttaccatgagactcctgagtccagtgagggtccctaactacaatcttattataatggatgaggcgcacttcactgaccccgcatctatcgccgctcgcggctatattagcacccgagtggaaatgggggaggccgcaggaatctttatgacagccacgccaccgggctccagagatcctttcccccagtcaaacgctccaatcatggacgaggaacgggagattcccgaaaggtcttggaatagcggtcatgagtgggtaactgattttaaggggaagaccgtgtggttcgttcctagtataaaagcgggaaacgacatcgccgcatgcctgcgcaagaatggcaaaaaggtcattcaattgtcccgtaaaacatttgatagcgaatacgtgaagaccagagctaacgactgggatttcgtggtcactacagacatctctgagatgggcgccaattttcgggcagagagggtaattgatccacgccgatgtatgaagcccgtgatcctaaccgacggggaagagagagttatactggccggacctatgccggtgacgcactcatccgctgcccagcggaggggtcgcatcggcagaaacccaaaaaatgaaaacgaccagtatatttacatgggggagcccctcgaaaatgatgaggactgcgcgcattggaaggaggcaaaaatgttactggataacatcaatactcctgaaggaattatccccagtatgttcgagccagaaagggagaaggtcgacgccatagatggcgaataccggcttcgtggtgaggctcgcaaaacatttgtggacctgatgcgaagaggggatctccctgtttggttggcctatagggtggctgcagagggcattaactacgccgaccggcgctggtgtttcgatggaatcaagaataaccaaattctggaagagaacgtcgaagtggagatctggaccaaagagggcgaaagaaagaagctcaaacccaggtggctggacgctcggatatatagcgatccacttgccctaaaggagttcaaagaatttgcagcggggcgaaagtcgctgaccttgaatttaatcactgagatgggaagactgcctacattcatgacccagaaagcccgcgacgctctcgataacctggccgtacttcacacagcagaagtgggtggcagggcttacaatcacgccctgtctgagctcccggagactttggaaacgctgctactgctcacccttctggcaacagttactgggggaatttttttattcttgatgtccggcaagggtatcgggaagatgaccctgggcatgtgctgcattatcacagccagcatactcctgtggtatgctcagattcagccccattggatcgcggcctcaatcattcttgagtttttcctgatcgtcctcttgataccagaacctgagaaacaacggaccccccaggacaaccagctgacttacgtggtgattgcaatcttaacggtcgttgctgccaccatggccaatgaaatgggatttctagagaagacaaaaaaggacctgggcctcgggagtattactacccaggagtctgaatccaacatccttgatatagacctgcgtccagcaagcgcttggacattgtatgccgtggcgaccactttcgtaacacctatgctgagacactcaatcgagaatagtagcgtgaacgtctccctcacggctattgccaatcaagcaaccgtgctgatgggacttggtaggggctggcccctctctaaaatggatatcggggttccgctgttggccattggatgttacagccaggtgaacccaatcactctgacagctgcattactactgctcgtcgcccattacgcgattatcggccctggtcttcaggctaaggccacccgcgaagcacagaagcggaccgccgctgggataatgaaaaatcccacagtagacggcattactgtgatcgatctggagccaatcccctatgaccctaagtttgaaaaacaattgggacaggttatgctgctcgtgctgtgcgtcacgcaggtgcttatgatgcgaaccacatgggccttatgtgaggcactgactctcgctaccggcccgatttccacattgtgggaggggaaccccggaagattctggaataccactatagccgtctcaatggcgaacatctttaggggctcttacctggccggtgcagggctactgttcagtattatgaagaatacgacaaacacccgccggggaactggcaatatcggtgaaaccctcggcgagaaatggaagtcgagacttaacgctctggggaagagcgaatttcagatttataaaaagtccggaatccaagaggtggatcgtacattggccaaagagggcataaagaggggggaaactgaccaccatgcagtttctcggggatcagctaaactgcgctggttcgtggagcgaaacatggtaaccccagaaggcaaggtggtcgatctcggttgcgggagaggaggctggagctactattgtggtggcctgaaaaatgttagggaggtgaaggggttaacaaagggaggccctgggcacgaagagcccatccctatgtccacgtacggatggaaccttgtccggctgcagagtggcgtggacgtattctttaccccacccgagaaatgcgatactctcctatgtgacattggtgaatctagccctaatccaacaatcgaggccgggcgcaccctgagagtgttgaacctggttgaaaattggctcaacaataacactcagttctgcattaaggtgcttaatccctatatgccgtcagtcatcgagaaaatggaaacactgcaaaggaagtacggaggcgccttggtgcgaaaccctctgtcccggaatagtacccacgagatgtactgggtcagcaacgcgacgggcaatatagtgtcttccgttaacatgatttcacgtatgctcatcaatagatttaccatgaaacataagaaggctacatatgagccagatgtagacttagggagcggaactcgcaacatcggtattgaaaacgagatacccaatctggacatcattggcaaaaggatcgaaaagattaaacaggagcacgaaacctcgtggcattacgatcaggaccacccttataagacatgggcataccacgggtcttatgagactaaacagaccggaagtgcctccagcatggtgaacggcgtcgtgaagcttctgacaaagccatgggatgttgtgcccatggtcacccaaatggctatgactgacacgacaccgttcggtcagcagcgggtgtttaaagagaaggtagataccagaactcaggaacctaaagaggggaccaagaaactaatgcgcatcacagccgaatggctctggaaggagctgggaaagaaaaagacgcccaggatgtgtacccgagaggaattcactcggaaagtgagatcaaatgcagccttgggcgctatatttacagacgagaacaagtggaaatccgcgagggaagccgttgaggattctcgcttctgggaactggtcgaccgtgagcggaatctccatcttgagggcaagtgcgaaacctgtgtgtacaacatgatggggaaaagagagaagaagctgggagaatttggtaaagcaaagggcagcagggctatctggtatatgtggttaggggcccgcttcctggagtttgaagcattgggattcctcaatgaggatcactggtttagtcgaggcaactccctgagcggtgtggagggggaaggactacataaacttggctacattctgcgggacgtctctaagaaagagggcggggccatgtacgctgatgacactgccggatgggacacaagaatcaccctcgaagatctgaagaatgaggaaatggttacaaaccacatgaagggtgagcataaaaagttggcggaggcaattttcaaactgacttatcaaaataaggtggtaagggtgcagcgcccaacccctagaggcacggtcatggacatcatttcacggaaagatcagagggggagtggacaggtgggcacctacggtctcaacacattcactaatatggaagcccaacttatacgtcagatggagggggaaggaatctttaagtccattcagcgactgaccgttacagaggagatcgctgtgcaaaactggttagcccgcgtcggcagagaacggctgagcaggatggcaatctctggcgacgattgcgtggtaaagcccttggacgatcgcttcgcttcggccctcactgctctgaatgacatggggaaagttagaaaggatattcagcagtgggagccatcacggggatggaacgactggacccaggtgcccttttgcagccaccacttccatgaactagtcatgaaagatggtagggtgcttgtggtcccttgtcgaaaccaagacgagctgataggccgtgccagaatctcccagggggcaggatggagtctcaaggaaacggcgtgcctgggcaaatcttatgcccagatgtggacattgatgtactttcaccgccgggatttaaggctggctgccaatgcaatttgtagcgctgttccatcccattgggtgccgacctcaagaactacatggagtatccacgccaagcacgagtggatgaccactgaggacatgctcgcagtatggaaccgcgtgtggattcaggaaaatccctggatggaggacaagacccctgtcgaatcttgggaggaagtgccatatcttggtaaacgggaggatcaatggtgcgggagcctgatcggactaacatccagggccacgtgggcgaagaacatacagaccgctatcaatcaggttcgatcactgattggcaacgaggaatacactgactatatgcccagcatgaaaagattccggaaggaggaagaggaagccggcgtgctctggtga

SEQ ID NO: 14632 - RNA, 9876 nt, synthetic construct
  misc_feature 1..9876: note = derived and/or modified CDS sequence (opt3) from DENV-2__EU482560__SS-prME
  source 1..9876: mol_type = other RNA
accgccggcgtgatcgtaatgctgattcccacagttatggctttccacctcactacgcggaacggggaacctcatatgatagtgggaaggcaggaaaagggtaaaagccttctgtttaagaccgaagacggcatcaatatgtgcacattgatggcaattgatttaggggaactgtgtgaagacactatcacctacaaatgcccactactcaagcaaaacgaaccggaggatattgactgttggtgcaattccacatctacctgggtgacttatggaacatgtaccacgactggcgagcaccggcgcgaaaaacgatcagtggccctggtcccccatgtgggtatggggcttgagacccgtacagaaacttggatgagtagcgagggagcgtggaagcacgttcagagaatcgagacctggatactgaggcatcctggcttcacaatcatggctgccattttggcatacaccatcggcacgactcactttcagcgggccctcattttcatcctgctgacagctgtggcaccatccatgaccatgcgctgcatagggatttctaacagagattttgtcgaaggagtgtcgggtggctcatgggtagacatcgttctcgagcacgggagctgtgtgactacaatggccaagaataaacccaccttagatttcgaactgattaagacggaggctaaacagcctgccacccttaggaagtattgcatcgaagcgaaattgacaaacactaccacagagagtcggtgtccaactcaaggagagccctccctgaatgaagaacaggacaagcgctttatctgcaagcattctatggtcgatcgaggctggggtaacgggtgtggactattcggcaaaggcgggattgtgacctgcgcaatgtttacatgcaagaaaaatatggaaggaaaggtggtccagcctgagaacctcgaatacaccatagttatcactccacacagcggtgaggagcatgccgtgggcaatgacacggggaaacacggaaaggaaattaaaatcacaccgcagtcctcaataaccgaggctgaactgactggctatggtaccgtaacaatggagtgtagtcccagaaccgggcttgatttcaacgaaatggtgctgttgcaaatggaggacaaggcctggctcgtccacaggcagtggtttctggatttacctctgccatggctccccggcgcagacactcagggaagcaattggattcagaaggagacacttgtgacgttcaaaaaccctcatgctaagaaacaagacgttgtggtcctgggctctcaggaaggggccatgcacaccgcgttgactggagccacagagatccagatgtcctcaggtaatctactgtttaccggccatctcaagtgccggctgcgtatggataaacttcaactgaaggggatgagctacagtatgtgtacaggaaagttcaaaatcgtgaaggaaattgcagagactcagcacggcaccatcgtaattcgcgttcagtatgagggtgacgggtctccatgcaaaatacccttcgaaatcacggatttggagaagagacatgtgctcggcaggctgattaccgtcaacccgatcgtgacagaaaaagactcccctgtcaacatcgaggctgaacccccatttggagatagctacattataatcggcgtggagcctgggcagttaaagctgaattggttcaagaaaggatcgtctattggtcaaatgtttgagactaccatgcggggcgccaagcgaatggctatcctaggggacacagcctgggatttcggatccctcggcggtgtttttacttcaattgggaaagcactgcaccaggtgttcggcgccatctacggagctgcgtttagtggcgtaagctggaccatgaagatacttatcggggtcattatcacgtggattggaatgaactcccgctctactagcttgtcagtgagtctggttctcgtgggcgtcgtgaccctgtatcttggtgcaatggtacaggccgactccgggtgtgtggttagctggaaaaataaggaactgaagtgcggatctggcatcttcataactgataacgtccacacatggaccgagcagtacaaatttcaacccgaatcaccaagtaagttggctagcgccattcagaaagcacatgaggaaggtatctgtggcattagatccgtgactaggctcgagaatctgatgtggaagcagatcacccccgagttaaaccacatactgtctgaaaatgaggtgaaactaacaatcatgacgggggacattaagggaatcatgcaggccggcaaacggtcgctccgccctcaaccaaccgaactgaagtatagctggaagacttgggggaaagctaagatgctttccacagagtcacataaccagaccttcttgattgatggaccggaaacagccgagtgccccaatactaacagagcatggaatagtctggaggtcgaagactacggctttggtgttttcaccacgaacatctggctcaaactgagggagaagcaggacgcgttttgtgattctaaattaatgagcgctgccataaaggacaatcgtgcagtgcacgccgatatggggtattggattgaatccgctctgaacgacacatggaagatggagaaagcctcattcatcgaggtaaagagctgccactggcctaaatctcataccctttggtccaatggagtattggaaagtgagatgatcattccaaagaacttcgcaggccccgtcagccagcacaaccatcggcctggttaccacactcaaaccgctggcccatggcatctcgggaaactggaaatggattttgacttctgtgagggaacaactgtggttgtgaccgaagattgcggcaatcgagggccctctctaagaacaacgaccgcctccggaaagctgatcactgagtggtgctgtaggtcatgcacactcccgcctctgcgctatcggggcgaggacggttgttggtacgggatggaaattagaccacttaaggagaaagaagagaacttggtcaatagtctggtgaccgcgggacacggccagatagataactttagcttaggtgttctcggcatggccctgttccttgaagagatgctgaggactcgcgtggggacaaagcacgctatcttgctcgtagcagtctcgctggtgaccctaattacgggaaatatgtcctttcgagacctgggccgggtgatggtcatggttggggccactatgaccgatgacatcggaatgggcgtgacatacctcgctctgcttgccgcattcaaagtacgtcccacctttgcggccggtttgctgttaagaaagctcacttctaaagagctgatgatggctacaattgggatcgcccttctgagccagtcaaccatacctgaaacaatcctagagctcactgatgcactggctttgggaatgatggtgctgaagattgtcaggaacatggaaaagtatcaattagccgtgaccatcatggcaattagttgcgttcccaatgccgtgatcctccagaacgcttggaaagtctcctgtacgatactggcggccgtgtctgttagcccacttctgttgacatcctcacagcagaaggcagactggattcctctcgctctgaccatcaaaggcctaaatcccactgccatcttcctgaccacacttagccgcacaagtaagaaacggtcttggccactcaacgaggccattatggctgtgggcatggtctccatactggcaagctcgttgctgaagaatgacatcccgatgaccgggcctttagtagccggaggtctcctgacggtgtgctacgttcttacaggcagatcagcggatctggaattggagagggctgccgacgtgaaatgggaggatcaagcagaaatttctgggagttcccccatcctcagcattaccatctctgaggacggaagcatgtccataaagaacgaagaggaggaacagactctgacaatcctaattcgaaccggcctgcttgtcatctcaggtgtgtttccagtaagtattcccatcactgccgctgcatggtatctctgggaggtgaagaaacagcgcgccggggtcctgtgggatgttcctagcccaccccctgtggaaaaggcggagttggaagacggagcttaccggataaaacagagaggcttcttaggctattctcaaattggggccggagtgtacaaggagggtacatttcataccatgtggcacgtcacgaggggcgcagtgctgatgcatcgtgggaaacgcatcgagccgtcctgggccgatgttaagaaggacctcatctcatatggaggcggttggaaactggaaggggagtggaaggaaggagaggaagtacaggtgcttgctctggagccaggcaaaaatccccgggccgtccagactaagcctggcattttcaaaaccaacacagggaccatcggagcagtgagtttggattttagcccaggtacatccggctctcccatagttgacagaaaggggaaggtggtcggactatacggcaatggtgtggtaactaggtcgggggcttacgtcagcgccattgcgcagaccgagaaatcaatcgaaaacaaccctgagattgaagatgacatcttccgaaagaaacggctgacgataatggatctccacccgggagccggcaagacaaaacgctatctgcccgcaattgtgagagaggctatcaagaggggccttcggactttaatcctggccccaacccgagttgtggctgcagaaatggaggaggccctcagagggttgcctattcgctaccaaacacccgccatcagggctgaacataccggacgtgagattgtcgacctgatgtgtcacgcgactttcaccatgcggctcctgtccccagtgagagttcctaattataaccttataatcatggacgaagcacactttacagatcccgccagtattgctgccaggggttacatctctacgcgcgtggagatgggcgaggcagccgggatcttcatgactgctaccccaccgggaagccgagacccttttccccagtccaatgcgccaattatggatgaagagagagaaatacccgagcggtcatggaactctggccatgaatgggtcacagacttcaagggtaaaaccgtgtggtttgtacctagcatcaaggccgggaatgatattgcagcttgcctgaggaaaaacggaaagaaagtgatccagttgagtcgcaagactttcgactccgagtatgttaagacacgtgccaatgattgggactttgtcgtgaccacggatattagcgagatgggcgcaaacttcaaagccgaaagagtgatcgacccacggaggtgtatgaagcccgtcatactaactgatggcgaggaacgcgtaatcctggctgggcctatgccggtgacacactcttcagccgcgcaacgaagaggacggattggtaggaatcccaaaaacgagaatgaccagtacatctatatgggcgaacccctcgagaacgacgaggattgcgcacattggaaggaagccaaaatgttactggacaatattaacacccctgaggggatcataccctccatgtttgaaccagagcgcgaaaaggttgatgctattgacggagagtacagacttaggggcgaggcccggaaaaccttcgtggatctgatgcgtcgcggtgacctccctgtctggttggcttacaaggtggcagccgaagggatcaattatgctgatcgaaagtggtgttttgacggcattaaaaacaaccagatcctggaggaaaatgttgaggtggagatatggactaaggaaggagagaggaaaaagctcaaacccagatggctggatgcccggatctacagtgacccacttgcactaaaggagttcaaggagttcgcggccggccgcaaaagcctgacattgaacttaattaccgaaatggggagactgcctacatttatgactcagaaggctaggaatgccctcgataacctggcagtccttcacacggctgaggccggaggtcgggcatataatcacgccctgtcggagctcccggaaaccttggagacactgctactgctcactcttctggctaccgtgacaggcgggatcttcttatttttgatgtctggaaaaggcattggtaagatgaccctggggatgtgctgcatcataactgcgtccattctcctgtggtacgcccaaatccagccccattggatcgcagctagcattatccttgagttctttctgatagtactcttgattccagagcctgaaaaacagcgaacgccccaggacaaccaactgacctatgtggttatcgccattttaacagtcgtggccgcaactatggctaatgagatgggcttcctagagaagaccaagaaagatctgggactcggctcaatcacaacccaggaaagtgagtctaacatacttgacatcgacctgagaccagcctccgcgtggactttgtacgctgtggccacaacgtttgtcacccctatgctgcgccacagcattgaaaattcaagtgttaacgtgagcctcactgcaatcgccaatcaggctacagtactgatggggcttggaaagggttggcccctctccaaaatggatattggcgtgccgctgttggcaatcgggtgttattctcaggtcaacccaattaccctgaccgccgcgttactactgctcgtggctcattacgccatcataggacctggccttcaagcaaaggccacaagggaggctcagaaacgggccgcagctggtattatgaagaatcccactgttgacgggatcacggtgatcgatctggaaccaattccctacgaccctaagttcgagaaacagttgggccaggtcatgctgctcatactgtgcgtaacccaagtgcttatgatgcgtacaacttgggccttatgtgaggcgctgaccctcgccacaggaccgatcagcaccttgtgggaaggcaaccccgggagattttggaatactacgattgcagtttccatggctaacatcttcaggggatcatatctggccggcgcaggtctactgttttctattatgaagaatacaaccaacactcgccgggggaccggaaacatcggcgagacactcggtgaaaaatggaagagtcgacttaatgctctgggcaaatcggagttccagatatacaagaaaagcgggatccaggaggtggatagaactttggccaaggaaggaattaagaggggcgagaccgaccaccatgccgtctcccgcgggtctgcgaaactgcggtggtttgtggaaagaaacatggtcacaccagagggaaaggtggttgatctcggctgcggtcgtgggggatggtcatattactgtggcggtctgaaaaatgtgagggaagtaaagggcttaacgaaagggggacctggccacgaggagcccatccctatgagcacctatgggtggaaccttgtgcggctgcaatccggagtcgacgttttcttcactccacccgaaaagtgcgatacactcctatgtgacattggcgagagttctcctaatccaaccatcgaagctggtcgcactctgcgagtgttgaacctggtcgagaattggctcaacaataacacacagttttgcataaaggtgcttaatccctacatgccgagcgtaattgagaaaatggagaccctgcagagaaagtatgggggagcattggtgaggaaccctctgtcaagaaattccacgcacgagatgtactgggttagtaacgccaccggcaatatcgtgagctctgtcaacatgatctcccgcatgctcattaacagattcacaatgaaacataagaaagctacttacgaaccagatgtggacttaggctcagggaccaggaatataggaatcgagagcgaaattcccaacctggatatcattggtaagcgaatcgagaagataaaacaggaacacgagacatcgtggcattatgaccaagaccacccttacaagacttgggcctatcacggctcttacgagaccaaacagacagggagtgcatccagcatggtcaatggagtggttcggcttctgaccaagccatgggatgtagtgcccatggtcactcagatggccatgacggacacaaccccgtttggccagcaacgtgtgttcaaagaaaaggttgatactagaacccaggagcctaaggaaggtaccaaaaagctaatgaaaatcacggctgagtggctctggaaggagctggggaaaaagaaaacaccacgcgtgtgtactagggaagagtttacacggaaggtcagatcaaacgcggccttgggagcaattttcaccgacgaaaataagtggaaatccgctcgcgaggccgtggaagatggcaggttttgggagctggtagaccgagagcggaacctccatcttgaaggcaagtgcgagacttgtgtgtataatatgatggggaaaagagaaaagaaactgggagagttcggtaaggcaaagggctctagggccatctggtacatgtggttaggggctcgctttctggagttcgaggccttgggatttctcaacgaggatcactggttcagccgtggcaatagtctgtccggtgttgaaggggagggactacatcggcttggctatattctgagagacgtcggcaaaaaggaagggggagcgatgtacgcagatgacacagccggttgggataccaggatcacactcgaggacctgaaaaacgaagagatggtgactaatcacatgaagggcgagcataaaaagttggctgaagccatttttaagctgacctaccagaacaaagtggtccgcgttcagcgaccaacgcctcgggggaccgtgatggacataatcagcagaagggatcaacgcggatctggccaggtaggtacatatgggctcaatactttcaccaacatggaggcacagcttattagacaaatggaaggagagggcatcttcaagtcaatccagcacctgacagctactgaggaaattgccgtgcagaattggttagctcgggtcggcagggagcgtctgagtcgaatggccatatccggggacgattgcgtggttaaacccatcgacgatcgctttgcaagcgcgttgaccgccctcaacgacatgggaaaggtgagaaaagatattcagcaatgggaaccatctcggggttggaacgactggacgcaggtccccttctgctcgcaccattttcacgagctggtgatgaaggatggcagggtcctagttgtgccttgtcgcaatcaggacgaacttatcgggagagctcggatttcacagggagccggctggagcctgaaggagacagcatgcctcggtaaatcctacgctcaaatgtggaccctgatgtatttccataggcgagatttgcgtttagccgcaaacgccatctgtagtgcggtcccatctcactgggtgccgactagcagaacaacctggtccatacacgctaagcatgagtggatgactaccgaagacatgctggccgtgtggaatcgcgtctggatccaggagaacccctggatggaagataaaacacctgttgagtcatgggaagaggtgccatacctcgggaagcgggaggaccagtggtgcggaagtcttattggcctgacgtctagggcaacctgggccaaaaatatccagactgctattagccaagtaagatccctaatcggcaacgaagagtatacagactacatgccctcaatgaagcgctttcggagggaagaggaagaggccggggtgctgtggtga

SEQ ID NO: 14633 - RNA, 9876 nt, synthetic construct
  misc_feature 1..9876: note = derived and/or modified CDS sequence (opt3) from DENV-2__EU482561__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtggccgaaaaggactcccctgtcaacatcgaggctgaacccccatttggagatagctacatcattataggcgtggagcctgggcagctgaaactaaattggttcaagaagggatcgtctatcggtcagatgtttgagaccacaatgcgaggcgccaaacgcatggcaattctcggggacactgcctgggatttcggatccctgggcggtgtttttacctcaatcgggaaggctcttcaccaagtgttcggcgcgatttacggagcagcctttagtggcgtaagctggacaatgaaaatcttgataggggtcatcattacttggatcggaatgaactccagatctaccagcctgtcagtgagtctcgttctggtgggcgtcgtgacgctttatctgggtgctatggtacaggccgactccgggtgtgtggttagctggaagtctaaagaattgaagtgcggatcaggcattttcatcacagataatgtccacacctggactgagcagtacaagtttcagcccgaaagtccaagcaaactcgcatccgccatacaaaaggctcatgaggaaggtatttgtggcatcaggtctgtgacacggctggagaacttaatgtggaaacagattacccccgagctgaatcacatcctatcggaaaacgaggtgaagctcactataatgaccggggacatcaaaggaattatgcaggccggcaagcgcagcctgagacctcagccaacagaacttaaatattcctggaagacgtgggggaaggcaaaaatgttgtcaaccgagagtcataatcaaactttcctgatcgatggaccggaaacagcggagtgccccaacaccaatagggcttggaactctctcgaggtcgaagactacggctttggtgttttcacaactaatatttggctgaagttacgtgagaaacaggacgtgttttgtgatagcaagctgatgtccgccgcaatcaaagacaaccgggccgtgcacgctgatatggggtattggatagaatcagcccttaatgacacctggaagatggagaaggcaagcttcattgaggtaaaatcttgccactggcctaagtcccatacgttgtggagtaacggagtcctcgaaagcgagatgatcatcccaaaaaatttcgctggccccgtgtctcagcacaactaccgacctggttatcatacacagaccgccggcccatggcacctggggaagctagaaatggattttgacttctgtgagggaactaccgttgtggtcacagaagattgcggcaacagagggccctccctgaggactaccacagcgtcaggaaaactcattacggagtggtgctgtcgcagttgcaccctgccgcctcttcggtacagaggcgaggacggttgttggtacgggatggaaatcaggccattgaaggagaaggaagagaatctggtgaacagcttagttactgccggacatggccaaattgataatttttcgctcggtgtgctgggcatggctcttttcctggaagagatgttgcgcacacgagtagggaccaaacacgcaatgctcctggtcgtggtgtcctttgtcactctaataacaggaaacatgtctttccgggacctgggccgtgttatggtgatggtaggggccaccatgacggatgacatcggaatgggcattacttatctcgctctgcttgccgcatttaaggtgagacccaccttcgcggccggtttgctgttaaggaaactcacaagcaaggagctgatgatggctaccatcgggattgcccttctgtcacagagtactatccctgaaacaatactagagctcaccgatgcactggctttgggaatgatggtcctgaaaatcgtgcgcaatatggaaaagtaccagttagccgttacaattatggcaatctcctgcgtgcccaacgccgtcattctccaaaatgcttggaaggtgtcttgtactatcctggcggccgttagcgtgtccccacttctgttgacctcaagccagcagaaagcagactggatacctctcgctctgacgattaagggcctaaaccccacagccatctttctgaccactcttagtcggacctctaaaaagagatcctggccactcaatgaggccatcatggctgtcggcatggtaagcattctggcatcgtcattgctgaaaaacgacataccgatgacagggcctttagtggccggaggtctcctgactgtttgctatgtgcttaccggcaggtctgcggatctggaattggagcgagctgccgacgtcaagtgggaggatcaggcagaaatcagtgggtccagccccattctctctatcacgattagcgaggacggatccatgtcaatcaaaaatgaagaggaggaacaaacactgaccatactaatccgcactggcctgcttgtgattagtggtgtattcccagtgagcatccccattacagccgctgcatggtacctctgggaggtcaagaagcagcgggccggggttctgtgggatgtgccttctccaccccctgtgggaaaagcggaattggaggacggcgcttatagaatcaagcagaggggcatattagggtactcccagattggagccggtgtctataaagaaggcacctttcacactatgtggcatgtgacacgtggggcagttctgatgcaccgcggaaagcggatcgagccgtcatgggccgatgtaaaaaaggacctcatcagttacggcggtgggtggaagctggagggagaatggaaagagggcgaagaggtgcaagtccttgctctggaaccaggcaagaaccccagagccgtgcagaccaaacctgggttgttcaagacgaatactggaaccattggtgcagttagcctagatttttccccaggcacatctgggtcgcccatcgtggacaggaaaggaaaggtcgtgggcctgtacggtaacggggtagtcacccgaagcggagcttatgtgtcagccatagcgcagacagagaagtccattgaggataatcctgaaatcgaggacgatattttccggaaaaagcgcctcactatcatggacctgcatccgggcgccggcaaaaccaagagataccttcccgcaatagttagggaagctattaaacgggggttacgaacgctgatcctcgccccaacaagagtggtcgctgcagagatggaagaggccttgcgcggactgcctatcaggtatcagactcccgccattcgtgctgagcacaccggtcgggaaatcgtggacctcatgtgtcatgcgacattcaccatgagactgcttagtccagttagggtgcctaactacaacctgattataatggatgaggcacactttactgaccccgcctctatcgctgcccgcggctatattagcacccgagtcgaaatgggggaggcagccggaatcttcatgacagctacgccaccgggctccagagatccttttccccaatcaaatgcgccaatcatggacgaggaacgggagattcccgaaaggtcttggaacagcggtcacgagtgggtgactgatttcaaggggaagaccgtatggtttgtgcctagtataaaagccggaaatgacatcgcagcttgcttgcgcaagaacggcaaaaaggttattcagctatcccgtaaaacattcgatagcgaatacgtcaagaccagagccaatgactgggattttgtggtgactacagacatctctgagatgggcgcaaacttcaaggccgagcgggtcattgatccaaggcgctgtatgaaacccgtaatcctgaccgacggggaagagcgagtgatactcgctggacctatgccggttacgcattcatccgccgcgcagagacggggtaggatcggccgcaatccaaagaacgaaaatgaccaatatatttacatgggggagcccttagaaaacgatgaggactgcgcacactggaaagaggccaagatgctgcttgataatatcaacactcctgaaggaattatccccagtatgtttgagccagaaagagagaaagtggacgctatagatggcgaatacaggctgcggggtgaggcccgtaagacattcgtcgacctcatgcgccgaggggatttgcctgtgtggctggcttatagagttgcagccgagggcattaattacgctgacaggcggtggtgttttgatggaatcaaaaacaatcagattctcgaagagaacgtggaagtcgagatctggaccaaggagggcgaacgcaagaaactgaagcccagatggcttgacgccaggatatatagcgatccactagcactgaaagagttcaaggaattcgcggccgggcggaaatcgttgaccttaaacctgatcactgagatgggacgactccctacatttatgacccagaaggctagagacgccctggataatcttgcagtgctgcatacagctgaagccggtggccgcgcatacaaccacgccctctctgagttgccggagactctggaaacgctactgctccttaccctgttagctacagtaactgggggaattttcttgtttctgatgtccggcaagggtatcgggaaaatgaccctcggcatgtgctgcattatcacagcgagcatactgctttggtatgcccagattcaaccccactggatcgcagcttcaatcattctggagttctttctcatcgtgttgctgataccagaacctgagaagcagaggaccccccaggacaatcagttaacttacgttgtcattgccatcctaacggtggtggccgcaaccatggctaacgaaatgggattcctggagaaaacaaagaaagacctcggccttgggagtattgccactcaagagtctgaatccaatatcctggatatagacttgcggccagcgagcgcttggaccctgtatgccgtcgcaacaacctttgttactcctatgctccgtcattcaatcgagaacagtagcgtgaatgtatccctgacagccattgctaaccaggcaacggtgcttatgggactcggtaagggctggcccctgtctaagatggatatcggggtcccgttgctggccattggatgttacagccaggtgaatccaatcaccttaactgcggctctactgctccttgttgcccactacgcaattatcggccctggtctgcaggccaaagctacaagagaagcccaaaagagggcagctgccgggataatgaaaaaccccaccgtggacggcattaccgtcatcgatttggagccaatcccctatgaccctaagttcgaaaaacagctgggacaggtaatgctcctgattctttgcgtgacacaggttttaatgatgcgcactacgtgggcgctgtgtgaggccctcaccttggcaacaggcccgatatccactctgtgggaggggaatcccggacggttttggaacaccacaatcgctgtgtcaatggccaatattttccgaggctcttacctagcaggtgctgggctgctctttagtatcatgaagaacaccactaatacgagaaggggaacaggcaacattggtgaaacccttggcgagaagtggaaatcgcgcctgaatgccttggggaagagcgaattccaaatctataaaaagtccggaatacaggaggtcgatcggactctggccaaagagggcatcaagagaggggaaaccgaccatcacgcggtgtctcgtggatcagctaaactcaggtggtttgtcgagcggaacatggtgacaccagaaggcaaggttgtggatctgggttgcgggcgcggaggctggagctactattgtggtggcttaaagaacgtacgagaggtgaaagggcttactaagggaggccctgggcatgaagagcccattcctatgtccacctacggatggaatctggtcagactccagagtggcgttgacgtgttcttcacaccacccgagaaatgcgatacgctactgtgtgacatcggtgaatctagccctaacccaaccattgaggcagggaggactttgcgggtcctgaatctcgtggaaaactggcttaataacaatacacaattttgcatcaaggtactgaacccctatatgccgtcagtgatagagaaaatggaaaccttgcagcgcaagtacggaggcgccctggttagaaatcctctctccaggaacagtactcacgagatgtactgggtgagcaatgctacaggcaacattgtctcttccgtgaatatgatctcacgaatgttaatcaaccggttcaccatgaagcacaaaaaggccacgtatgagccagatgtcgacctggggagcggaacccgtaatattggtatagaatcggagatccccaaccttgacattatcggcaaaagaattgaaaagatcaaacaggagcatgaaacatcttggcactacgatcaggaccatccttataagacttgggcataccacgggagttatgagaccaagcaaacaggatccgccagctcaatggtgaacggcgttgtacgcctgctaactaaaccatgggatgtggtccccatggtgacccagatggctatgacagacaccactccgtttggtcagcagagggttttcaaggagaaagtggatacgcggacacaagaacctaaggaggggaccaaaaagctcatgaagataactgcggaatggctgtggaaagagttgggaaagaaaaagacccccagaatgtgtacacgcgaggaatttacgaggaaagtccgatccaatgccgcactgggcgctatcttcaccgacgagaacaagtggaaatctgcccgggaagcagtggaggatagcagattttgggaactcattgacagggagcgcaatcttcacctggagggcaagtgcgaaacttgtgtatacaacatgatggggaagcgtgagaaaaagttaggagaattcggtaaagccaagggcagtcgggctatctggtatatgtggctgggggccagatttttggagttcgaagcgctcggatttctgaatgaggatcattggttctccaggggcaacagcctatctggtgtggagggggaaggacttcaccgcctgggctacattctccgagacgtttcaaaaaaggagggcggggcaatgtacgccgatgacacagctggatgggacacccggatcactctggaagatttgaagaatgaggaaatggtcacaaaccatatgaaaggtgagcacaagaaactggccgaggcaatttttaagctcacctatcagaataaagtggtgagagtccagaggccaacacctcgcggcactgttatggacataatcagtagacgggatcagagggggtccggacaagtgggcacctacggtcttaacacgttcaccaatatggaagctcagctgattcgtcagatggagggggaaggaatcttcaagagcatccaacatttaacagtaactgaggagattgccgtgcagaactggctggctcgagtcggccgcgaaagattgtctcggatggccatatcgggcgacgattgcgtggttaagcccctcgacgataggtttgcatcagcgctgaccgccctaaatgacatggggaaagtgcgcaaggatatccagcagtgggagccaagcagaggatggaacgactggacacaagtccccttctgctcccaccactttcatgaacttattatgaaagatggtcgggtgctggtagttccttgtaggaatcaggacgagctcatcggccgagctcgtattagtcagggggccggatggtctctgaaggaaactgcatgcttgggcaaaagctatgctcagatgtggaccttaatgtacttccacagacgcgatctgcggctcgccgcaaacgccatctgttccgcggtgccatcacattgggtcccgacgagtaggacaacctggtctatacacgctaagcacgagtggatgactacagaggacatgcttgccgtgtggaacagagtgtggatccaagaaaatccctggatggaggacaagacccctgtcgaaagctgggaggaagttccatatctgggtaaacgcgaggatcagtggtgcgggtccctaattggactgacttcacgggcaacctgggccaagaacatccagacagctattaatcaggtgaggagcctcatcggcaacgaggaatacacggactatatgccctctatgaaacgatttagacgggaggaagaggaagccggcgtattgtggtga

SEQ ID NO: 14634 - RNA, 9876 nt, synthetic construct
  misc_feature 1..9876: note = derived and/or modified CDS sequence (opt3) from DENV-2__EU569703__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgaggtaaaatcttgccactggcctaagtcccatacgttgtggagtaatggagtcctcgaaagcgagatgatcattccaaaaaacttcgccggccccgtgtctcagcacaactaccgacctggttatcatacacagaccgcaggcccatggcacctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtacgggatggaaattaggccattgaaggagaaggaagagaacctggtgaatagcttagttactgccggacatggccaaatagataacttttcgctcggtgtgctgggcatggcgcttttcctggaagagatgttgcgcacacgagtagggaccaaacacgccatcctcctggtcgctgtgtcctttgtgactctaattacaggaaatatgtctttccgggacctgggccgtgtcatggttatggtgggggcaaccatgacggatgacatcggaatgggcgtaacttatctcgccctgcttgctgcctttaaggtgagacccaccttcgcagcgggtttgctgttaaggaaactcacaagcaaggagctgatgatggccaccattgggatcgctcttctgtcacagagtactatacctgaaacaatcctagagctcaccgatgccctggcattgggaatgatggtcctgaaaattgtgcgcaacatggaaaagtaccagttagctgttacaatcatggccatttcctgcgtgcccaatgcagtcatcctccaaaacgcctggaaggtgtcttgtactatactggctgcggttagcgtgtccccacttctgttgacctcaagccagcagaaagccgactggattcctctcgcactgacgatcaagggcctaaatcccacagctatctttctgaccactcttagtcggacctctaaaaagagatcctggccactcaacgaggccgtcatggccgtaggcatggtgagcattctggcttcgtcattgctgaaaaatgacataccgatgacagggcctttagttgcaggaggtctcctgactgtgtgctatgtccttaccggcaggtctgccgatctggaattggagcgagcggctgacgtgaagtgggaggatcaggccgaaatcagtgggtccagccccattctctctatcacgattagcgaggacggatccatgtcaatcaaaaacgaagaggaggaacacacactgaccatactaatccgcactggcctgcttgtaattagtggtgtgttcccagtcagcatccccattacagcagccgcttggtacctctgggaggttaagaagcaacgggcaggggtgctgtgggatgtgccttctccaccccctgtcggaaaagccgaattggaggacggcgcgtatagaatcaagcagaggggcatatttgggtactcccagattggagctggtgtgtataaagaaggcaccttccatactatgtggcacgttacacgtggggccgtattaatgcatcgcggaaagcggatcgagccgtcatgggcagatgtgaaaaaggacctgatcagttacggcggtgggtggaagctcgagggagaatggaaagagggcgaagaggtccaggtgctggcccttgaaccaggcaagaatcccagagctgttcaaaccaaacctgggctgtttaagacgaacactggaaccattggtgccgtgagcttggatttctccccaggcacatctgggtcgcccatcgtcgacaggaaaggaaaggtggtaggcctatacggtaatggggtcgtgacccgaagcggagcatatgtttcagctatagcccagacagagaagtccattgaggataaccctgaaatcgaggacgatattttccggaaaaagcgcctgactatcatggacctccacccgggcgcgggcaaaaccaagagatacctgcccgccatagtgagggaagcaattaaacgggggcttcgaacgttaatcctggctccaacaagagtcgtggccgctgagatggaagaggcactccgcggattgcctatcaggtatcagactcccgccattcgtgccgagcataccggtcgggaaatcgttgacctgatgtgtcacgctacatttaccatgagactcctgagtccagtgagggtccctaactacaatcttattataatggatgaggcgcacttcactgaccccgcatctatcgccgctcgcggctatattagcacccgagtggaaatgggggaggccgcaggaatctttatgacagccacgccaccgggctccagagatcctttcccccagtcaaacgctccaatcatggacgaggaacgggagattcccgaaaggtcttggaatagcggtcatgagtgggtaactgattttaaggggaagaccgtgtggttcgttcctagtataaaagcgggaaacgacatcgccgcatgcctgcgcaagaatggcaaaaaggtcattcaattgtcccgtaaaacatttgatagcgaatacgtgaagaccagagctaacgactgggatttcgtggtcactacagacatctctgagatgggcgccaattttcgggcagagagggtaattgatccacgccgatgtatgaagcccgtgatcctaaccgacggggaagagagagttatactggccggacctatgccggtgacgcactcatccgctgcccagcggaggggtcgcatcggcagaaacccaaaaaatgaaaacgaccagtatatttacatgggggagcccctcgaaaatgatgaggactgcgcgcattggaaggaggcaaaaatgttactggataacatcaatactcctgaaggaattatccccagtatgttcgagccagaaagggagaaggtcgacgccatagatggcgaataccggcttcgtggtgaggctcgcaaaacatttgtggacctgatgcgaagaggggatctccctgtttggttggcctatagggtggctgcagagggcattaactacgccgaccggcgctggtgtttcgatggaatcaagaataaccaaattctggaagagaacgtcgaagtggagatctggaccaaagagggcgaaagaaagaagctcaaacccaggtggctggacgctcggatatatagcgatccacttgccctaaaggagttcaaagaatttgcagcggggcgaaagtcgctgaccttgaatttaatcactgagatgggaagactgcctacattcatgacccagaaagcccgcgacgctctcgataacctggccgtacttcacacagcagaagtgggtggcagggcttacaatcacgccctgtctgagctcccggagactttggaaacgctgctactgctcacccttctggcaacagttactgggggaatttttttattcttgatgtccggcaagggtatcgggaagatgaccctgggcatgtgctgcattatcacagccagcatactcctgtggtatgctcagattcagccccattggatcgcggcctcaatcattcttgagtttttcctgatcgtcctcttgataccagaacctgagaaacaacggaccccccaggacaaccagctgacttacgtggtgattgcaatcttaacggtcgttgctgccaccatggccaatgaaatgggatttctagagaagacaaaaaaggacctgggcctcgggagtattactacccaggagtctgaatccaacatccttgatatagacctgcgtccagcaagcgcttggacattgtatgccgtggcgaccactttcgtaacacctatgctgagacactcaatcgagaatagtagcgtgaacgtctccctcacggctattgccaatcaagcaaccgtgctgatgggacttggtaggggctggcccctctctaaaatggatatcggggttccgctgttggccattggatgttacagccaggtgaacccaatcactctgacagctgcattactactgctcgtcgcccattacgcgattatcggccctggtcttcaggctaaggccacccgcgaagcacagaagcgggccgctgccgggataatgaaaaatcccaccgtagacggcattacagtgatcgatctggagccaatcccctatgaccctaagtttgaaaaacaattgggacaggttatgctgctcgtgctgtgcgtcactcaggtgcttatgatgcgaacgacctgggcattatgtgaggctctgacactcgccactggcccgatttccaccttgtgggaggggaaccccggaagattctggaatacaaccatagcggtctcaatggccaacatctttaggggctcttacctggcaggtgctgggctactgttcagtattatgaagaatactacgaacacacgccggggaaccggcaatatcggtgaaactctcggcgagaaatggaagtcgagacttaacgccctggggaagagcgaatttcagatttataaaaagtccggaatccaagaggtggatcgtaccttggcaaaagagggcataaagaggggggaaacagaccaccatgctgtttctcggggatcagccaaactgcgctggttcgtggagcgaaacatggtaactccagaaggcaaggtggtcgatctcggttgcgggagaggaggctggagctactattgtggtggcctgaaaaatgttagggaggtgaaggggttaaccaagggaggccctgggcacgaagagcccatccctatgtccacatacggatggaaccttgtccggctgcagagtggcgtggacgtattctttacgccacccgagaaatgcgataccctcctatgtgacattggtgaatctagccctaatccaactatcgaggccgggcgcacactgagagtgttgaacctggttgaaaattggctcaacaataacacccagttctgcattaaggtgcttaatccctatatgccgtcagtcatcgagaaaatggaaactctgcaaaggaagtacggaggcgcgttggtgcgaaaccctctgtcccggaatagtacacacgagatgtactgggtcagcaacgctaccggcaatatagtgtcttccgttaacatgatttcacgtatgctcatcaatagatttacgatgaaacataagaaggcaacctatgagccagatgtagacttagggagcggaacacgcaacatcggtattgaaaacgagatacccaatctggacatcattggcaaaaggatcgaaaagattaaacaggagcacgaaacttcgtggcattacgatcaggaccacccttataagacctgggcctaccacgggtcttatgagacaaaacagactggaagtgcttccagcatggtgaacggcgtcgtgcggcttctgaccaagccatgggatgttgtgcccatggtcacacaaatggccatgaccgacactacgccgttcggtcagcagagagtgtttaaggagaaagtagatacacgcacccaggaacctaaggaggggactaaaaagctaatgaggatcaccgcagaatggctctggaaagagctgggaaagaagaaaacaccccgaatgtgtacgcgggaggaattcaccagaaaggtgaggtcaaatgccgctttgggcgcgatatttactgacgagaacaaatggaagtccgcccgcgaagcagttgaggattctcgtttctgggaactggtcgaccgggagagaaatctccatcttgagggcaaatgcgaaacatgtgtgtacaacatgatggggaagagggagaaaaagctgggagaatttggtaaggctaaaggcagccgcgccatctggtatatgtggttaggggcacgattcctggagtttgaagccttgggattcctcaatgaggatcactggtttagtcggggcaactccctgagcggtgtggagggggaaggactacataagcttggctacattctgagagacgtctctaaaaaggagggcggggctatgtacgccgatgacaccgcgggatgggacactaggatcacactcgaagatctgaaaaatgaggaaatggttaccaaccacatgaagggtgagcataagaaattggcagaggccattttcaagctgacatatcaaaataaagtggtacgcgtgcagagaccaactcctcggggcaccgtcatggacatcatttcaaggaaggatcagcgtgggagtggacaggtgggcacgtacggtctcaacaccttcacaaatatggaagctcaacttatacgacagatggagggggaaggaatctttaaatccattcagcgcctgactgttaccgaggagatcgccgtgcaaaactggttagcaagagtcggccgggaaaggctgagccgcatggctatctctggcgacgattgcgtggtaaagcccttggacgatagattcgcctcggctctcacagccctgaatgacatggggaaggttcggaaagatattcagcagtgggagccatcaaggggatggaacgactggactcaggtgcccttttgcagccaccacttccatgaactagtcatgaaggatggtcgagtgcttgtggtcccttgtcgtaaccaagacgagctgataggcagagcacgcatctcccagggggcgggatggagtctcaaagaaaccgcctgcctgggcaagtcttatgctcagatgtggacgttgatgtactttcaccggagggatttaagactggccgcaaatgctatttgtagcgccgttccatcccattgggtgccgacatcacgcaccacttggagtatccacgcaaaacacgagtggatgacaaccgaggacatgctcgccgtatggaaccgggtgtggattcaggaaaatccctggatggaggacaagactcctgtcgaatcttgggaggaagtgccatatcttggtaagagggaggatcaatggtgcgggagcctgatcggactaacctcccgagcgacatgggctaaaaacatacagacggccatcaatcaggttagatcactgattggcaacgaggaatacaccgactatatgcccagcatgaagcggttcaggaaagaggaagaggaagcaggcgtgctctggtga

SEQ ID NO: 14635 - RNA, 9876 nt, synthetic construct
  misc_feature 1..9876: note = derived and/or modified CDS sequence (opt3) from DENV-2__EU529694__SS-prME
  source 1..9876: mol_type = other RNA
accgcaggcgtgttcataatgctgattcccacagctatggcatttcacctcactacgagaaacggggagcctcatatgatagtcgggaggcaggaaaagggtaaaagccttctgttcaagaccgaggacggcgttaatatgtgcacattgatggccatggatttaggggaactgtgtgaggacactatcacctacaaatgcccactgctccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggattctgcggcatcctggctttacaatcatggccgcaatattggcctacaccatcggcacgactcacttccagcgcgctctcatttttatcctgctgacagcagttgccccatccatgaccatgagatgcattgggatctctaacagggatttcgtggaaggagtctcgggtggctcatgggtggacatagtactcgagcacgggagctgtgttactacaatggctaagaataagcccaccttagattttgaactgattaaaacggaggccaagcagcctgcgacccttcggaaatattgcatcgaagcaaagttgacaaacactaccacagagagtcgctgtccaactcaaggagagccctccctgaatgaagaacaggacaaacgattcgtgtgcaagcattctatggtcgatagaggctggggtaacgggtgtggactgtttggcaagggcgggattgtgacctgcgccatgttcacatgcaaaaagaatatggaaggaaaagtggtcctccctgagaacctggaatacaccatcgttatcactccacacagcggtgaggagcatgctgtgggcaatgacacggggaagcacggaaaagaaattaagataacaccgcagtcctcaatcaccgaggccgaacttactggctatggtaccgtaacaatggagtgtagtcccaggaccgggctggattttaacgaaatggtgttgctccagatggaggacaaagcatggctggtccaccggcaatggttcttagatctgcctctcccatggcttcccggcgctgacactcagggaagcaattggattcagaaggagacactggtgacgtttaagaaccctcatgccaaaaagcaggacgttgtggtcttgggctctcaagaaggggcgatgcacaccgccctaactggagcaacagagatccagatgtcctcaggtaatctactcttcaccggccatctgaaatgccgtcttcgcatggataagctgcagttgaaagggatgagctacagtatgtgtacaggaaagttcaagatagtgaaagaaattgctgagactcaacacggcaccatcgtaatcagagttcagtatgagggtgacgggtctccatgcaagattccctttgaaatcatggatctcgagaaaaggcatgtgctgggccggttaattacggtcaacccgatagtggccgaaaaggactcccctgtcaacatcgaggctgaacccccattcggagatagctacattatcatcggcgtggagcctgggcagctgaaactaaattggtttaagaagggatcgtctattggtcagatgttcgagaccacaatgcgaggcgccaaacgcatggcaatactcggggacactgcctgggattttggatccctgggcggtgttttcacctcaatcgggaaggcacttcaccaagtgtttggcgcgatttacggagcagccttcagtggcgtaagctggacaatgaaaatcttgattggggtcatcataacttggatcggaatgaactccagatctaccagcctgtcagtgagtctcgttctggtgggcgtcgtgacgctttatctgggtgctatggtacaggccgactccgggtgtgtggttagctggaagtctaaagaattgaagtgcggatcaggcatttttatcacagataatgtccacacctggactgagcagtacaagttccagcccgaaagtccaagcaaactcgcatccgccattcaaaaggctcatgaggaaggtatctgtggcataaggtctgtgacacggctggagaacttaatgtggaaacagattacccccgagctgaatcacatcctatcggaaaacgaggtgaagctcactattatgaccggggacatcaaaggaataatgcaggccggcaagcgcagcctgagacctcagccaacagaacttaaatattcctggaagacgtgggggaaggcaaaaatgttgtcaaccgagagtcataatcaaacttttctgatcgatggaccggaaacagcggagtgccccaacaccaatagggcttggaactctctcgaggtcgaagactacggcttcggtgtttttacaactaatatttggctgaagttacgtgagaaacaggacgtgttctgtgatagcaagctgatgtccgccgcaatcaaagacaaccgggccgtgcacgctgatatggggtattggattgaatcagcccttaatgacacctggaagatggagaaggcttcattcatcgaggtaaaatcttgccactggcctaagtcccatacgttgtggagtaacggagtcctcgaaagcgagatgataattcccaaaaattttgctggccccgtgtctcagcacaactaccgacctggttatcatacacagaccgccggcccatggcacctggggaagctagaaatggatttcgacttttgtgagggaactaccgttgtggtcacagaagattgcggcaacagagggccctccctgaggactaccacagcgtcaggaaaactcatcacggagtggtgctgtcgcagttgcaccctgccgcctcttcggtacagaggcgaggacggttgttggtacgggatggaaatcaggccattgaaggagaaggaagagaatctggtgaacagcttagttactgccggacatggccaaattgataatttctcgctcggtgtgctgggcatggctctttttctggaagagatgttgcgcacacgagtagggaccaaacacgcaatgctcctggtcgccgtgtccttcgtgactctaatcacaggaaacatgtcttttcgggacctgggccgtgtcatggttatggtgggggctaccatgacggatgacattggaatgggcataacttatctcgccctgcttgcagcgttcaaggtaagacccacctttgccgctggtttgctgttaaggaaactcacaagcaaggagctgatgatggccaccatcgggattgcacttctgtcacagagtactatccctgaaacaattctagagctcaccgatgctctggccttgggaatgatggtgctgaaaatcgtccgcaatatggaaaagtaccagttagcagtgacaataatggccatctcctgcgttcccaacgctgtgattctccaaaatgcgtggaaggtctcttgtactatcctggccgcagtgagcgtttccccacttctgttgacctcaagccagcagaaagctgactggattcctctcgccctgacgatcaagggcctaaaccccacagccatattcctgaccactcttagtcggacctctaaaaagagatcctggccactcaatgaggctattatggcagtgggcatggtcagcatcctggcctcgtcattgctgaaaaacgacatcccgatgacagggcctttagtagcgggaggtctcctgactgtgtgctatgttcttaccggcaggtctgctgatctggaattggagcgagccgcagacgtgaagtgggaggatcaggccgaaattagtgggtccagccccatactctctatcacgattagcgaggacggatccatgtcaatcaaaaatgaagaggaggaacaaacactgaccattctaatccgcactggcctgcttgtcataagtggtgtgtttccagtaagcatccccattacagctgcagcctggtacctctgggaggtgaagaagcagcgggcgggggtcctgtgggatgttccttctccaccccctgtgggaaaagctgaattggaggacggcgcctatagaatcaagcagaggggcattttagggtactcccagatcggagccggtgtgtataaagaaggcaccttccacactatgtggcatgtcacacgtggggccgtgctgatgcaccgcggaaagcggatagagccgtcatgggctgatgttaaaaaggacctcattagttacggcggtgggtggaagctggagggagaatggaaagagggcgaagaggtacaagtgcttgccctggaaccaggcaagaaccccagagcagtccagaccaaacctgggttgtttaagacgaatactggaaccatcggtgctgtgagcctagatttctccccaggcacatctgggtcgcccatcgttgacaggaaaggaaaggtggtcggcctgtacggtaacggggtggtaacccgaagcggagcctatgtctcagcgattgcccagacagagaagtccatcgaggataatcctgaaatagaggacgatattttccggaaaaagcgcctcactatcatggacctgcatccgggcgcaggcaaaaccaagagataccttcccgctattgtgagggaagccatcaaacgggggttacgaacgctgatactcgctccaacaagagttgtggcagccgagatggaagaggccttgcgcggactgcctattaggtatcagactcccgctatccgtgcggagcacaccggtcgggaaatcgtcgacctcatgtgtcatgcaacatttaccatgagactgcttagtccagtgagggttcctaactacaacctgattatcatggatgaggcccacttcactgaccccgcttctattgccgcacgcggctatataagcacccgagtggaaatgggggaggccgctggaatctttatgacagcgacgccaccgggctccagagatcctttcccccaatcaaatgccccaattatggacgaggaacgggagatccccgaaaggtcttggaacagcggtcacgagtgggtcactgattttaaggggaagaccgtgtggttcgtacctagtatcaaagcaggaaatgacattgctgcctgcttgcgcaagaacggcaaaaaggtgatacagctatcccgtaaaacatttgatagcgaatacgttaagaccagagcaaatgactgggatttcgtcgtgactacagacatctctgagatgggcgccaactttaaggctgagcgggtgattgatccaaggcgctgtatgaaacccgtcatcctgaccgacggggaggaacgagtaattctcgccggacctatgccggtgacgcattcatccgcggcacagagacggggtaggatcggccgcaatccaaagaacgaaaatgaccaatatatatacatgggggagcccttagaaaacgatgaggactgcgcccactggaaagaggctaagatgctgcttgataatatcaacactcctgaaggaattatccccagtatgttcgagccagaaagagagaaagttgacgccattgatggcgaatacaggctgcggggtgaggctcgtaagacatttgtggacctcatgcgccgaggggatttgcctgtctggctggcatatagagtggccgctgagggcatcaattacgccgacaggcggtggtgtttcgatggaatcaaaaacaatcagattctcgaagagaacgttgaagtggagatctggaccaaggagggcgaacgcaagaaactgaagcccagatggcttgacgcaaggatttatagcgatccactagcgctgaaagagttcaaggaatttgccgctgggcggaaatcgttgaccttaaacctgatcactgagatgggacgactccctacattcatgacccagaaggccagagacgcactggataatcttgctgtcctgcatacagccgaagccggtggacgcgcatacaaccacgctctctctgagttgccggagactctggaaacgctactgctccttaccctgttagcgacagtgactgggggaatatttttgttcctgatgtccggcaagggtatcgggaaaatgaccctcggcatgtgctgcattatcacagccagcattctgctttggtatgcacagatccaaccccactggatagctgcctcaattatcctggagtttttcctcatcgtattgctgattccagaacctgagaagcagaggaccccacaggacaatcagttaacttacgtggttatcgccatactaacggtcgtggcagctaccatggccaacgaaatgggatttctggagaaaacaaagaaagacctcggccttgggagtattgcgactcaagagtctgaatccaatatcctggatattgacttgcggccagctagcgcctggaccctgtatgcagtggccacaaccttcgtcactcctatgctccgtcattcaatcgagaacagtagcgttaatgtgtccctgacagctatagcaaaccaggccacggtacttatgggactcggtaagggctggcccctgtctaagatggatatcggggtgccgttgctggcgattggatgttacagccaggtcaatccaatcaccttaactgctgccctactgctccttgtggcacactacgccattatcggccctggtctgcaggctaaagccacaagagaagcacaaaagagggctgccgcggggattatgaaaaaccccaccgttgacggcatcaccgtgatagatttggagccaattccctatgaccctaagtttgaaaaacagctgggacaggtcatgctcctgatcctttgcgtaacacaggtgttaatgatgcgcactacgtgggccctgtgtgaggcactcaccttggctacaggcccgatctccactctgtgggaggggaatcccggacggttctggaacaccacaattgccgtttcaatggcaaatatatttcgaggctcttacctagctggtgccgggctactcttcagtatcatgaagaacaccactaatacgagaaggggaacaggcaacattggtgaaacccttggcgagaagtggaaatcgcgcctgaatgccttgggaaagagcgaatttcaaatctataaaaagtccggcattcaggaggtggatcggactctggcgaaagagggcatcaagagaggggaaaccgaccatcacgctgtctctcgtggatcagcaaaactcaggtggttcgtggagcggaacatggtcacaccagaaggcaaggtggttgatctgggttgcgggcgcggaggctggagctactattgtggtggcttaaagaacgtgcgagaggtaaaagggcttactaagggaggccctgggcatgaggaacccatacctatgtccacctacggatggaatctggtgagactccagagtggcgtcgacgttttctttacaccacccgagaaatgcgatacgctactgtgtgacatcggtgaatctagccctaacccaaccattgaggccgggaggactttgcgggtgctgaatctcgtcgaaaactggcttaataacaatacacaattctgcatcaaggtgctgaacccctatatgccgtcagtaattgagaaaatggaaaccttgcagcgcaagtacggaggcgctctggtgagaaatcctctctccaggaacagtactcacgagatgtactgggttagcaatgccacaggcaacatcgtgtcttccgtcaatatgatatcacgaatgttaattaaccggtttaccatgaagcacaaaaaggcaacgtatgagccagatgtggacctggggagcggaacccgtaatatcggtatcgaatcggagattcccaaccttgacataatcggcaaaagaattgaaaagatcaaacaggagcatgaaacatcttggcactacgatcaggaccatccttataagacttgggcctaccacgggagttatgagaccaagcaaacaggatccgctagctcaatggtcaacggcgtggttcgcctgctaactaaaccatgggatgtagtgcccatggtcacccagatggcgatgacagacaccactccgttcggtcagcagagggtgtttaaggagaaagttgatacgcggacacaagaacctaaggaggggaccaaaaagctcatgaagattactgccgaatggctgtggaaagagttgggaaagaaaaagacccccagaatgtgtacacgcgaggagttcacgaggaaagtgcgatccaatgcagctctgggcgccatctttaccgacgagaacaagtggaaatctgcacgggaagccgtcgaggatagcagattctgggaactcatagacagggagcgcaatcttcacctggagggcaagtgcgaaacttgtgtgtacaacatgatggggaagcgtgagaaaaagttaggagaatttggtaaagctaagggcagtcgggccatctggtatatgtggctgggggcgagattcttggagtttgaagcactcggattcctgaatgaggatcattggttttccaggggcaacagcctatctggtgtagagggggaaggacttcaccgcctgggctacattctccgagacgtgagcaaaaaggagggcggggccatgtacgctgatgacacagccggatgggacacccggatcactctggaagatttgaagaatgaggaaatggttacaaaccatatgaaaggtgagcacaagaaactggcagaggctattttcaagctcacctatcagaataaagtcgtgagagtgcagaggccaacacctcgcggcactgtcatggacatcattagtagacgggatcagagggggtccggacaagttggcacctacggtcttaacacgttcaccaatatggaagcccagctgatacgtcagatggagggggaaggaatctttaagagcattcaacatttaacagtgactgaggagatcgctgtacagaactggctggcccgagtgggccgcgaaagattgtctcggatggcaatctcgggcgacgattgcgtcgtgaagcccctcgacgataggttcgcgtcagccctgaccgctctaaatgacatggggaaagttcgcaaggatattcagcagtgggagccaagcagaggatggaacgactggacacaagtgcccttttgctcccaccacttccatgaacttgtcatgaaagatggtcgggtgctggtagttccttgtaggaatcaggacgagctcataggccgagcccgtatcagtcagggggcaggatggtctctgaaggaaactgcttgcttgggcaaaagctatgcccagatgtggaccttaatgtactttcacagacgcgatctgcggctcgcagccaacgcgatttgttccgctgtgccatcacattgggtcccgacgagtaggacaacctggtctatccacgccaagcacgagtggatgactacagaggacatgcttgcagtgtggaacagagtgtggattcaagaaaatccctggatggaggacaagacccctgtcgaaagctgggaggaagttccatatctgggtaaacgcgaggatcagtggtgcgggtccctaatcggactgacttcacgggccacctgggctaagaacatacagacagccatcaatcaggtgaggagcctcattggcaacgaggaatacacggactatatgccctctatgaaacgattcagacgggaggaagaggaagcaggcgtattgtggtga

SEQ ID NO: 14636 - RNA, 9876 nt, synthetic construct
  misc_feature 1..9876: note = derived and/or modified CDS sequence (opt3) from DENV-2__EU529695__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgaggtaaaatcttgccactggcctaagtcccatacgttgtggagtaatggagtcctcgaaagcgagatgatcattccaaaaaacttcgccggccccgtgtctcagcacaactaccgacctggttatcatacacagaccgcaggcccatggcacctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtacgggatggaaattaggccattgaaggagaaggaagagaacctggtgaatagcttagttactgccggacatggccaaatagataacttttcgctcggtgtgctgggcatggcgcttttcctggaagagatgttgcgcacacgagtagggaccaaacacgccatcctcctggtcgctgtgtcctttgtgactctaattacaggaaatatgtctttccgggacctgggccgtgtcatggttatggtgggggcaaccatgacggatgacatcggaatgggcgtaacttatctcgccctgcttgctgcctttaaggtgagacccaccttcgcagcgggtttgctgttaaggaaactcacaagcaaggagctgatgatggccaccattgggatcgctcttctgtcacagagtactatacctgaaacaatcctagagctcaccgatgccctggcattgggaatgatggtcctgaaaattgtgcgcaacatggaaaagtaccagttagctgttacaatcatggccatttcctgcgtgcccaatgcagtcatcctccaaaacgcctggaaggtgtcttgtactatactggctgcggttagcgtgtccccacttctgttgacctcaagccagcagaaagccgactggattcctctcgcactgacgatcaagggcctaaatcccacagctatctttctgaccactcttagtcggacctctaaaaagagatcctggccactcaacgaggccgtcatggccgtaggcatggtgagcattctggcttcgtcattgctgaaaaatgacataccgatgacagggcctttagttgcaggaggtctcctgactgtgtgctatgtccttaccggcaggtctgccgatctggaattggagcgagcggctgacgtgaagtgggaggatcaggccgaaatcagtgggtccagccccattctctctatcacgattagcgaggacggatccatgtcaatcaaaaacgaagaggaggaacaaacactgaccatactaatccgcactggcctgcttgtaattagtggtgtgttcccagtcagcatccccattacagcagccgcttggtacctctgggaggttaagaagcagcgggcaggggtgctgtgggatgtgccttctccaccccctgtcggaaaagccgaattggaggacggcgcgtatagaatcaagcagaggggcatatttgggtactcccagattggagctggtgtgtataaagaaggcaccttccacactatgtggcatgttacacgtggggccgtattaatgcaccgcggaaagcggatcgagccgtcatgggcagatgtgaaaaaggacctgatcagttacggcggtgggtggaagctcgagggagaatggaaagagggcgaagaggtccaagtgctggcccttgaaccaggcaagaatcccagagctgttcagaccaaacctgggctgtttaagacgaacactggaaccattggtgccgtgagcttggatttctccccaggcacatctgggtcgcccatcgtcgacaggaaaggaaaggtggtaggcctatacggtaatggggtcgtgacccgaagcggagcatatgtttcagctatagcccagacagagaagtccattgaggataaccctgaaatcgaggacgatattttccggaaaaagcgcctgactatcatggacctccatccgggcgcgggcaaaaccaagagatacctgcccgccatagtgagggaagcaattaaacgggggcttcgaacgttaatcctggctccaacaagagtcgtggccgctgagatggaagaggcactccgcggattgcctatcaggtatcagactcccgccattcgtgccgagcacaccggtcgggaaatcgttgacctgatgtgtcatgctacatttaccatgagactcctgagtccagtgagggtccctaactacaatcttattataatggatgaggcgcacttcactgaccccgcatctatcgccgctcgcggctatattagcacccgagtggaaatgggggaggccgcaggaatctttatgacagccacgccaccgggctccagagatcctttcccccaatcaaacgctccaatcatggacgaggaacgggagattcccgaaaggtcttggaatagcggtcacgagtgggtaactgattttaaggggaagaccgtgtggttcgttcctagtataaaagcgggaaacgacatcgccgcatgcctgcgcaagaatggcaaaaaggtcattcagttgtcccgtaaaacatttgatagcgaatacgtgaagaccagagctaacgactgggatttcgtggtcactacagacatctctgagatgggcgccaattttcgggcagagagggtaattgatccacgccgatgtatgaagcccgtgatcctaaccgacggggaagagagagttatactggccggacctatgccggtgacgcattcatccgctgcccagcggaggggtcgcatcggcagaaacccaaaaaatgaaaacgaccaatatatttacatgggggagcccctcgaaaatgatgaggactgcgcgcactggaaggaggcaaaaatgttactggataacatcaatactcctgaaggaattatccccagtatgttcgagccagaaagggagaaggtcgacgccatagatggcgaataccggcttcgtggtgaggctcgcaaaacatttgtggacctgatgcgaagaggggatctccctgtttggttggcctatagggtggctgcagagggcattaactacgccgaccggcgctggtgtttcgatggaatcaagaataaccagattctggaagagaacgtcgaagtggagatctggaccaaagagggcgaaagaaagaagctcaaacccaggtggctggacgctcggatatatagcgatccacttgccctaaaggagttcaaagaatttgcagcggggcgaaagtcgctgaccttgaatttaatcactgagatgggaagactgcctacattcatgacccagaaagcccgcgacgctctcgataacctggccgtacttcatacagcagaagtgggtggcagggcttacaatcacgccctgtctgagctcccggagactttggaaacgctgctactgctcacccttctggcaacagttactgggggaatttttttattcttgatgtccggcaagggtatcgggaagatgaccctgggcatgtgctgcattatcacagccagcatactcctgtggtatgctcagattcaaccccactggatcgcggcctcaatcattcttgagtttttcctgatcgtcctcttgataccagaacctgagaaacagcggaccccccaggacaaccagctgacttacgtggtgattgcaatcttaacggtcgttgctgccaccatggccaatgaaatgggatttctagagaagacaaaaaaggacctgggcctcgggagtattatcactcaagagtctgaatccaacatacttgatatcgacctgcgtccagcaagcgcttggaccttgtatgccgtggcgacaaccttcgtaactcctatgctgagacattcaattgagaatagtagcgtgaacgtctccctcacagctatcgccaatcaggcaacggtgctgatgggacttggtaggggctggcccctctctaaaatggatattggggttccgctgttggccatcggatgttacagccaggtgaacccaattaccctgactgctgcattactactgctcgtcgcccactacgcgatcataggccctggtcttcaggctaaggccacacgcgaagcacaaaagcgggccgctgccgggattatgaaaaatcccaccgtagacggcatcaccgtgatcgatctggagccaattccctatgaccctaagtttgaaaaacagttgggacaggttatgctgctcgtgctgtgcgtcacacaggtgcttatgatgcgaactacgtgggcattatgtgaggctctgaccctcgccacaggcccgatatccactttgtgggaggggaaccccggaagattctggaataccacaatcgcggtctcaatggccaacatttttaggggctcttacctggcaggtgctgggctactgttcagtatcatgaagaataccactaacacgcgccggggaacaggcaatattggtgaaaccctcggcgagaaatggaagtcgagacttaacgccctggggaagagcgaatttcaaatctataaaaagtccggaatacaggaggtggatcgtactttggcaaaagagggcatcaagaggggggaaaccgaccatcacgctgtttctcggggatcagccaaactgcgctggttcgtggagcgaaacatggtaacaccagaaggcaaggtggtcgatctcggttgcgggagaggaggctggagctactattgtggtggcctgaaaaatgttagggaggtgaaggggttaactaagggaggccctgggcatgaagagcccattcctatgtccacctacggatggaaccttgtccggctgcagagtggcgtggacgtattctttacaccacccgagaaatgcgatacgctcctatgtgacatcggtgaatctagccctaatccaaccattgaggccgggcgcactctgagagtgttgaacctggttgaaaattggctcaacaataacacacaattctgcatcaaggtgcttaatccctatatgccgtcagtcatagagaaaatggaaaccctgcagaggaagtacggaggcgcgttggtgcgaaaccctctgtcccggaatagtactcacgagatgtactgggtcagcaacgctacaggcaatattgtgtcttccgttaacatgatctcacgtatgctcatcaatagatttaccatgaaacacaagaaggcaacgtatgagccagatgtagacttagggagcggaacccgcaacattggtatagaaaacgagatccccaatctggacattatcggcaaaaggattgaaaagatcaaacaggagcatgaaacatcgtggcactacgatcaggaccatccttataagacttgggcctaccacgggtcttatgagaccaaacaaacaggaagtgcttccagcatggtgaacggcgtcgtgcggcttctgactaagccatgggatgttgtgcccatggtcacccagatggccatgacagacaccactccgttcggtcagcagagagtgtttaaggagaaagtagatacgcgcacacaagaacctaaggaggggaccaaaaagctaatgaggataactgcagaatggctctggaaagagctgggaaagaagaaaaccccccgaatgtgtacacgggaggaattcacgagaaaggtgaggtcaaatgccgctttgggcgcgatctttaccgacgagaacaaatggaagtccgcccgcgaagcagttgaggattctcgtttctgggaactggtcgaccgggagagaaatctccaccttgagggcaaatgcgaaacttgtgtgtacaacatgatggggaagagggagaaaaagctgggagaatttggtaaggctaaaggcagccgcgccatttggtatatgtggttaggggcacgattcctggagtttgaagccttgggattcctcaatgaggatcattggtttagtcggggcaactccctgagcggtgtggagggggaaggactacacaagcttggctacatcctgagagacgtctctaaaaaggagggcggggctatgtacgccgatgacacagcgggatgggacaccaggattactctcgaagatctgaaaaatgaggaaatggttacaaaccatatgaagggtgagcacaagaaattggcagaggccatcttcaagctgacctatcagaataaagtggtacgcgtgcagagaccaacacctcggggcactgtcatggacattatatcaaggaaggatcagcgtgggagtggacaagtgggcacctacggtctcaacacgttcaccaatatggaagctcagcttatccgacagatggagggggaaggaatttttaaatccatccaacatctgacagttactgaggagatcgccgtgcagaactggttagcacgcgtcggcagagaacggctgagcaggatggctatttctggcgacgattgcgtggtaaagcccttggacgatcgcttcgcctcggctctcaccgccctgaatgacatggggaaggttagaaaagatatacagcagtgggagccatcacggggatggaacgactggacacaagtgcccttttgcagccaccacttccatgaactagtcatgaaggatggtagggtgcttgtggtcccttgtcgaaaccaggacgagctgatcggccgtgcaagaatttcccagggggcgggatggagtctcaaagaaactgcctgcctgggcaagtcttatgctcagatgtggaccttgatgtactttcaccgccgggatttaaggctggccgcaaatgctatctgtagcgccgttccatcccattgggtgccgacgtcaagaacaacctggagtattcacgcaaaacacgagtggatgactacagaggacatgctcgccgtatggaaccgcgtgtggatccaagaaaatccctggatggaggacaagacccctgtcgaatcttgggaggaagtgccatatcttggtaagcgggaggatcagtggtgcgggagcctgataggactaacttccagggcgacctgggctaaaaacatccagacagccattaatcaggttcgatcactgatcggcaacgaggaatacacggactatatgcccagcatgaagagattccggaaagaggaagaggaagcaggcgtgctctggtga

SEQ ID NO: 14637 - RNA, 9876 nt, synthetic construct
  misc_feature 1..9876: note = derived and/or modified CDS sequence (opt3) from DENV-2__EU482562__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtgaccgaaaaggactcccctgtcaacatcgaggccgaacccccatttggagatagctacatcattataggcgtggagcctgggcagctgaaactaaattggttcaagaagggatcgtctatcggtcagatgtttgagacaactatgcgaggcgctaaacgcatggccattctcggggacaccgcatgggatttcggatccctgggcggtgtttttacatcaatcgggaaggcccttcaccaagtgttcggcgctatttacggagcggcatttagtggcgtaagctggactatgaaaatcttgataggggtcatcattacctggatcggaatgaactccagatctacgagcctgtcagtgagtctcgttctggtgggcgtcgtgattctttatctgggtgccatggtacaggctgactccgggtgtgtggttagctggaagtctaaagaattgaagtgcggatcaggcatcttcataacagataatgtccacacctggactgagcagtacaagtttcagcccgaaagtccaagcaaactcgcctccgcaattcaaaaggcccatgaggaaggtatctgtggcattaggtctgtgacacggctggagaacttaatgtggaaacagatcacccccgagctgaatcacatactatcggaaaacgaggtgaagctcactatcatgaccggggacattaaaggaatcatgcaggctggcaagcgcagcctgagacctcagccaacagaacttaaatattcctggaagacgtgggggaaggccaaaatgttgtcaaccgagagtcataatcaaactttcctgattgatggaccggaaacagcagagtgccccaacaccaatagggcgtggaactctctcgaggtcgaagactacggctttggtgttttcacaactaatatctggctgaagttacgtgagaaacaggacgtgttttgtgatagcaagctgatgtccgctgccataaaagacaaccgggcagtgcacgccgatatggggtattggattgaatcagctcttaatgacacctggaagatggagaaggccagcttcatcgaggtaaaatcttgccactggcctaagtcccatacgttgtggagtaacggagtcctcgaaagcgagatgatcattccaaaaaatttcgcaggccccgtgtctcagcacaactaccgacctggttatcatacacagaccgctggcccatggcacctggggaagctagaaatggattttgacttctgtgagggaactaccgttgtggtcacagaagattgcggcaacagagggccctccctgaggactaccacagcctcaggaaaactcatcacggagtggtgctgtcgcagttgcaccctgccgcctcttcggtacagaggcgaggacggttgttggtacgggatggaaattaggccattgaaggagaaggaagagaatctggtgaacagcttagttactgcgggacatggccaaatagataatttttcgctcggtgtgctgggcatggcccttttcctggaagagatgttgcgcacacgagtagggaccaaacacgctatcctcctggtcgcagtgtcctttgtgactctaattacaggaaacatgtctttccgggacctgggccgtgtcatggttatggtgggggccaccatgacggatgacatcggaatgggcgtaacttatctcgctctgcttgccgcatttaaggtgagacccaccttcgcggccggtttgctgttaaggaaactcacaagcaaggagctgatgatggctaccattgggatcgcccttctgtcacagagtactatacctgaaacaatcctagagctcaccgatgcactggctttgggaatgatggtcctgaaaattgtgcgcaatatggaaaagtaccagttagccgttacaatcatggcaatttcctgcgtgcccaacgccgtcatcctccaaaatgcttggaaggtgtcttgtactatactggcggccgttagcgtgtccccacttctgttgacctcaagccagcagaaagcagactggattcctctcgctctgacgatcaagggcctaaaccccacagccatctttctgaccactcttagtcggacctctaaaaagagatcctggccactcaatgaggccattatggctgtcggcatggtaagcatactggcatcgtcattgctgaaaaacgacatcccgatgacagggcctttagtggccggaggtctcctgactgtttgctatgtgcttaccggcaggtctgcggatctggaattggagcgagctgccgacgtcaagtgggaggatcaggcagaaattagtgggtccagccccatcctctctattacgatcagcgaggacggatccatgtcaataaaaaatgaagaggaggaacaaacactgaccatcctaattcgcactggcctgcttgtgatcagtggtgtattcccagtgagcattcccatcacagccgctgcatggtacctctgggaggtcaagaagcagcgggccggggttctgtgggatgtgccttctccaccccctgtgggaaaagcggaattggaggacggcgcttatagaataaagcagaggggcattttagggtactcccagatcggagccggtgtctataaagaaggcacctttcacactatgtggcatgtgacacgtggggcagttctgatgcaccgcggaaagcggatcgagccgtcatgggccgatgtaaaaaaggacctcattagttacggcggtgggtggaagctggagggagaatggaaagagggcgaagaggtgcaagtccttgctctggaaccaggcaagaaccccagagccgtgcagaccaaacctgggttgttcaagacgaatactggaaccatcggtgcagttagcctagatttttccccaggcacatctgggtcgcccatagtggacaggaaaggaaaggtcgtgggcctgtacggtaacggggtagtcacccgaagcggagcttatgtgtcagccattgcgcagacagagaagtccatcgaggataatcctgaaattgaggacgatatcttccggaaaaagcgcctcactataatggacctgcatccgggcgccggcaaaaccaagagataccttcccgcaattgttagggaagctatcaaacgggggttacgaacgctgatcctcgccccaacaagagtggtcgctgcagagatggaagaggccttgcgcggactgcctattaggtatcagactcccgccatccgtgctgagcacaccggtcgggaaattgtggacctcatgtgtcatgcgacattcaccatgagactgcttagtccagttagggtgcctaactacaacctgataatcatggatgaggcacactttactgaccccgcctctattgctgcccgcggctatatcagcacccgagtcgaaatgggggaggcagccggaatcttcatgacagctacgccaccgggctccagagatccttttccccaatcaaatgcgccaattatggacgaggaacgggagatacccgaaaggtcttggaacagcggtcacgagtgggtgactgatttcaaggggaagaccgtatggtttgtgcctagtatcaaagccggaaatgacattgcagcttgcttgcgcaagaacggcaaaaaggttatccagctatcccgtaaaacattcgatagcgaatacgtcaagaccagagccaatgactgggattttgtggtgactacagacatttctgagatgggcgcaaacttcaaggccgagcgggtcatcgatccaaggcgctgtatgaaacccgtaatactgaccgacggggaagagcgagtgatcctcgctggacctatgccggttacgcattcatccgccgcgcagagacggggtaggattggccgcaatccaaagaacgaaaatgaccaatatatctacatgggggagcccttagaaaacgatgaggactgcgcacactggaaagaggccaagatgctgcttgataatattaacactcctgaaggaatcatacccagtatgtttgagccagaaagagagaaagtggacgctattgatggcgaatacaggctgcggggtgaggcccgtaagacattcgtcgacctcatgcgccgaggggatttgcctgtgtggctggcttatagagttgcagccgagggcatcaattacgctgacaggcggtggtgttttgatggaattaaaaacaatcagatcctcgaagagaacgtggaagtcgagatatggaccaaggagggcgaacgcaagaaactgaagcccagatggcttgacgccaggatctatagcgatccactagcactgaaagagttcaaggaattcgcggccgggcggaaatcgttgaccttaaacctgattactgagatgggacgactccctacatttatgacccagaaggctagagacgccctggataatcttgcagtgctgcatacagctgaagccggtggccgcgcatacaaccacgccctctctgagttgccggagactctggaaacgctactgctccttaccctgttagctacagtaactgggggaatcttcttgtttctgatgtccggcaagggtattgggaaaatgaccctcggcatgtgctgcatcataacagcgagcattctgctttggtatgcccagatccaaccccactggatcgcagcttcaattatcctggagttctttctcatagtgttgctgattccagaacctgagaagcagaggaccccccaggacaatcagttaacttacgttgtcatcgccattctaacggtggtggccgcaaccatggctaacgaaatgggattcctggagaaaacaaagaaagacctcggccttgggagtatcactacccaagagtctgaatccaatatactggatatcgacttgcggccagccagcgcgtggacactgtatgctgtcgccaccacttttgttacacctatgctccgtcattcaattgagaacagtagcgtgaatgtatccctgacggcaatcgccaaccaggctaccgtgcttatgggactcggtaagggctggcccctgtctaagatggatattggggtcccgttgctggcaatcggatgttacagccaggtgaatccaattactttaacagccgcgctactgctccttgttgctcactacgccatcataggccctggtctgcaggcaaaagccaccagagaagctcaaaagagggccgcagctgggattatgaaaaaccccaccgtggacggcatcacagtcatcgatttggagccaattccctatgaccctaagttcgaaaaacagctgggacaggtaatgctcctgatactttgcgtgactcaggttttaatgatgcgcacgacctgggccctgtgtgaggcgctcacattggccactggcccgatctccaccctgtgggaggggaatcccggacggttttggaacacaaccattgcagtgtcaatggctaatatcttccgaggctcttacctagccggtgcagggctgctctttagtattatgaagaacactacgaatacaagaaggggaaccggcaacatcggtgaaactcttggcgagaagtggaaatcgcgcctgaatgctttggggaagagcgaattccaaatatataaaaagtccggaatccaggaggtcgatcggaccctggccaaagagggcattaagagaggggaaacagaccatcacgccgtgtctcgtggatcagcgaaactcaggtggtttgtcgagcggaacatggtgactccagaaggcaaggttgtggatctgggttgcgggcgcggaggctggagctactattgtggtggcttaaagaacgtacgagaggtgaaagggcttaccaagggaggccctgggcatgaagagcccatccctatgtccacatacggatggaatctggtcagactccagagtggcgttgacgtgttcttcacgccacccgagaaatgcgataccctactgtgtgacattggtgaatctagccctaacccaactatcgaggctgggaggacattgcgggtcctgaatctcgtggaaaactggcttaataacaatacccaattttgcataaaggtactgaacccctatatgccgtcagtgattgagaaaatggaaactttgcagcgcaagtacggaggcgcactggttagaaatcctctctccaggaacagtacacacgagatgtactgggtgagcaatgccaccggcaacatcgtctcttccgtgaatatgatctcacgaatgttaattaaccggttcacgatgaagcacaaaaaggctacctatgagccagatgtcgacctggggagcggaacacgtaatataggtatcgaatcggagattcccaaccttgacatcattggcaaaagaatcgaaaagataaaacaggagcatgaaacttcttggcactacgatcaggaccatccttataagacctgggcctaccacgggagttatgagacaaagcaaactggatccgcaagctttatggtgaacggcgttgtacgcctgctaaccaaaccatgggatgtggtccccatggtgacacagatggccatgaccgacactacgccgttcggtcagcagagggtttttaaggagaaagtggatacacggacccaagaacctaaggaggggactaaaaagctcatgaagatcaccgctgaatggctgtggaaagagttgggaaagaaaaagacacccagaatgtgtacgcgcgaggaattcaccaggaaagtccgatcaaatgcggccctgggcgcaatttttactgacgagaacaagtggaaatccgctcgggaagccgtggaggattctagattctgggaactcatcgacagggagcgcaatcttcacctggagggcaagtgcgaaacatgtgtatacaacatgatggggaagcgtgagaaaaagttaggagaatttggtaaagcaaagggcagccgggccatttggtatatgtggctgggggctagattcttggagtttgaagccctcggattcctgaatgaggatcattggtttagtaggggcaactccctaagcggtgtggagggggaaggacttcaccgcctgggctacatcctccgagacgtttctaaaaaggagggcggggcgatgtacgcagatgacaccgccggatgggacactcggattacactggaagatttgaagaatgaggaaatggtcaccaaccatatgaaaggtgagcacaagaaactggctgaggccatattcaagctcacatatcagaataaagtggtgagagtccagaggccaactcctcgcggcaccgttatggacatcatttcaagacgggatcagagggggagtggacaagtgggcacgtacggtcttaacaccttcacaaatatggaagcacagctgatccgtcagatggagggggaaggaatctttaagtccattcaacatttaactgtaaccgaggagatagctgtgcagaactggctggcccgagtcggccgcgaaagattgagccggatggctatctctggcgacgattgcgtggttaagcccctcgacgataggttcgcctcggcactgacagcgctaaatgacatggggaaagtgcgcaaggatattcagcagtgggagccatcaagaggatggaacgactggactcaagtccccttttgcagccaccacttccatgaacttgtgatgaaagatggtcgggtactggttgtgccttgtaggaatcaggacgagctcatcggccgagcccgtatttcccagggggctggatggagtctgaaggaaaccgcctgcttgggcaaatcttatgcacagatgtggacgttaatgtactttcacagacgcgatctgcggctcgctgccaacgcaatctgtagcgccgtcccatcccattgggtgccgacatcaaggaccacttggagtatacacgcgaagcacgagtggatgacaaccgaggacatgcttgctgtgtggaacagagtctggatccaagaaaatccctggatggaggacaagactcctgttgaatcttgggaggaagtgccatatctgggtaaacgcgaggatcagtggtgcgggagcctaattggactgacctcccgggccacatgggcaaagaacatccagacggccattaatcaggtaaggtcactcatcggcaacgaggaatacaccgactatatgcccagcatgaaacgattcagacgggaggaagaggaagctggcgtgttgtggtga

SEQ ID NO: 14638 - RNA, 9876 nt, synthetic construct
  misc_feature 1..9876: note = derived and/or modified CDS sequence (opt3) from DENV-2__EU482565__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatattctgggccggttaatcacggttaacccgatcgtgaccgaaaaggactcccctgtcaacattgaggccgaacccccatttggagatagctacataatcattggcgtggagcctgggcagctgaaactaaattggttcaagaagggatcgtctatcggtcagatgtttgagacaactatgcgaggcgctaaacgcatggccattctcggggacaccgcatgggatttcggatccctgggcggtgtctttacatcaatcgggaaggcccttcaccaagtgttcggcgctatatacggagcggcatttagtggcgttagctggactatgaaaatcttgattggggtgatcattacctggatcggaatgaactccagatctacgagcctgtcagtaagtctcgtcctggtgggcgttgtgacactttatctgggtgtcatggtgcaggccgactccgggtgtgtagtgagctggaagaataaagaattgaagtgcggatctggcatattcattaccgataacgttcacacttggacagagcagtacaagtttcagcccgaatcaccacccaaactcgctagtgccatccaaaaggcacatgaggaaggtatttgtggcatcaggagcgtcacccggctggagaatttaatgtggaaacagataactcctgagctgaaccacatcctatccgaaaatgaggtgaagctcaccattatgacaggggacatcaaaggaattatgcaggccggcaagcgctctctgagaccacagccgacggaacttaaatattcgtggaagacctgggggaaggctaaaatgttgagcactgagtcccataaccaaacattcctgatcgatggacccgaaaccgccgagtgccctaatacaaacagggcatggaattcactcgaggtggaagactacggctttggtgtcttcagtactaacatatggctgaagttacgtgagaaacaggacgttttttgtgattctaagctgatgagcgcggctattaaagacaatcgggccgtgcacgcagatatggggtattggatcgaatccgcccttaacgacacctggaagatggagaaggcttcattcatcgaggtgaaaagctgccactggccaaagtctcatacgttgtggtccaatggagtactcgaaagtgagatgattatccccaaaaacttcgccggccctgtcagccagcacaactaccgaccaggttatcatacacagaccgcaggcccctggcacctggggaagctagaaatggattttgacttctgtgagggaactaccgtggttgtgacagaagattgcggcaatagagggccgtctctgaggactaccacagcttccggaaaactcattacggagtggtgctgtcgctcatgcaccctgcctccacttcggtacagaggcgaggacggttgttggtacgggatggaaataaggcccttgaaggagaaggaagagaacctggtcaatagtttagtgactgccggacatggccaaatcgataactttagcctcggtgttctgggcatggcgcttttcctggaagagatgttgcgcacacgagtggggaccaaacacgccattctcctggtagctgtctcgtttgtgactctaatcacaggaaatatgtccttccgggacctgggccgtgtgatggtcatggttggggcaaccatgacggatgacattggaatgggcgtgacttatctcgccctgcttgctgcctttaaggtaagacctaccttcgcagcgggtttgctgttaaggaaactcacatctaaggagctgatgatggccaccatcgggatagctcttctgagccagtcaactatccccgaaacaattctagagctcaccgatgccctggcattgggaatgatggtgctgaaaatcgtccgcaacatggaaaagtaccagttagctgtgacaattatggccatcagttgcgttccaaatgcagtgatactccaaaacgcctggaaggtctcctgtactattctggctgcggtgtctgttagccctcttctgttgacctcctcacagcagaaagccgactggatccccctcgcactgacgatcaagggcctaaatccaacagctatttttctgaccactcttagccggaccagtaaaaagagatcttggccgctcaacgaggccgtgatggccgtcggcatggtatccatactggctagctcgttgctgaaaaatgacatccctatgacagggcccttagtggcaggaggtctcctgactgtttgctatgtgcttaccggcaggtcagccgatctggaattggagcgagcggctgacgtcaagtgggaggatcaggccgaaatttctgggagttccccaatcctcagcattacgatctctgaggacggaagcatgtccataaaaaacgaagaggaggaacacacactgaccatcctaattcgcactggcctgcttgtgatctcaggtgtattccccgtgagtattcctatcacagcagccgcttggtacctctgggaggtcaagaagcaacgggcaggggttctgtgggatgtgccaagcccccctccggtgggaaaagccgaattggaggacggcgcgtatagaataaagcagaggggcatttttgggtactctcagatcggagctggtgtctataaagaaggcaccttccatactatgtggcacgtgacacgtggggccgttttaatgcatcgcggaaagcggatcgagccatcctgggcagatgtaaaaaaggacctgatttcatacggcggtgggtggaagctcgagggagaatggaaagagggcgaagaggtgcaggtcctggcccttgaacccggcaagaatcctagagctgtgcaaaccaaaccagggctgtttaagacgaacactggaaccatcggtgccgttagtttggatttcagccccggcacatccgggtctcctatagtggacaggaaaggaaaggtcgtgggcctatacggtaatggggtagtcacccgatcgggagcatatgtgagcgctattgcccagacagagaagtcaatcgaggataacccggaaattgaggacgatatcttccggaaaaagcgcctgactataatggacctccaccccggcgcgggcaaaaccaagagatacctgccagccattgttagggaagcaatcaaacgggggcttcgaacgttaatcctggctcctacaagagtggtcgccgctgagatggaagaggcactccgcggattgcccattaggtatcagactccagccatccgtgccgagcataccggtcgggaaattgtggacctgatgtgtcacgctacatttaccatgagactcctgtcccctgttagggtgcccaactacaatcttataatcatggatgaggcgcacttcactgacccagcaagtattgccgctcgcggctatatctctacccgagtcgaaatgggggaggccgcaggaatctttatgacagccacgccgcctggcagcagagatcccttcccacagtccaacgctcccattatggacgaggaacgggagatacctgaaaggtcatggaattctggtcatgagtgggtgactgattttaaggggaagaccgtatggttcgtgccaagcatcaaagcgggaaacgacattgccgcatgcctgcgcaagaatggcaaaaaggttatccaattgagtcgtaaaacatttgattccgaatacgtcaagaccagagctaacgactgggatttcgtggtgactacagacattagcgagatgggcgccaattttcgggcagagagggtcatcgatccccgccgatgtatgaagcctgtaatactaaccgacggggaagagagagtgatcctggccggaccgatgccagttacgcactcttcagctgcccagcggaggggtcgcattggcagaaaccccaaaaatgaaaacgaccagtatatctacatgggggagcctctcgaaaatgatgaggactgcgcgcattggaaggaggcaaaaatgttactggataacattaatactcccgaaggaatcataccatccatgttcgagcctgaaagggagaaggtggacgccattgatggcgaataccggcttcgtggtgaggctcgcaaaacatttgtcgacctgatgcgaagaggggatctccccgtgtggttggcctatagggttgctgcagagggcatcaactacgccgaccggcgctggtgtttcgatggaattaagaataaccaaatcctggaagagaacgtggaagtcgagatatggaccaaagagggcgaaagaaagaagctcaaaccaaggtggctggacgctcggatctatagtgatcctcttgccctaaaggagttcaaagaatttgcagcggggcgaaagagcctgaccttgaatttaattactgagatgggaagactgccgacattcatgacccagaaagcccgcgacgctctcgataacctggccgtgcttcacacagcagaagtaggtggcagggcttacaatcacgccctgtcggagctccccgagactttggaaacgctgctactgctcacccttctggcaacagtgactgggggaatctttttattcttgatgtctggcaagggtattgggaagatgaccctgggcatgtgctgcatcataacagcctccattctcctgtggtatgctcagatccagccacattggatcgcggccagcattatccttgagtttttcctgatagttctcttgattcctgaacccgagaaacaacggaccccacaggacaaccagctgacttacgtcgtgatcgcaattttaacggtggtcgctgccaccatggccaatgaaatgggatttctagagaagacaaaaaaggacctgggcctcgggtcaatcactacccaggagcctgaaagtaacatacttgatatcgacctgcgtcccgcatctgcttggacattgtatgccgttgcgaccactttcgtgacaccgatgctgagacactccattgagaatagctcagtaaacgtgagtctcacggctatcgccaatcaagcaaccgtcctgatgggacttggtaggggctggccactcagcaaaatggatattggggtgcctctgttggccatcggatgttactcccaggttaaccccattactctgacagctgcattactactgctcgtggcccattacgcgatcataggcccaggtcttcaggctaaggccacccgcgaagcacagaagcgggccgctgccgggattatgaaaaatcccaccgtcgacggcatcacagtaatcgatctggagcctattccgtatgaccccaagtttgaaaaacaattgggacaggtgatgctgctcgttctgtgcgtgactcaggtccttatgatgcgaacgacctgggcattatgtgaggctctgacactcgccactggcccaatatctaccttgtgggaggggaaccctggaagattctggaatacaaccatcgcggtgagcatggccaacatttttaggggctcctacctggcaggtgctgggctactgttctcaatcatgaagaatactacgaacacacgccggggaaccggcaatattggtgaaactctcggcgagaaatggaagtctagacttaacgccctggggaagagtgaatttcagatctataaaaagtcgggaatacaagaggtcgatcgtaccttggcaaaagagggcatcaagaggggggaaacagaccaccatgctgtgagccggggatccgccaaactgcgctggttcgttgagcgaaacatggtgactcccgaaggcaaggtagtggatctcggttgcgggagaggaggctggtcttactattgtggtggcctgaaaaatgtcagggaggttaaggggttaaccaagggaggccctgggcacgaagagccaattcccatgtcaacatacggatggaaccttgtgcggctgcagagcggcgtcgacgtgttctttacgcctccagagaaatgcgataccctcctatgtgacatcggtgaatccagtcccaatccgactattgaggccgggcgcacactgagagtattgaacctggtggaaaattggctcaacaataacacccagttctgcatcaaggttcttaatccttatatgccatctgtgatagagaaaatggaaactctgcaaaggaagtacggaggcgcgttggtccgaaaccccctgagccggaattcaacacacgagatgtactgggtgtccaacgctaccggcaatattgtcagtagcgtgaacatgatctctcgtatgctcatcaatagatttacgatgaaacataagaaggcaacctatgagcctgatgttgacttagggtccggaacacgcaacgtaggtattgaaaacgagataccaaatctggacatcattggcaaaaggatcgaaaagattaaacaggagcacgaaacttcatggcattacgatcaggaccacccctataagacctgggcctaccacgggagctatgagacaaaacagactggatcggcttctagtatggtgaacggcgtcgtgcggcttctgaccaagccgtgggatgttgtgcctatggtcacacaaatggccatgaccgacactacgcccttcggtcagcagagagtgtttaaggagaaagtagatacacgcacccaggaaccaaaggaggggactaaaaagctaatgaggatcaccgcagaatggctctggaaagagctgggaaagaagaaaacacctcgaatgtgtacgcgggaggaattcaccagaaaggtgaggtccaatgccgctttgggcgcgatatttactgacgagaacaaatggaagagcgcccgcgaagcagttgaggattcacgtttctgggaactggtcgaccgggagagaaatctccatcttgagggcaaatgcgaaacatgtgtgtacaacatgatggggaagagggagaaaaagctgggagaatttggtaaggctaaaggctcccgcgccatctggtatatgtggttaggggcacgattcctggagtttgaagccttgggattcctcaatgaggatcactggttttctcggggcaacagcctgagtggtgtggagggggaaggactacataagcttggctacattctgagagacgtctccaaaaaggagggcggggctatgtacgccgatgacaccgcgggatgggacactaggatcacactcgaagatctgaaaaatgaggaaatggttaccaaccacatgaagggtgagcataagaaattggcagaggccattttcaagctgacatatcaaaataaagtggtacgcgtgcagagacccactccacggggcaccgtcatggacatcattagcaggaaggatcagcgtgggtctggacaggtgggcacgtacggtctcaacaccttcacaaatatggaagctcaacttatacgacagatggagggggaaggaatctttaaatcaattcagcgcctgactgttaccgaggagatcgccgtgcaaaactggttagcaagagtcggccgggaaaggctgagtcgcatggctatctccggcgacgattgcgtggtaaagcccttggacgatagattcgccagcgctctcacagccctgaatgacatggggaaggttcggaaagatattcagcagtgggagccttctaggggatggaacgactggactcaggtgccattttgctcgcaccacttccatgaactagtcatgaaggatggtcgagtgcttgtggtcccgtgtcgtaaccaagacgagctgataggcagagcacgcatctcacagggggcgggatggagcctcaaagaaaccgcctgcctgggcaagtcctatgctcagatgtggacgttgatgtactttcaccggagggatttaagactggccgcaaatgctatttgtagtgccgttccctctcattgggtgcctacaagccgcaccacttggtccatccacgcaaaacacgagtggatgacaaccgaggacatgctcgccgtatggaaccgggtgtggattcaggaaaatccatggatggaggacaagactcccgtcgaatcatgggaggaagtgccttatcttggtaagagggaggatcaatggtgcgggagtctgatcggactaacctctcgagcgacatgggctaaaaacatacagacggccatcaatcaggttagaagcctgattggcaacgaggaatacaccgactatatgccatccatgaagcggttcaggaaagaggaagaggaagcaggcgtgctctggtga

SEQ ID NO: 14639 - RNA, 9876 nt, synthetic construct
  misc_feature 1..9876: note = derived and/or modified CDS sequence (opt3) from DENV-2__EU529700__SS-prME
  source 1..9876: mol_type = other RNA
accgccggcgtgatcattatgctgatacccacagctatggcattccacctcactacgaggaacggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggattctgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggattattcggcaagggcgggattgtcacatgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctgactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgaggtaaaatcttgccactggcctaagtcccatacgttgtggagtaatggagtcctcgaaagcgagatgatcattcccaaaaacttcgccggccccgtgtctcagcacaactaccgacctggttatcatacacagaccgcaggcccatggcacctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtacgggatggaaattaggccattgaaggagaaggaagagaacctggtgaatagcttagttactgccggacatggccaaatagataacttttcgctcggtgtgctgggcatggcgcttttcctggaagagatgttgcgcacacgagtagggaccaaacacgccatcctcctggtcgctgtgtcctttgtgactctaattacaggaaatatgtctttccgggacctgggccgtgtcatggttatggtgggggcaaccatgacggatgacatcggaatgggcgtaacttatctcgccctgcttgctgcctttaaggtgagacccaccttcgcagcgggtttgctgttaaggaaactcacaagcaaggagctgatgatggccaccattgggatcgcacttctgtcacagagtactatacctgaaacaatcctagagctcaccgatgccctggcattgggaatgatggtcctgaaaattgtgcgcaacttagaaaagtaccagctcgctgttacaatcatggccatttcctgcgtgcccaatgcagtcatcctgcaaaacgcctggaaggtgtcttgtactatacttgctgcggttagcgtgtccccactgttgctcacctcaagccagcagaaagccgactggattcctctggcactaacgatcaagggcctgaatcccacagctatctttcttaccactctcagtcggacctctaaaaagagatcctggccactgaacgaggccgtcatggccgtaggcatggtgagcattttggcttcgtcactgctcaaaaatgacataccgatgacagggcctctagttgcaggaggtctgcttactgtgtgctatgtcctgaccggcaggtctgccgatttggaactcgagcgagcggctgacgtgaagtgggaggatcaggccgaaatcagtgggtccagccccattctgtctatcacgattagcgaggacggatccatgtcaatcaaaaacgaagaggaggaacaaacactaaccatactgatccgcactggccttctcgtaattagtggtgtgttcccagtcagcatccccattacagcagccgcttggtacctgtgggaggttaagaagcagcgggcaggggtgttgtgggatgtgccttctccaccccctgtcggaaaagccgaattagaggacggcgcgtatagaatcaagcagaggggcatatttgggtactcccagattggagctggtgtgtataaagaaggcaccttccacactatgtggcatgttacacgtggggccgtactgatgcaccgcggaaagcggatcgagccgtcatgggcagatgtgaaaaaggacctcatcagttacggcggtgggtggaagctggagggagaatggaaagagggcgaagaggtccaagtgcttgccctggaaccaggcaagaatcccagagctgttcagaccaaacctgggttgtttaagacgaacactggaaccattggtgccgtgagcctagatttctccccaggcacatctgggtcgcccatcgtcgacaggaaaggaaaggtggtaggcctgtacggtaatggggtcgtgacccgaagcggagcatatgtttcagctatagcccagacagagaagtccattgaggataaccctgaaatcgaggacgatattttccggaaaaagcgcctcactatcatggacctgcatccgggcgcgggcaaaaccaagagataccttcccgccatagtgagggaagcaattaaacgggggttacgaacgctgatcctcgctccaacaagagtcgtggccgctgagatggaagaggcattgcgcggactgcctatcaggtatcagactcccgccattcgtgccgagcacaccggtcgggaaatcgttgacctcatgtgtcatgctacatttaccatgagactgcttagtccagtgagggtccctaactacaatctgattataatggatgaggcgcacttcactgaccccgcatctatcgccgctcgcggctatattagcacccgagtggaaatgggggaggccgcaggaatctttatgacagccacgccaccgggctccagagatcctttcccccaatcaaacgctccaatcatggacgaggaacgggagattcccgaaaggtcttggaatagcggtcacgagtgggtaactgattttaaggggaagaccgtgtggttcgttcctagtataaaagcgggaaacgacatcgccgcatgcttgcgcaagaatggcaaaaaggtcattcagctatcccgtaaaacatttgatagcgaatacgtgaagaccagagctaacgactgggatttcgtggtcactacagacatctctgagatgggcgccaattttcgggcagagagggtaattgatccacgccgatgtatgaagcccgtgatcctgaccgacggggaagagagagttatactcgccggacctatgccggtgacgcattcatccgctgcccagcggaggggtcgcatcggcagaaaccccaaaaatgaaaacgaccaatatatttacatgggggagcccttagaaaatgatgaggactgcgcgcactggaaggaggcaaaaatgctgcttgataacatcaatactcctgaaggaattatccccagtatgttcgagccagaaagggagaaggtcgacgccatagatggcgaataccggctgcgtggtgaggctcgcaaaacatttgtggacctcatgcgaagaggggatttgcctgtttggctggcctatagggtggctgcagagggcattaactacgccgaccggcgctggtgtttcgatggaatcaagaataaccagattctcgaagagaacgtcgaagtggagatctggaccaaagagggcgaaagaaagaagctgaaacccaggtggcttgacgctcggatatatagcgatccactagccctgaaggagttcaaagaatttgcagcggggcgaaagtcgttgaccttaaatctgatcactgagatgggaagactccctacattcatgacccagaaagcccgcgacgctctggataaccttgccgtactgcatacagcagaagtgggtggcagggcttacaatcacgccctctctgagttgccggagactctggaaacgctactgctccttaccctgttagcaacagttactgggggaatatttttgttcctgatgtccggcaagggtatcgggaagatgaccctcggcatgtgctgcattatcacagccagcatactgctttggtatgctcagattcaaccccactggatcgcggcctcaatcattctggagtttttcctcatcgtcttgctgataccagaacctgagaaacagcggaccccacaggacaaccagttaacttacgtggtgattgcaatcctaacggtcgttgctgccaccatggccaatgaaatgggatttctggagaagaccaaaaaggacctcggccttgggagtattactacccaagagtctgaatccaacatcctggatatagacttgcgtccagcaagcgcttggacactgtatgccgtggcgaccactttcgtaacacctatgctcagacattcaatcgagaatagtagcgtgaacgtctccctgacggctattgccaatcaggcaaccgtgcttatgggactcggtaggggctggcccctgtctaaaatggatatcggggttccgttgctggccattggatgttacagccaggtgaacccaatcactttaacagctgcactactgctccttgtcgcccactacgcgattatcggccctggtctgcaggctaaggccacccgcgaagcacaaaagcgggccgctgccgggataatgaaaaatcccaccgtagacggcattacagtgatcgatttggagccaatcccctatgaccctaagtttgaaaaacagctgggacaggttatgctcctggtgctttgcgtcactcaggtgttaatgatgcgaacgacctgggcactgtgtgaggctctcacattggccactggcccgatttccaccctgtgggaggggaaccccggaagattctggaatacaaccatagcggtctcaatggccaacatctttaggggctcttacctagctggtgctgggctactcttcagtattatgaagaatactacgaacacacgccggggaaccggcaatatcggtgaaactcttggcgagaaatggaagtcgagactgaacgccttgggaaagagcgaatttcaaatttataaaaagtccggaatccaggaggtggatcgtaccctggcaaaagagggcataaagagaggggaaacagaccatcacgctgtttctcggggatcagccaaactccgctggttcgtggagcgaaacatggtaactccagaaggcaaggtggtcgatctgggttgcgggagaggaggctggagctactattgtggtggccttaaaaatgttagggaggtgaaggggctaaccaagggaggccctgggcatgaggaaccaatccctatgtccacatacggatggaacctggtccggctccagagtggcgtggacgtattctttacgccacccgagaaatgcgataccctactgtgtgacattggtgaatctagccctaatccaactatcgaggccgggcgcacattgagagtgctgaacctcgttgaaaattggcttaacaataacacccaattctgcattaaggtgctgaatccctatatgccgtcagtcatcgagaaaatggaaactttgcagaggaagtacggaggcgcgctggtgcgaaaccctctctcccggaatagtacacacgagatgtactgggtcagcaacgctaccggcaatatagtgtcttccgttaacatgatttcacgtatgttaatcaatagatttacgatgaaacacaagaaggcaacctatgagccagatgtagacctggggagcggaacacgcaacatcggtattgaaaacgagatacccaatcttgacatcattggcaaaaggatcgaaaagattaaacaggagcatgaaacttcgtggcactacgatcaggaccatccttataagacctgggcctaccacgggtcttatgagacaaaacaaactggaagtgcttccagcatggtgaacggcgtcgtgcggctgctaaccaagccatgggatgttgtgcccatggtcacacagatggccatgaccgacactacgccgttcggtcagcagagagtgtttaaggagaaagtagatacacgcacccaagaacctaaggaggggactaaaaagctcatgaggatcaccgcagaatggctgtggaaagagttgggaaagaagaaaacaccccgaatgtgtacgcgggaggagttcaccagaaaggtgaggtcaaatgccgctctgggcgcgatatttactgacgagaacaaatggaagtccgcccgcgaagcagttgaggattctcgtttctgggaactcgtcgaccgggagagaaatcttcacctggagggcaaatgcgaaacatgtgtgtacaacatgatggggaagagggagaaaaagttaggagaatttggtaaggctaaaggcagccgcgccatctggtatatgtggctgggggcacgattcttggagtttgaagccctcggattcctgaatgaggatcattggtttagtcggggcaactccctaagcggtgtggagggggaaggacttcacaagctgggctacattctcagagacgtctctaaaaaggagggcggggctatgtacgccgatgacaccgcgggatgggacactaggatcacactggaagatttgaaaaatgaggaaatggttaccaaccatatgaagggtgagcacaagaaactggcagaggccattttcaagctcacatatcagaataaagtggtacgcgtgcagagaccaactcctcggggcaccgtcatggacatcatttcaaggaaggatcagcgtgggagtggacaagtgggcacgtacggtcttaacaccttcacaaatatggaagctcagctgatacgacagatggagggggaaggaatctttaaatccattcaacatttaactgttaccgaggagatcgccgtgcagaactggctggcacgcgtcggcagagaacggttgagcaggatggctatctctggcgacgattgcgtggtaaagcccctcgacgatcgcttcgcctcggctctgacagccctaaatgacatggggaaggttagaaaagatattcagcagtgggagccatcacggggatggaacgactggactcaagtgcccttttgcagccaccacttccatgaacttgtcatgaaggatggtagggtgctggtggtcccttgtcgaaaccaggacgagctcataggccgtgcaagaatctcccagggggcgggatggagtctgaaagaaaccgcctgcttgggcaagtcttatgctcagatgtggacgttaatgtactttcaccgccgggatctgaggctcgccgcaaatgctatttgtagcgccgttccatcccattgggtgccgacatcaagaaccacttggagtatccacgcaaaacacgagtggatgacaaccgaggacatgcttgccgtatggaaccgcgtgtggattcaagaaaatccctggatggaggacaagactcctgtcgaatcttgggaggaagtgccatatctgggtaagcgggaggatcagtggtgcgggagcctaatcggactgacctccagggcgacatgggctaaaaacatacagacggccatcaatcaggttcgatcactcattggcaacgaggaatacaccgactatatgcccagcatgaagagattccggaaagaggaagaggaagcaggcgtgttgtggtga

SEQ ID NO: 14640 - RNA, 9876 nt, synthetic construct
  misc_feature 1..9876: note = derived and/or modified CDS sequence (opt3) from DENV-2__EU529701__SS-prME
  source 1..9876: mol_type = other RNA
accgcaggagtgatcattatgctgatacccacagctatggcattccacctcactacgcggaacggggagcctcatatgatcgtcggaaggcaggaaaagggtaaaagccttctgtttaagaccgaggacggagttaatatgtgcacattgatggccatggatttaggggaactgtgtgaggacactattacctacaaatgcccactactccggcaaaacgaaccggaggatatcgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggattgagacctggatcctgcggcatcctggcttcacaataatggccgcaatcttggcctacaccattggcacgactcactttcagcgcgctctcatcttcattctgctgacagcagttgccccatccatgaccatgagatgcatcgggatatctaacagggattttgtggaaggagtctcgggtggctcatgggtggacattgtactcgagcacgggagctgtgttactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttctatgcaagcattctatggtggatagaggctggggtaacgggtgtggactcttcggcaagggcgggatcgtaacctgcgccatgtttacatgcaaaaagaatatggaaggaaaagtggtgcagcctgagaacctggaatacaccatcgtcattactccacacagcggtgaggagcatgctgttggcaatgacacggggaagcacggaaaagaaataaagatcacaccgcagtcctcaattaccgaggccgaacttactggctatggtaccgtgacaatggagtgtagtcccaggaccgggctggatttcaacgaaatggtattgctccaaatggaggacaaagcatggctggtgcaccggcagtggtttttagatctgcctctcccatggcttcccggcgctgacactcagggaagcaattggatccagaaggagacactggtcacgttcaagaaccctcatgccaaaaagcaagacgtggttgtgttgggctctcaggaaggggcgatgcacaccgccctaactggagcaacagagatacagatgtcctcaggtaatctgctctttaccggccatctgaaatgccgtcttcgcatggataagctgcaattgaaagggatgagctacagtatgtgtacaggaaagttcaagattgtcaaagaaatcgctgagactcagcacggcaccatcgtgattagagtacagtatgagggtgacgggtctccatgcaagatccccttcgaaattatggatctcgagaaaaggcatgttctgggccggttaataacggtgaacccgatcgtcaccgaaaaggactcccctgtgaacattgaggccgaacccccatttggagatagctacatcatcattggcgtcgagcctgggcagctgaaactaaattggttcaagaagggatcgtctataggtcaaatgtttgagacaactatgcgaggcgctaaacgcatggccatcctcggggacaccgcatgggatttcggatccctgggcggtgtgtttacatcagttgggaaggcccttcaccaggtgttcggcgctatttacggagcggcatttagtggcgtaagctggactatgaaaatcttcattggggtcatcataacctggatcggaatgaactccagatctacgagcttgtcagtgagtctggttctcgtgggcgtcgtgacactgtatcttggtgccatggtacaggctgactccgggtgtgtggttagctggaagaataaagaactgaagtgcggatctggcatttttatcaccgataacgtccacacttggacagagcagtacaagttccaacccgaatcaccaagtaaattggccagcgcaattcagaaggcccatgaggaaggtatctgtggcataaggtccgtgacccggctcgagaatctgatgtggaaacagattactcccgagttaaaccacatcctgtctgaaaatgaggtgaagctaaccattatgacaggggacatcaaaggaataatgcaggctggcaagcgctcgctcagacctcaaccaacggaactgaaatatagctggaagacctgggggaaggccaaaatgctttccactgagtcacataaccagacatttttgatcgatggaccggaaaccgcagagtgccccaatacaaacagggcgtggaatagtctggaggtcgaagactacggcttcggtgtttttactaccaacatttggctcaagctgcgtgagaaacaggacgtgttctgtgattctaagttaatgagcgctgccatcaaagacaatcgggcagtgcacgccgatatggggtattggattgaatccgctctgaacgacacgtggaagatggagaaggcctcattcatcgaggtaaaaagctgccactggcctaagtctcatacactttggtccaatggagtcttggaaagtgagatgataattcccaaaaattttgcaggccccgtgagccagcacaactaccgacctggttatcatacccaaactgctggcccatggcacctcgggaagctggaaatggatttcgacttttgtgagggaaccacagttgtggtcactgaagattgcggcaatagagggccctctctaaggaccacaacggcctccggaaaactgatcaccgagtggtgctgtcgctcatgcactctcccgcctctgcggtacagaggcgaggacggttgttggtacgggatggaaatcaggccacttaaggagaaggaagagaacttggtgaatagtctggttacagcgggacatggccagattgataacttcagcttaggtgtgctcggcatggccctgtttcttgaagagatgctgcgcacccgagtagggactaaacacgctatcttgctcgtcgcagtgtcgttcgtgacactgattaccggaaatatgtcctttcgggacctaggccgtgtcatggttatggtgggggccacgatgactgatgacataggaatgggcgtaacctatctggctctcctggccgcattcaaggtgagacccacatttgcggccggtcttttgctgaggaaattaacctctaaggagctcatgatggctactatcgggattgccctgcttagccagtcaacaatccctgaaaccattctggagctaacagatgcactcgctctgggaatgatggtcttgaaaatcgtgcgcaacatggaaaagtaccaactggccgttactataatggcaatcagttgcgtgcccaatgccgtcattttacagaacgcttggaaggtgtcctgtaccatcctcgcggccgtttctgtgagcccactgcttctgacgtcctcacagcagaaagcagactggattcctttggctctcacaatcaagggcctgaatcccaccgccatattcctaactaccctgagccggacaagtaaaaagagatcttggccacttaacgaggccattatggctgtcggcatggtatccatcctcgcaagctcgctgttgaaaaatgacatcccgatgactgggcctctggtggccggaggtttactcaccgtttgctatgtgctgacgggcaggtcagcggatcttgaactggagcgagctgccgacgtcaagtgggaggatcaagcagaaatttctgggagttcccccatattgagcatcacaatttctgaggacggaagcatgtccatcaaaaacgaagaggaggaacagaccctcactattctgatccgcacaggcctactggtgatatcaggtgtatttccagtgagtatccccattaccgccgctgcatggtacctttgggaggtcaagaagcagcgggccggggttctctgggatgtgcctagcccaccccctgtgggaaaagcggaactggaggacggcgcttatagaatcaagcagaggggcattttggggtactctcaaatcggagccggtgtctataaagaaggcactttccacacaatgtggcatgtgacccgtggggcagttttaatgcaccgcggaaagcggatagagccgtcctgggccgatgtcaaaaaggacctgatttcatacggcggtgggtggaagctcgagggagaatggaaagagggcgaagaggtgcaggtcctggctcttgaaccaggcaagaatcccagagccgtgcagacgaaacctgggctgtttaagactaacaccggaacaatcggtgcagttagtttggatttcagcccaggcacctccgggtctcccatcgtggacaggaaaggaaaggtcgtgggcctatacggtaatggggtagtcacacgatcgggagcttatgtgagcgccattgcgcagactgagaagtcaatcgaggataaccctgaaatagaggacgatattttccggaaaaagcgcctgaccatcatggacctccatccgggcgccggcaaaacgaagagatacctgcccgcaattgttagggaagctatcaaacgggggcttcgaacattaatactggccccaactagagtggtcgctgcagagatggaagaggccctccgcggattgcctattaggtatcaaacccccgccatccgtgctgagcacacaggtcgggaaatcgtggacctgatgtgtcatgcgacctttactatgagactcctgtccccagttagggtgcctaactacaatcttattatcatggatgaggcacacttcaccgaccccgccagtattgctgcccgcggctatatatctacacgagtcgaaatgggggaggcagccggaatctttatgacggctactccaccgggcagcagagatcctttcccccagtccaacgcgccaattatggacgaggaacgggagatccccgaaaggtcatggaactctggtcacgagtgggtgaccgattttaaggggaagacagtatggttcgtgcctagcatcaaagccggaaacgacattgcagcttgcctgcgcaagaatggcaaaaaggttatacagttgagtcgtaaaacctttgattccgaatacgtcaagactagagccaacgactgggatttcgtggtgacaaccgacatcagcgagatgggcgcaaattttaaggccgagcgggtcattgatccaaggcgctgtatgaaacccgtaatcctaacggacggggaagaacgagtgattctggctggacctatgccggttactcattcttcagccgcgcaaagacggggtaggatcggccgcaacccaaagaatgaaaacgaccagtatatatacatgggggagcccctcgaaaatgatgaggactgcgcacactggaaagaggccaagatgttactggataacatcaatacacctgaaggaattatcccctccatgttcgagccagaaagagagaaagtggacgctattgatggcgaatacaggcttcggggtgaggcccgtaagacctttgtcgacctgatgcgccgaggggatctccctgtgtggttggcttatagagttgcagccgagggcatcaactacgctgacaggcggtggtgtttcgatggaatcaaaaataaccagattctggaagagaacgtggaagtcgagatctggaccaaggagggcgaacgcaagaaactcaagcccagatggctggacgccaggatttatagtgatccacttgcactaaaagagttcaaggaatttgcggccgggcggaaaagcctgactttgaatttaatcacagagatgggacgactgcctaccttcatgacacagaaggctagagacgccctcgataacctggcagtgcttcatactgctgaagccggtggcaaggcatacaatcacgccctgtcggagctcccggagacgttggaaaccctgctactgctcacacttctggctactgtaaccgggggaatatttttattcttgatgtctggcaaaggtatcgggaagatgacactgggcatgtgctgcattatcaccgcgtccattctcctgtggtatgcccaaatccagccccactggatagcagctagcattatccttgagtttttcctgatcgtgctcttgattccagaacctgagaaacagcgcactccccaggacaaccaactgacgtacgttgtcatcgccatattaaccgtggtggccgcaacaatggctaatgaaatgggatttctagagaagactaaaaaggacctgggcctcgggtcaattaccacacaggagagtgaatctaacatccttgatattgacctgaggccagcctccgcgtggaccttgtatgctgtcgccactacattcgttacgcctatgctgcggcatagcatcgaaaattcaagtgtgaacgtaagcctcaccgcaatagccaatcaggctactgtgctgatgggacttggtaagggctggcccctctccaaaatggatatcggggtcccgctgttggcaattggatgttactctcaggtgaacccaatcacactgaccgccgcgttactactgctcgttgctcactacgccattatcggccctggtcttcaagcaaaggccacccgtgaagctcagaaaagagccgcagctgggattatgaagaatcccacagtggacggcatcactgtcatagatctggagccaattccctatgaccctaaatttgaaaagcagttgggacaggtaatgctgctcatcctgtgcgtgacgcaagttcttatgatgaggaccacatgggccttatgtgaggcgctgactctcgccaccggcccgatcagcacattgtgggaggggaaccccggacgcttctggaataccactattgcagtgtccatggctaacatatttcggggctcatacctggccggtgcagggctactgttctctatcatgaagaatacgacaaacacccgaagaggaactggcaatattggtgaaaccctcggcgagaaatggaagagtaggcttaacgctctggggaaatcggaatttcagatctataagaaaagcggcattcaggaggtcgatcgcacattggccaaggagggcatcaaaagaggggaaactgaccatcacgccgtgtccagaggatctgcgaagctgcgttggttcgtcgagaggaacatggtgaccccagaaggcaaggttgtggatctcggttgcgggcggggaggctggtcatactattgtggtggcctgaaaaatgtacgcgaggtgaaggggttaacaaaaggaggccctgggcatgaagaaccaatacctatgagcacgtacggatggaaccttgtccgactgcaatccggcgttgacgtgttctttaccccacccgagaagtgcgatactctcctatgtgacatcggtgaaagttctcctaatccaacaattgaggctgggagaaccctgagggtcttgaacctggtggaaaattggctcaacaataacactcagttctgcatcaaagtacttaatccctatatgccgagcgtgattgagaagatggaaacactgcagcggaagtacggaggcgcattggttcgcaaccctctgtcaagaaattccacccacgagatgtactgggtgagtaacgccacgggcaatatcgtcagctctgtgaacatgatatccaggatgctcattaatcgatttaccatgaaacacaagaaagctacatatgagccagatgtcgacttagggtcaggaactcggaacatcggtatcgaaagcgagattcccaacctggacataatcggcaagcgtattgagaaaataaagcaggagcatgaaacctcgtggcactacgatcaagaccatccttataagacatgggcctaccacgggtcttatgagactaaacagaccggaagtgcatccagcatggtgaatggcgttgtaagacttctgacaaagccatgggatgtggtccccatggtgacccagatggccatgactgacacgacaccgttcggtcagcaacgcgtttttaaagagaaggtggataccaggactcaggaacctaaagaggggaccaagaagctaatgaaaattacagctgaatggctctggaaggagctgggcaaaaagaaaacgccccggatgtgtaccagagaggagttcactcgcaaggtcaggtcaaacgcggccttgggcgcaatctttacagacgagaataaatggaagtccgctcgagaagccgtggaggattctcggttctgggaactggtagacagagagaggaacctccaccttgagggcaagtgcgaaacctgtgtgtacaatatgatggggaaacgcgagaagaaactgggagaatttggtaaggcaaaaggcagccgtgccatatggtatatgtggttaggggctcggttcctggagtttgaagccttgggattcctcaacgaggatcattggtttagtagaggcaattccctgagcggtgttgagggggaaggactacacaggcttggctacatcctgcgcgacgtctctaagaaggagggcggggcgatgtacgcagatgacactgccggatgggacacacgaattaccctcgaagatctgaaaaacgaggaaatggtgacaaatcatatgaagggtgagcacaaaaagttggctgaggccatcttcaaactgacttatcagaacaaggtggtccgggttcagagaccaacccctaggggcacggtgatggacattatctcacgcagagatcaacgggggagtggacaggtaggcacctacggtctcaatacattcactaacatggaagcacagcttattaggcaaatggagggggaaggaatatttaagtccatccagcatctgaccgtgacagaggagattgctgtccagaattggttagcccgtgtgggccgagaacgcctgagcagaatggctatctctggcgacgattgcgttgtgaaacccttggacgatcggttcgcctcggcactcactgcgctgaacgacatggggaaggtcaggaaagatatccagcaatgggagccatcacgcggatggaatgactggacccaggtgcccttttgcagccaccacttccatgagctagtaatgaaggatggtagagttcttgtggtcccttgtcggaaccaggacgagctgattggcagggcccgaatatcccagggggctggatggagtctcaaagaaacggcctgcctgggcaagtcttatgcacaaatgtggacattgatgtactttcaccgtagagatttacgcctggctgccaacgcaatctgtagcgccgtgccatcccattgggtgccgacctcacggactacatggagtattcacgcgaagcacgagtggatgaccactgaggacatgctcgctgtctggaatagggtttggatccaggaaaacccctggatggaggacaaaacccctgtggaatcttgggaggaagtaccatatcttggtaagagagaggatcagtggtgcgggagcctgattggactaacatcccgcgccacgtgggccaaaaatatccagaccgccataaaccaagtgcggtcactgatcggcaatgaggaatacactgactatatgcccagcatgaagaggttccgaagagaggaagaggaagctggcgtcctctggtga

SEQ ID NO: 14641 - RNA, 9876 nt, synthetic construct
  misc_feature 1..9876: note = derived and/or modified CDS sequence (opt3) from DENV-2__EU569704__SS-prME
  source 1..9876: mol_type = other RNA
accgccggcgtgataattatgctgatacccacagctatggcattccacctcactacgaggaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtcctcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttctttgcaagcattctatggtggatagaggctggggtaacgggtgtggactcttcggcaagggcgggatcgtaacctgcgccatgtttacatgcaaaaagaatatggaaggaaaagtggtgctgcctgagaaccttgaatacaccattgtcataactccacacagcggtgaggagcatgctgttggcaatgacacggggaagcacggaaaagaaatcaagattacaccgcagtcctcaatcaccgaggccgaactgactggctatggtaccgtgacaatggagtgtagtcccaggaccgggttggatttcaacgaaatggtactcctgcagatggaggacaaagcatggttagtgcaccggcaatggtttctggatctccctcttccatggctgcccggcgctgacactcagggaagcaattggatacagaaggagacattggtcacgttcaagaaccctcatgccaaaaagcaggacgtggttgtgctaggctctcaagaaggggcgatgcacaccgccctgactggagcaacagagattcagatgtcctcaggtaatctcctgtttaccggccatcttaaatgccgtctgcgcatggataagttgcagctcaaagggatgagctacagtatgtgtacaggaaagttcaagatcgtcaaagaaatcgctgagactcaacacggcaccattgtgatcagagtacagtatgagggtgacgggtctccatgcaagattcccttcgaaataatggatctggagaaaaggcatgttttaggccggctgatcacggtgaacccgattgtcaccgaaaaggactcccctgtgaacatcgaggccgaacccccatttggagatagctacatcattataggcgtcgagcctgggcagctaaaactcaattggttcaagaagggatcgtctatcggtcagatgtttgagacaactatgcgaggcgctaaacgcatggccattctgggggacaccgcatgggatttcggatcccttggcggtgtgtttacatcaatcgggaaggccttgcaccaagttttcggcgctatttacggagcggcatttagtggcgtgagctggactatgaaaatcctgataggggtaatcattacctggatcggaatgaactccagatctacgagcctctcagtcagtctggtgcttgttggcgtggtcacactgtatttgggtgccatggtgcaggctgactccgggtgtgtagtgagctggaagaataaagaactcaagtgcggatctggcattttcatcaccgataacgttcacacttggacagagcagtacaagtttcagcccgaatcaccaagtaaactggccagcgcaatacaaaaggcccatgaggaaggtatttgtggcatcaggtccgtcacccggttagagaatctgatgtggaaacagattactcccgagctaaaccacatcctctctgaaaatgaggtgaagctgaccataatgacaggggacatcaaaggaattatgcaggctggcaagcgctcgcttagacctcagccaacggaattgaaatatagctggaagacctgggggaaggccaaaatgctgtccactgagtcacataaccaaacattcctcatcgatggaccggaaaccgcagagtgccccaatacaaacagggcgtggaatagtctggaggtggaagactacggctttggtgtcttcactaccaacatttggttaaagctgcgtgagaaacaggacgtattttgtgattctaaacttatgagcgctgccatcaaagacaatcgggcagtgcacgccgatatggggtattggatagaatccgctttgaacgacacgtggaagatggagaaggcctcattcattgaggtgaaaagctgccactggcctaagtctcatacactctggtccaatggagtactggaaagtgagatgatcatccccaagaatttcgcaggccccgtcagccagcacaactaccgacctggttatcatacccagactgctggcccatggcacctagggaagctggaaatggattttgacttctgtgagggaaccacagtggttgtgactgaagattgcggcaatagagggccctctctcaggaccacaacggcctccggaaaactgattaccgagtggtgctgtcgctcatgcactcttccgcctttgcggtacagaggcgaggacggttgttggtacgggatggaaatcaggccactgaaggagaaggaagagaacttagtcaatagtctcgtgacagcgggacatggccaaattgataactttagcctgggtatacttggcatggccctgttcttggaagagatgctccgcacccgagttgggactaaacacgctatcctgctagtggcagtatcgtttgtcacactgattaccggaaatatgtccttccgggacctcggccgtgtgatggtgatggtcggggccacgatgactgatgacatcggaatgggcgttacctatctggctcttttggccgcatttaaggtgagacccacattcgcggccggtctgttactcaggaaactgacctctaaggagcttatgatggctactattgggatcgccctgctaagccagtcaacaatacctgaaaccatcctcgagctgacagatgcattggctctgggaatgatggtattaaaaattgtgcgcaacatggaaaagtaccagctcgccgtcactatcatggcaattagttgcgtgcccaatgccgttatcctgcaaaacgcttggaaggtgtcctgtaccatacttgcggccgtctctgtgagcccactgttgctcacgtcctcacagcagaaagcagactggattcctctggctctaacaatcaagggcctgaatcccaccgccatctttcttactaccctcagccggacaagtaaaaagagatcttggccactgaacgaggccattatggctgttggcatggtgtccatattggcaagctcgctgctaaagaatgacatcccgatgactgggcctctcgtcgccggaggtctgcttaccgtatgctatgtgctgacgggcaggtcagcggatttggaactcgagcgagctgccgacgttaagtgggaggatcaggcagaaatttctgggagttcccccatcctgagcattacaatctctgaggacggaagcatgtccatcaaaaacgaagaggaggaacaaaccctaactatcctgattcgcacaggccttctcgtgatctcaggtgtcttcccagtgagtattcccatcaccgccgctgcatggtacctgtgggaggtaaagaagcagcgggccggggtgttgtgggatgtccctagcccaccccctgttggaaaagcggaattagaggacggcgcttatagaataaagcagaggggcattctggggtactctcagatcggagccggtgtgtataaagaaggcacttttcacacaatgtggcatgtgacccgtggggcagtcctcatgcaccgcggaaagcggatcgagccgtcctgggccgatgtgaaaaaggacctgatttcatacggcggtgggtggaaacttgagggagaatggaaagagggcgaagaggttcaagtactggctttggaaccaggcaagaatcccagagccgtgcagacgaaacctgggctattcaagactaacaccggaacaatcggtgcagtcagtctggattttagcccaggcacctccgggtctcccatagtggacaggaaaggaaaggttgtgggcctctacggtaatggggtcgtgacacgatcgggagcttatgtaagcgccattgcgcagactgagaagtcaatcgaggataaccctgaaattgaggacgatatcttccggaaaaagcgcctgaccataatggaccttcatccgggcgccggcaaaacgaagagatacttacccgcaattgtcagggaagctatcaaacgggggctgcgaacactcatcttggccccaactagagtggttgctgcagagatggaagaggccctgcgcggactccctattaggtatcagacccccgccatccgtgctgagcacacaggtcgggaaattgtggacctgatgtgtcatgcgaccttcactatgagacttctgtccccagtcagggtgcctaactacaatttgataatcatggatgaggcacactttaccgaccccgccagtattgctgcccgcggctatatctctacacgagttgaaatgggggaggcagccggaatcttcatgacggctactccaccgggcagcagagatccttttccccaatccaacgcgccaattatggacgaggaacgggagatacccgaaaggtcatggaactctggtcacgagtgggtgaccgatttcaaggggaagacagtctggtttgtgcctagcatcaaagccggaaacgacattgcagcttgcctacgcaagaatggcaaaaaggtaatccagctgagtcgtaaaaccttcgattccgaatacgtgaagactagagccaacgactgggattttgttgtcacaaccgacattagcgagatgggcgcaaatttcaaggccgagcgggtgatcgatccaaggcgctgtatgaaacccgtgatactcacggacggggaagaacgagtcatcttagctggacctatgccggtaactcattcttcagccgcgcagagacggggtaggattggccgcaacccaaagaatgaaaacgaccaatatatctacatgggggagcccctggaaaatgatgaggactgcgcacactggaaagaggccaagatgcttctggataacattaatacacctgaaggaatcataccctccatgtttgagccagaaagagagaaagtggacgctattgatggcgaatacaggctccggggtgaggcccgtaagaccttcgttgacttgatgcgccgaggggatctgcctgtgtggctcgcttatagagtcgcagccgagggcatcaactacgctgacaggcggtggtgttttgatggaattaaaaataaccagatcctggaagagaacgtggaagttgagatatggaccaaggagggcgaacgcaagaaacttaagcccagatggctagacgccaggatctatagtgatccactggcattgaaagagttcaaggagttcgcggccgggcgaaagagcttaactctgaatctcattacagagatgggacggctgcctacctttatgacacagaaggctagagacgcccttgataacctggcagtgctccatactgctgaagccggtggccgcgcatacaatcacgccttgtcggagctgccggagacgctagaaaccctgctccttctgacattattggctactgtcaccgggggaatcttcctgtttctcatgtctggcaagggtattgggaaaatgacactgggcatgtgctgcatcataaccgcgtccattcttctgtggtatgcccagatccaaccccactggatcgcagctagcattatcctcgagttctttttgatagtgctgttaattccagaacctgagaagcagaggactccccaggacaaccagctaacgtacgtagtgatcgccattctgaccgttgtcgccgcaacaatggctaatgaaatgggattcctcgagaaaactaagaaagaccttggcctggggtcaatcaccacacaagagagtgaatctaacatattggatatcgacctgcggccagcctccgcgtggaccctctatgctgtggccactacatttgtgacgcctatgctgcgtcatagcattgaaaattcaagtgtcaacgttagccttaccgcaatcgccaatcaggctactgtgctcatgggactgggtaagggctggcccttgtccaagatggatattggggtaccgctgttagcaatcggatgttactctcaggtgaacccaattacactaaccgccgcgctgctccttctggtcgctcactacgccatcataggccctggtttgcaggcaaaagccaccagagaagctcaaaagagggccgcagctgggattatgaaaaatcccacagtggacggcatcactgttatcgatctggagccaattccctatgaccctaagttcgaaaaacagctcggacaggtgatgctgcttatattatgcgtcacgcaggtactgatgatgcgcaccacatgggccctctgtgaggcgttgactctggccaccggcccgatcagcacactatgggaggggaaccccggacggttttggaataccactattgcagtgtccatggctaacatcttccgaggctcatacctggccggtgcagggctcctattttctattatgaagaatacgacaaacaccagaaggggaactggcaatatcggtgaaaccctgggcgagaagtggaaaagtcgcttgaacgctctggggaagtcggagttccaaatatataaaaagagcggaatccaggaggttgatcggacactcgccaaagagggcattaagagaggggaaactgaccatcacgccgtgtcccgtggatctgcgaaactgaggtggtttgtcgagcggaacatggtgaccccagaaggcaaggtcgtggatttaggttgcgggcgcggaggctggtcatactattgtggtggccttaagaatgttcgagaggtgaaagggctgacaaagggaggccctgggcatgaagaaccaatccctatgagcacgtacggatggaacctcgtaagactacagtccggcgtggacgtcttcttcaccccacccgagaaatgcgatactctgttgtgtgacattggtgaaagttctcctaatccaacaatcgaggctgggaggaccctgcgggttctcaaccttgtggaaaattggctgaacaataacactcaattttgcataaaggtcttgaatccctatatgccgagcgtgattgagaaaatggaaacactgcagcgcaagtacggaggcgcactcgtaagaaaccctttatcaagaaattccacccacgagatgtactgggtgagtaacgccacgggcaatatcgttagctctgtgaacatgatctcccgaatgctgattaatcggttcaccatgaagcacaaaaaggctacatatgagccagatgtcgaccttgggtcaggaactcgtaacataggtatcgaaagcgagattcccaacctggacatcattggcaaaagaatcgaaaagataaaacaggagcatgaaacctcgtggcactacgatcaggaccatccttataagacatgggcctaccacgggtcttatgagactaagcaaaccggaagtgcatccagcatggtgaatggcgtcgtgcgcctactcacaaaaccatgggatgttgtacccatggtgacccagatggccatgactgacacgacaccgtttggtcagcagagggtcttcaaggagaaagtggatacccggactcaagaacctaaggaggggaccaaaaagctgatgaagatcacagctgaatggttgtggaaagagctgggaaagaaaaagacgcccagaatgtgtacccgcgaggaatttactaggaaagttcgatcaaacgcggccctcggcgcaattttcacagacgagaataagtggaaatccgctcgggaagccgtggaggattctagattttgggaacttatcgacagggagcgcaacctgcacttagagggcaagtgcgaaacctgtgtctacaatatgatggggaagcgtgagaaaaagctgggagagttcggtaaagcaaagggcagccgggccatttggtatatgtggttgggggctagatttctcgagttcgaagccctgggatttctaaacgaggatcattggttcagtaggggcaattcccttagcggtgtggagggggaaggactgcaccgcctcggctacatcctgcgagacgtatctaaaaaggagggcggggcgatgtacgcagatgacactgccggatgggacacacggattaccttggaagatctgaagaacgaggaaatggtgacaaatcatatgaaaggtgagcacaagaaactcgctgaggccatatttaaacttacttatcagaacaaagttgtcagagtgcagaggccaacccctcgcggcacggtgatggacatcatttcaagacgggatcagagggggagtggacaagtcggcacctacggtctgaatacattcactaacatggaagcacagttaatccgtcagatggagggggaaggaatcttcaagtccattcaacatctgaccgttacagaggagatagctgtgcagaattggttggcccgagtaggccgcgaaagactcagccggatggctatctctggcgacgattgcgtggtcaagcccctggacgataggtttgcctcggcactaactgcgcttaacgacatggggaaagtgcgcaaggatattcagcagtgggagccatcaagaggatggaatgactggacccaagttcccttctgcagccaccactttcatgaactggtgatgaaagatggtcgggtcctcgtggtaccttgtaggaaccaggacgagctgatcggccgagcccgtatttcccagggggctggatggagtttgaaggaaacggcctgcttaggcaaatcttatgcacagatgtggacactgatgtacttccacagacgcgatctccggcttgctgccaacgcaatctgtagcgccgttccatcccattgggtgccgacctcaaggactacatggagtatacacgcgaagcacgagtggatgaccactgaggacatgctggctgtctggaatagagtgtggatccaagaaaacccctggatggaggacaagacccctgtggaatcttgggaggaagtcccatatctaggtaaacgcgaggatcagtggtgcgggagcctgattggactcacatcccgggccacgtgggcaaagaatatccagaccgccattaaccaggttaggtcattgatcggcaatgaggaatacactgactatatgcccagcatgaaacgatttagacgggaggaagaggaagctggcgtgctgtggtga

SEQ ID NO: 14642 - RNA, 9876 nt, synthetic construct
  misc_feature 1..9876: note = derived and/or modified CDS sequence (opt3) from DENV-2__EU482568__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttctatgcaagcattctatggtggatagaggctggggtaacgggtgtggactcttcggcaagggcgggatcgtcacctgcgccatgtttacatgcaaaaagaatatggaaggaaaagtggtgctgcctgagaaccttgaatacaccattgtcataactccacacagcggtgaggagcatgctgttggcaatgacacggggaagcacggaaaagaaatcaagattacaccgcagtcctcaatcaccgaggccgaactgactggctatggtaccgtgacaatggagtgtagtcccaggaccgggttggatttcaacgaaatggtactcctgcagatggaggacaaagcatggttagtgcaccggcaatggtttctggatctccctcttccatggctgcccggcgctgacactcagggaagcaattggatacagaaggagacattggtcacgttcaagaaccctcatgccaaaaagcaggacgtggttgtgctaggctctcaagaaggggcgatgcacaccgccctgactggagcaacagagattcagatgtcctcaggtaatctcctgtttaccggccatcttaaatgccgtctgcgcatggataagttgcagctcaaagggatgagctacagtatgtgtacaggaaagttcaagatcgtcaaagaaatcgctgagactcaacacggcaccattgtgatcagagtacagtatgagggtgacgggtctccatgcaagattcccttcgaaataatggatctggagaaaaggcatgttttaggccggctgatcacggtgaacccgattgtcaccgaaaaggactcccctgtgaacatcgaggccgaacccccatttggagatagctacatcattataggcgtcgagcctgggcagctaaaactcaattggttcaagaagggatcgtctatcggtcagatgtttgagacaactatgcgaggcgctaaacgcatggccattctgggggacaccgcatgggatttcggatcccttggcggtgtgtttacatcaatcgggaaggccttgcaccaagttttcggcgctatttacggagcggcatttagtggcgtgagctggactatgaaaatcctgataggggtaatcattacctggatcggaatgaactccagatctacgagcctctcagtcagtctggtgcttgttggcgtggtcacactgtatttgggtgccatggtgcaggctgactccgggtgtgtagtgagctggaagaataaagaactcaagtgcggatctggcattttcatcaccgataacgttcacacttggacagagcagtacaagtttcagcccgaatcaccaagtaaactggccagcgcaatacaaaaggcccatgaggaaggtatttgtggcatcaggtccgtcacccggttagagaatctgatgtggaaacagattactcccgagctaaaccacatcctctctgaaaatgaggtgaagctgaccataatgacaggggacatccgcggaattatgcaggctggcaaaagatcgcttaggcctcagccaacggaattgaagtatagctggaaaacctgggggaaggccaagatgctgtccactgagtcacataaccaaacattcctcatcgatggaccggaaaccgcagagtgccccaatacaaaccgtgcgtggaatagtctggaggtggaagactacggctttggtgtcttcactaccaacatttggttaaaactgcgggagaagcaggacgttttttgtgattctaaacttatgagcgctgccatcaaggacaatcgagcagtgcacgccgatatggggtattggatagaatccgctttgaacgacacgtggaaaatggagaaggcctcattcattgaggtgaagagctgccactggcctaaatctcatacactctggtccaatggagtactggaaagtgagatgatcatcccaaagaacttcgcaggccccgtcagccagcacaactacagacctggttatcatacccagactgctggcccatggcacctagggaaactggaaatggattttgacttctgtgagggaaccacagtggttgtgactgaagattgcggcaatagggggccctctctccgcaccacaacggcctccggaaagctgattaccgagtggtgctgtcggtcatgcactcttccgcctttgagatacaggggcgaggacggttgttggtacgggatggaaatccgcccactgaaagagaaggaagagaacttagtcaatagtctcgtgacagcgggacatggccaaattgataactttagcctgggtatacttggcatggccctgttcttggaagagatgctccgaacccgggttgggactaagcacgctatcctgctagtggcagtatcgtttgtcacactgattaccggaaatatgtccttccgtgacctcggcagagtgatggtgatggtcggggccacgatgactgatgacatcggaatgggcgttacctatctggctcttttggccgcatttaaagtgaggcccacattcgcggccggtctgttactccgcaagctgacctctaaagagcttatgatggctactattgggatcgccctgctaagccagtcaacaatacctgaaaccatcctcgagctgacagatgcattggctctgggaatgatggtattaaagattgtgcggaacatggaaaaataccagctcgccgtcactatcatggcaattagttgcgtgcccaatgccgttatcctgcaaaacgcttggaaggtgtcctgtaccatacttgcggccgtctctgtgagcccactgttgctcacgtcctcacagcagaaggcagactggattcctctggctctaacaatcaaaggcctgaatcccaccgccatctttcttactaccctcagcagaacaagtaagaaaaggtcttggccactgaacgaggccattatggctgttggcatggtgtccatattggcaagctcgctgttaaagaatgacatcccgatgactgggcctctcgtcgccggaggtctgcttaccgtatgctatgtgctgacgggccgatcagcggatttggaactcgagcgcgctgccgacgttaaatgggaggatcaggcagaaatttctgggagttcccccatcctgagcattacaatctctgaggacggaagcatgtccataaagaacgaagaggaggaacaaaccctaactatcctgattcggacaggccttctcgtgatctcaggtgtcttcccagtgagtattcccatcaccgccgctgcatggtacctgtgggaggtaaaaaagcagagagccggggtgttgtgggatgtccctagcccaccccctgttgaaaaggcggagttagaagacggagcttataggataaaacagcgtggcattctgggctactctcagatcggggccggagtgtataaggagggtacttttcacacaatgtggcatgtgacccgcggcgcagtcctcatgcaccgggggaaaagagtggagccgtcctgggccgatgttaagaaagacctgatctcatacggaggcggttggaagcttgaaggggagtggaaggaaggagaggaagtacaagtgctggctttggagccaggcaaaaatcccagggccgtccagacgaagcctggcctattcaaaactaacaccgggacaattggagcagtgagtctggattttagcccaggtacctccggctctcccatcgttgaccgaaaggggaaagtggtcggactctacggcaatggtgtggtaacacggtcgggggcttatgtcagcgccatagcgcagactgagaagtcaattgaagataaccctgagatcgaagacgatattttccgcaagaaaagactgaccatcatggaccttcatccgggagccggcaagacgaaaaggtacttacccgcaatagtgcgggaggctattaagcgaggcctgagaacactcatcttggccccaactcgcgttgtggctgcagaaatggaggaggccctgagggggctccctatccgttatcagacccccgccattcgggctgaacacacaggaagagagatcgtcgacctgatgtgtcatgcgaccttcactatgaggcttctgtccccagtgcgcgttcctaactacaatttgattataatggatgaagcacactttaccgaccccgccagtatcgctgcccgaggttatatttctacaagagtggagatgggcgaggcagccgggatcttcatgacggctactccaccgggaagccgggatccttttccccaatccaacgcgccaatcatggacgaagagagggaaattcccgagcgctcatggaattctggccacgaatgggtcaccgatttcaaaggtaagacagtgtggtttgtacctagcataaaggccgggaacgacatcgcagcttgcctacgtaaaaatggaaagaaagtgattcagctgagtagaaagaccttcgattccgagtacgttaaaactcgggccaacgactgggattttgtcgtgacaaccgacatcagcgagatgggcgcaaatttcaaggccgaaagggtgattgatccacgccgatgtatgaagcccgtcatcctcacggacggcgaggaaagagtaatattagctgggcctatgccggtgactcattcttcagccgcgcagcggaggggacgcatcggtagaaacccaaaaaatgagaacgaccaatatatttacatgggcgaacccctggagaatgatgaggactgcgcacactggaaggaagccaaaatgcttctggataacatcaatacacctgaggggattatcccctccatgtttgaaccagagagggaaaaggttgacgctatagatggagagtaccggctccgtggcgaggcccgcaaaaccttcgtggacttgatgcgaagaggtgatctgcctgtctggctcgcttatagggtggcagccgaagggattaactacgctgaccggcgctggtgttttgatggcatcaagaataaccagattctggaggaaaacgttgaggtggagatctggaccaaagaaggagagagaaagaagcttaaacccaggtggctagacgcccggatatatagtgatccactggcattgaaggaattcaaagagttcgcggccggccgaaagagcttaactctgaatctcatcacagaaatggggagactgcctacctttatgacacagaaagctcgcgacgcccttgataacctggcagtcctccatactgctgaggccggaggtagggcatacaatcacgccttgtcggagctgccggaaacgctagagaccctgctccttctgacattattggctactgtgaccggcgggattttcctgtttctcatgtctggaaagggcatcggtaagatgacactggggatgtgctgcattatcaccgcgtccatacttctgtggtatgcccagattcaaccccactggatcgcagctagcatcattctcgaattctttttgatcgtactgttaataccagagcctgaaaaacagcggactccccaggacaaccagctaacgtacgtggttattgccatcctgaccgtcgtggccgcaacaatggctaatgagatgggcttcctcgagaagactaaaaaggaccttggactgggctcaattaccacacaagaaagtgagtctaacatcttggatatagacctgcgtccagcctccgcgtggaccctctatgctgtggccactacatttgtcacgcctatgctgagacatagcatcgaaaattcaagtgttaacgtgagccttaccgcaattgccaatcaggctactgtactcatggggctgggaaaaggttggcccttgtccaagatggatatcggcgtgccgctgttagcaattgggtgttactctcaggtcaacccaatcacactaaccgccgcgctgctccttctggtggctcactacgccattatcggacctggcttgcaggcaaaggccaccagggaggctcaaaaacgcgccgcagctggtataatgaagaatcccacagttgacgggattactgtgatcgatctggaaccaatcccctatgaccctaaattcgagaagcagctcggccaggtcatgctgcttattttatgcgtaacgcaggtgctgatgatgcggaccacatgggccctctgtgaggcgttgactctggccaccggaccgataagcacactatgggaaggcaaccccgggcgattttggaataccactatcgcagtttccatggctaacattttcagaggatcatacctggccggcgcaggtctccttttttctatcatgaaaaatacgacaaacaccaggcgcgggactggaaatattggcgagaccctgggtgaaaagtggaagagtcggttgaacgctctgggcaaatcggagttccaaatctataagaaaagcgggatacaggaggtggatagaacactcgccaaggaaggaatcaaacgtggcgagactgaccatcacgccgtctccagggggtctgcgaagctgcggtggtttgtggaacgcaacatggtcaccccagagggaaaagtggttgatttaggctgcggtcgagggggatggtcatactattgtggcggtcttaagaatgtgagagaagtaaagggcctgacaaaagggggacctggccatgaggagcccattcctatgagcacgtacgggtggaacctcgtgaggctacagtccggagtcgacgttttcttcaccccacccgaaaagtgcgatactctgttgtgtgacatcggcgagagttctcctaatccaacaattgaagctggtcggaccctgcgcgtgctcaaccttgtcgagaattggctgaacaataacactcaattttgcatcaaagtgttgaatccctatatgccgagcgtaatagaaaagatggagacactgcagagaaaatacgggggagcactcgtgaggaaccctttatcacgaaattccacccacgagatgtactgggttagtaacgccacgggcaatattgtgagctctgtcaacatgatctcccggatgctgatcaatcgtttcaccatgaagcacaagaaagctacatatgaaccagatgtggaccttggctcagggactagaaacattggaatagagagcgaaatccccaacctggacattatcggtaagcgcattgagaaaatcaagcaggaacatgagacctcgtggcactacgatcaggaccatccttataaaacatgggcctaccacggctcttatgagactaagcaaaccgggagtgcatccagcatggtcaatggagtggttaggctactcacaaagccatgggatgtagtgcccatggtcacccagatggccatgactgacacgacaccgtttggccagcagcgggtgttcaaagaaaaggttgataccagaactcaagagcctaaagaaggtaccaagaaactgatgaagataacagctgagtggttgtggaaggagctggggaaaaagaaaacgccccgcatgtgtaccagggaagagtttactcgaaaggtgcggtcaaacgcggccctcggagcaatcttcacagacgaaaataaatggaagtccgctagagaggccgtcgaagattctaggttttgggagcttattgaccgcgagcgtaacctgcacttagaaggcaaatgcgagacctgtgtgtacaatatgatgggcaagcgggaaaagaaactgggggagttcggaaaggcaaaaggtagcagagccatctggtatatgtggttgggcgctaggtttctcgaattcgaggccctggggtttctaaacgaggatcattggttcagtcgcggaaattcccttagcggcgtagaaggtgaggggctgcaccgactcggatacattctgcgggacgtgtctaagaaagaaggcggcgcgatgtacgcagatgacactgccgggtgggacacaagaatcaccttggaggatctgaagaacgaagagatggttacaaatcatatgaagggagagcacaaaaagctcgctgaagccatttttaaacttacttatcagaacaaggtcgtgagggtgcagcgcccaacccctagaggtacggtcatggacataatctcacggagggatcagcgtggcagtgggcaagttggaacctacggcctgaatacattcactaacatggaggcacagttaattcgacagatggaaggtgaggggatcttcaaatccatccaacatctgaccgtgacagaggaaattgctgtacagaattggttggcccgcgtgggaagagagcggctcagcaggatggctatatctggcgacgattgcgtcgtgaagcccctggacgatcgctttgcctcggcactaactgcgcttaacgacatgggcaaggttagaaaagatatccagcagtgggaaccatcacgggggtggaatgactggacccaagtgcccttctgcagccaccactttcatgagctggtcatgaaggatggaagggtgctcgtagttccttgtcgaaaccaggacgaactgattggtcgtgccagaatctcccagggcgctgggtggagtttgaaagagacggcctgcttaggaaagtcttatgcacagatgtgggctctgatgtacttccaccgccgggatctcaggcttgccgcaaacgccatttgtagcgcggtgccatcccattgggtcccgacatcaagaaccacttggagtatccacgctaaacacgagtggatgacaaccgaagacatgctggccgtgtggaatcgcgtgtggatacaagagaacccctggatggaagacaagactcctgtcgagtcttgggaagaggttccatatctaggcaagcgggaggatcagtggtgcggtagcctgatcgggctcacctccagggcaacatgggccaaaaatattcagacggctatcaaccaggtgcgatcattgattggaaatgaagagtacaccgactatatgcccagcatgaagagatttcggagggaagaggaagaggccggcgtactgtggtga

SEQ ID NO: 14643 - RNA, 9876 nt, synthetic construct
  misc_feature 1..9876: note = derived and/or modified CDS sequence (opt3) from DENV-2__EU482569__SS-prME
  source 1..9876: mol_type = other RNA
accgccggcgtgatcattatgctgatacccacagctatggcattccacctcactacgagaaacggggagcctcatatgatcgtaggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtgaccgaaaaggactcccctgtcaacatcgaggccgaacccccatttggagatagctacatcattataggcgtggagcctgggcagctgaaactaaattggttcaagaagggatcgtctatcggtcagatgtttgagacaactatgcgaggcgctaaacgcatggccattctcggggacaccgcatgggatttcggatccctgggcggtgtttttacatcaatcgggaaggcccttcaccaagtgttcggcgctatttacggagcggcatttagtggcgtaagctggactatgaaaatcttgataggggtcatcattacctggatcggaatgaactccagatctacgagcctgtcagtgagtctcgttctggtgggcgtcgtgacactttatctgggtgccatggtacaggctgactccgggtgtgtggttagctggaagaataaagaattgaagtgcggatctggcattttcatcaccgataacgtccacacttggacagagcagtacaagtttcagcccgaatcaccaagtaaactcgccagcgcaatacaaaaggcccatgaggaaggtatttgtggcatcaggtccgtgacccggctggagaatttaatgtggaaacagattactcccgagctgaaccacatcctatctgaaaatgaggtgaagctcaccataatgacaggggacatcaaaggaattatgcaggctggcaagcgctcgctgagacctcagccaacggaacttaaatatagctggaagacctgggggaaggccaaaatgttgtccactgagtcacataaccaaacattcctgatcgatggaccggaaaccgcagagtgccccaatacaaacagggcgtggaatagtctcgaggtcgaagactacggctttggtgttttcactaccaacatttggctgaagttacgtgagaaacaggacgtgttttgtgattctaagctgatgagcgctgccatcaaagacaatcgggcagtgcacgccgatatggggtattggatagaatccgctcttaacgacacgtggaagatggagaaggcctcattcattgaggtaaaaagctgccactggcctaagtctcatacattgtggtccaatggagtcctcgaaagtgagatgatcatccccaaaaatttcgcaggccccgtgagccagcacaactaccgacctggttatcatacccagactgctggcccatggcacctggggaagctagaaatggattttgacttctgtgagggaaccacagttgtggtcactgaagattgcggcaatagagggccctctctgaggaccacaacggcctccggaaaactcattaccgagtggtgctgtcgctcatgcactctgccgcctcttcggtacagaggcgaggacggttgttggtacgggatggaaatcaggccattgaaggagaaggaagagaacctggtgaatagtttagttacagcgggacatggccaaattgataactttagcctcggtgtgctgggcatggcccttttcctggaagagatgttgcgcacccgagtagggactaaacacgctatactcctggtcgcagtgtcgtttgtgacactaatcaccggaaatatgtccttccgggacctgggccgtgtcatggttatggtgggggccacgatgactgatgacattggaatgggcgtaacctatctcgctctgcttgccgcatttaaggtgagacccacattcgcggccggtttgctgttaaggaaactcacctctaaggagctgatgatggctactatcgggattgcccttctgagccagtcaacaatccctgaaaccatactagagctcacagatgcactggctttgggaatgatggtcctgaaaatcgtgcgcaacatggaaaagtaccagttagccgttactattatggcaatcagttgcgtgcccaatgccgtcattctccaaaacgcttggaaggtgtcctgtaccatcctggcggccgtttctgtgagcccacttctgttgacgtcctcacagcagaaagcagactggatacctctcgctctgacaattaagggcctaaatcccaccgccatctttctgactacccttagccggacaagtaaaaagagatcttggccactcaacgaggccatcatggctgtcggcatggtatccattctggcaagctcgttgctgaaaaatgacataccgatgactgggcctttagtggccggaggtctcctgaccgtttgctatgtgcttacgggcaggtcagcggatctggaattggagcgagctgccgacgtcaagtgggaggatcaggcagaaatctctgggagttcccccattctcagcatcacaatttctgaggacggaagcatgtccatcaaaaacgaagaggaggaacaaaccctgactatactaatccgcacaggcctgcttgtgatttcaggtgtattcccagtgagtatccccattaccgccgctgcatggtacctctgggaggtcaagaagcagcgggccggggttctgtgggatgtgcctagcccaccccctgtgggaaaagcggaattggaggacggcgcttatagaatcaagcagaggggcatattagggtactctcagattggagccggtgtctataaagaaggcacttttcacacaatgtggcatgtgacccgtggggcagttctgatgcaccgcggaaagcggatcgagccgtcctgggccgatgtcaagaaagacctcatctcatacggcggtgggtggaaactggagggagaatggaaagagggcgaagaggtgcaagtccttgctctggaaccaggcaagaatcccagagccgtgcagacgaaacctgggttgttcaagactaacaccggaacaattggtgcagttagtctagattttagcccaggcacctccgggtctcccatcgtggacaggaaaggaaaggtcgtgggcctgtacggtaatggggtagtcacacgatcgggagcttatgtgagcgccatagcgcagactgagaagtcaattgaggataaccctgaaatcgaggacgatattttccggaaaaagcgcctcaccatcatggacctgcatccgggcgccggcaaaacgaagagataccttcccgcaatagttagggaagctattaaacgggggttacgaacactgatcctcgccccaactagagtggtcgctgcagagatggaagaggccttgcgcggactgcctatcaggtatcagacccccgccattcgtgctgagcacacaggtcgggaaatcgtggacctcatgtgtcatgcgaccttcactatgagactgctttccccagttagggtgcctaactacaatctgattataatggatgaggcacactttaccgaccccgccagtatcgctgcccgcggctatatttctacacgagtcgaaatgggggaggcagccggaatcttcatgacggctactccaccgggcagcagagatccttttccccaatccaacgcgccaatcatggacgaggaacgggagattcccgaaaggtcatggaactctggtcacgagtgggtgaccgatttcaaggggaagacagtatggtttgtgcctagcataaaagccggaaacgacatcgcagcttgcttgcgcaagaatggcaaaaaggttattcagctaagtcgtaaaaccttcgattccgaatacgtcaagactagagccaacgactgggattttgtggtgacaaccgacatcagcgagatgggcgcaaatttcaaggccgagcgggtcattgatccaaggcgctgtatgaaacccgtaatcctgacggacggggaagaacgagtgatactcgctggacctatgccggttactcattcttcagccgcgcagagacggggtaggatcggccgcaacccaaagaatgaaaacgaccaatatatttacatgggggagcccttagaaaatgatgaggactgcgcacactggaaagaggccaagatgctgcttgataacatcaatacacctgaaggaattatcccctccatgtttgagccagaaagagagaaagtggacgctatagatggcgaatacaggctgcggggtgaggcccgtaagaccttcgtcgacctcatgcgccgaggggatttgcctgtgtggctggcttatagagttgcagccgagggcattaactacgctgacaggcggtggtgttttgatggaatcaaaaataaccagattctcgaagagaacgtggaagtcgagatctggaccaaggagggcgaacgcaagaaactgaagcccagatggcttgacgccaggatatatagtgatccactagcactgaaagagttcaaggagttcgcggccgggcgaaagagcttgactttaaatctgatcacagagatgggacggctccctacctttatgacacagaaggctagagacgccctggataaccttgcagtgctgcatactgctgaagccggtggccgcgcatacaatcacgccctctcggagttgccggagacgctggaaaccctactgctccttacactgttagctactgtaaccgggggaattttcttgtttctgatgtctggcaagggtatcgggaaaatgacactcggcatgtgctgcattatcaccgcgtccatactgctttggtatgcccagattcaaccccactggatcgcagctagcatcattctggagttctttctcatcgtgttgctgataccagaacctgagaagcagaggactccccaggacaaccagttaacgtacgttgtcattgccatcctaaccgtggtggccgcaacaatggctaatgaaatgggattcctggagaaaactaagaaagacctcggccttgggtcaattaccacacaagagagtgaatctaacatcctggatatagacttgcggccagcctccgcgtggaccctgtatgctgtcgccactacatttgttacgcctatgctccgtcatagcatcgaaaattcaagtgtgaacgtaagcctgaccgcaattgccaatcaggctactgtgcttatgggactcggtaagggctggcccctgtccaagatggatatcggggtcccgttgctggcaattggatgttactctcaggtgaacccaatcacattaaccgccgcgctactgctccttgttgctcactacgccattatcggccctggtctgcaggcaaaagccaccagagaagctcaaaagagggccgcagctgggataatgaaaaatcccacagtggacggcattactgtcatcgatttggagccaatcccctatgaccctaagttcgaaaaacagctgggacaggtaatgctcctgattctttgcgtgacgcaggttttaatgatgcgcaccacatgggccctgtgtgaggcgctcactttggccaccggcccgataagcacactgtgggaggggaaccccggacggttttggaataccactatcgcagtgtccatggctaacattttccgaggctcatacctagccggtgcagggctgctcttttctatcatgaagaatacgacaaacaccagaaggggaactggcaatattggtgaaacccttggcgagaagtggaaaagtcgcctgaacgctttggggaagaacgagttccaaatctataaaaagtcgggaatacaggaggtcgatcggacactggccaaagagggcatcaagagaggggaaactgaccatcacgccgtgagccgtggatccgcgaaactcaggtggtttgtcgagcggaatatggtgattccagaaggcaaggttgtggatctgggttgcgggcgcggaggctggtcttactattgtggtggcttaaagaacgtacgagaggtgaaagggcttaccaagggaggccctgggcatgaagaaccaatccctatgtcaacatacggatggaatctggtcagactccagagcggcgttgacgtgttcttcacgccacccgagaaatgcgataccctactgtgtgacattggtgaatccagtcctaacccaactatcgaggctgggaggacattgcgggtcctgaatctcgtggaaaactggcttaataacaatacccaattttgcataaaggtactgaacccctatatgccgtctgtgattgagaaaatggaaactttgcagcgcaagtacggaggcgcactggttagaaatcctctcagcaggaactcaacacacgagatgtactgggtgtccaatgccaccggcaacatcgtcagtagcgtgaatatgatctctcgaatgttaattaaccggttcacgatgaagcacaaaaaggctacctatgagccagatgtcgacctggggtccggaacacgtaacataggtatcgaatcagagattcccaatcttgacatcattggcaaaagaatcgaaaagataaaacaggagcatgaaactagctggcactacgatcaggaccatccttataagacctgggcctaccacgggtcgtatgagacaaagcaaactggatctgcaagttccatggtgaacggcgttgtacgcctgctaaccaaaccatgggatgtggtccccatggtgacacagatggccatgaccgacactacgccgtttggtcagcagagggttttcaaggagaaagtggatacacggacccaagaacctaaggaggggactaaaaagctcatgaagatcaccgctgaatggctgtggaaagagttgggaaagaaaaagacacccagaatgtgtacgcgcgaggaatttaccaggaaagtccgaagcaatgcggccctgggcgcaattttcactgacgagaacaagtggaaatcagctcgggaagccgtggaggattccagattttgggaactcatcgacagggagcgcaatcttcacctggagggcaagtgcgaaacatgtgtatacaacatgatggggaagcgtgagaaaaagttaggagagttcggtaaagcaaagggctctcgggccatttggtatatgtggctgggggctagatttttggagttcgaagccctcggatttctgaatgaggatcattggttcagcaggggcaacagtctatccggtgtggagggggaaggacttcaccgcctgggctacatcctccgagacgttagcaaaaaggagggcggggcgatgtacgcagatgacaccgccggatgggacactcggattacactggaagatttgaagaatgaggaaatggtcaccaaccatatgaaaggtgagcacaagaaactggctgaggccatatttaagctcacatatcagaataaagtggtgagagtccagaggccaactcctcgcggcaccgttatggacatcatttctagacgggatcagagggggtcaggacaagtgggcacgtacggtcttaacaccttcacaaatatggaagcacagctgatccgtcagatggagggggaaggaatcttcaagagtattcaacatttaactgtaaccgaggagatagctgtgcagaactggctggcccgagtcggccgcgaaagattgtcccggatggctatcagcggcgacgattgcgtggttaagcccctcgacgataggtttgcctctgcactgacagcgctaaatgacatggggaaagtgcgcaaggatattcagcagtgggagccatcgagaggatggaacgactggactcaagtccccttctgctcacaccactttcatgaacttgtgatgaaagatggtcgggtactggttgtgccttgtaggaaccaggacgagctcatcggccgagcccgtattagccagggggctggatggtccctgaaggaaaccgcctgcttgggcaaaagttatgcacagatgtggacgttaatgtacttccacagacgcgatctgcggctcgctgccaatgcaatctgttctgccgtcccaagccattgggtgccgacatccaggaccacttggtcaatacacgcgaagcacgagtggatgacaaccgaggacatgcttgctgtgtggaacagagtctggatccaagaaaatccctggatggaggacaagactcctgttgaaagttgggaggaagtgccatatctgggtaaacgcgaggatcagtggtgcgggtctctaattggactgaccagccgggccacatgggcaaagaacatccagacggccattaatcaggtaaggtccctcatcggcaacgaggaatacaccgactatatgccctcaatgaaacgatttagacgggaggaagaggaagctggcgtgttgtggtga

SEQ ID NO: 14644 - RNA, 9876 nt, synthetic construct
  misc_feature 1..9876: note = derived and/or modified CDS sequence (opt3) from DENV-2__EU482570__SS-prME
  source 1..9876: mol_type = other RNA
accgccggcgtgatcattatgctgatacccacagctatggcattccacctcactacgcggaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttctatgcaagcattctatggtggatagaggctggggtaacgggtgtggactcttcggcaagggcgggatcgtaacctgcgccatgtttacatgcaaaaagaatatggaaggaaaagtggtgcagcctgagaacctggaatacaccattgtcataactccacacagcggtgaggagcatgctgttggcaatgacacggggaagcacggaaaagaaatcaagattacaccgcagtcctcaatcaccgaggccgaacttactggctatggtaccgtgacaatggagtgtagtcccaggaccgggctggatttcaacgaaatggtattgctccaaatggaggacaaagcatggctggtgcaccggcagtggtttttagatctgcctctcccatggcttcccggcgctgacactcagggaagcaattggatacagaaggagacactggtcacgttcaagaaccctcatgccaaaaagcaagacgtggttgtgttgggctctcaggaaggggcgatgcacaccgccctaactggagcaacagagattcagatgtcctcaggtaatctgctctttaccggccatctgaaatgccgtcttcgcatggataagctgcaattgaaagggatgagctacagtatgtgtacaggaaagttcaagatcgtcaaagaaatcgctgagactcagcacggcaccattgtgatcagagtacagtatgagggtgacgggtctccatgcaagattcccttcgaaataatggatctcgagaaaaggcatgttctgggccggttaatcacggtgaacccgattgtcaccgaaaaggactcccctgtgaacatcgaggccgaacccccatttggagatagctacatcattataggcgtcgagcctgggcagctgaaactaaattggttcaagaagggatcgtctatcggtcaaatgtttgagacaactatgcgaggcgctaaacgcatggccattctcggggacaccgcatgggatttcggatccctgggcggtgtgtttacatcaatcgggaaggcccttcaccaggttttcggcgctatttacggagcggcatttagtggcgtgagctggactatgaaaatcttgataggggtaatcattacctggatcggaatgaactccagatctacgagcctgtcagtcagtctcgtgctggttggcgtggtcacactttatctgggtgccatggtgcaggctgactccgggtgtgtagtgagctggaagaataaagaattgaagtgcggatctggcattttcatcaccgataacgttcacacttggacagagcagtacaagtttcaacccgaatcaccaagtaaactcgccagcgcaatacagaaggcccatgaggaaggtatttgtggcatcaggtccgtcacccggctggagaatttaatgtggaaacaggtgactcccgagctgaaccacattctatctgaaaatgaggtgaagctcaccatcatgacaggggacataaaaggaatcatgcaggctggcaagcgctcgctgagacctcaaccaacggaacttaaatatagctggaagacctgggggaaggccaaaatgttgtccactgagtcacataaccagacattcctgattgatggaccggaaaccgcagagtgccccaatacaaacagggcgtggaatagtctcgaggtcgaagactacggctttggtgttttcactaccaacatctggctgaagttacgtgagaaacaggacgtgttttgtgattctaagctgatgagcgctgccattaaagacaatcgggcagtgcacgccgatatggggtattggatcgaatccgctcttaacgacacgtggaagatggagaaggcctcattcatagaggtaaaaagctgccactggcctaagtctcatacattgtggtccaatggagtcctcgaaagtgagatgattatccccaaaaatttcgcaggccccgtgagccagcacaactaccgacctggttatcatacccaaactgctggcccatggcacctggggaagctagaaatggattttgacttctgtgagggaaccacagttgtggtcactgaagattgcggcaatagagggccctctctgaggaccacaacggcctccggaaaactcatcaccgagtggtgctgtcgctcatgcactctgccgcctcttcggtacagaggcgaggacggttgttggtacgggatggaaattaggccattgaaggagaaggaagagaacctggtgaatagtttagttacagcgggacatggccagatcgataactttagcctcggtgtgctgggcatggcccttttcctggaagagatgttgcgcacccgagtagggactaaacacgctattctcctggtcgcagtgtcgtttgtgacactaataaccggaaatatgtccttccgggacctgggccgtgtcatggttatggtgggggccacgatgactgatgacatcggaatgggcgtaacctatctcgctctgcttgccgcatttaaggtgagacccacattcgcggccggtttgctgttaaggaaactcacctctaaggagctgatgatggctactattgggatcgcccttctgagccagtcaacaattcctgaaaccatcctagagctcacagatgcactggctttgggaatgatggtcctgaaaatagtgcgcaacatggaaaagtaccaattagccgttactatcatggcaattagttgcgtgcccaatgccgtcatcctccagaacgcttggaaggtgggctgtaccattctggcggccgtttccgtgtctccacttctgttgacgagctcccagcagaaagcagactggatccctctcgctctgacaataaagggcctaaatcccaccgccatttttctgactaccctttcacggacaagcaaaaagagaagttggccactcaacgaggccatcatggctgtcgggatggtatctatcctggcatccagcttgctgaaaaatgacattccgatgactggacctttagtggccggtggcctcctgaccgtttgctatgtgcttacggggaggtcggcggatctggaattggagcgagctgccgacgtcaagtgggaggatcaagcagaaatatcaggatctagtcccatcctctccattacaatcagcgaggacggctctatgagcattaaaaacgaagaggaggaacagaccctgactatcctaatacgcacaggtctgcttgtgatctccggggtattcccagtgtcaattcccatcaccgccgctgcatggtacctctgggaggtcaagaagcagcgggccggagttctgtgggatgtgcctagtccaccccctgtgggcaaagcggaattggaggacggcgcttatagaattaagcagagggggatcttaggatacagccaaataggtgccggcgtctataaagaagggacttttcacacaatgtggcatgtgacccgtggagcagttctgatgcaccgcggcaagcggattgagccgtcttgggccgatgtcaaaaaggacctcatctcctacggtgggggatggaagctggagggcgaatggaaagagggcgaagaggtgcaggtccttgctctggaaccagggaagaatcccagagccgtgcagacgaaacctggattgttcaagactaacaccggtacaatcggcgcagtttcactagattttagtccagggaccagcggatcccccattgtggacaggaaaggcaaggtcgtgggtctgtacgggaatggagtagtcacacgatctggcgcttatgtgtcggccatcgcgcagactgaaaagagcatagaggataaccctgaaattgaggacgatatcttccggaaaaagcgcctcaccattatggacctgcatccgggcgccgggaaaacgaagagataccttcccgcaatcgttagggaagctataaaacggggattacgaacactgattctcgccccaactagagtggtcgctgcagagatggaagaggccttgcgcggtctgcctatcaggtatcaaacccccgccatccgtgctgagcacacaggccgggaaattgtggacctcatgtgtcatgcgaccttcactatgagactgctttcaccagttagggtgcctaactacaatctgatcattatggatgaggcacactttaccgaccccgcctccatagctgcccgcgggtatatcagtacacgagtcgaaatgggagaggcagccggcattttcatgacggctactccaccgggttctagagatccttttccccagagcaacgcgccaatcatggacgaggaacgggagatccccgaaaggtcctggaactcagggcacgagtgggtgaccgatttcaagggaaagacagtatggtttgtgccttctattaaagccggcaacgacatagcagcttgcttgcgcaagaatggcaaaaaggttatccagctaagccgtaaaaccttcgatagtgaatacgtcaagactagagccaacgactgggattttgtggtgacaaccgacatttccgagatgggggcaaatttcaaggccgagcgggtcatcgatccaaggcgctgtatgaaacccgtaattctgacggacggagaagaacgagtgatcctcgctggtcctatgccggttactcatagctctgccgcgcaaagacggggcaggatagggcgcaacccaaagaatgaaaacgaccagtatatctacatgggagagcccttagaaaatgatgaggactgcgcacactggaaagaggccaagatgctgcttgataacattaatacacctgaaggcatcattccctcaatgtttgagccagaaagagagaaagtggacgctatcgatggtgaatacaggctgagaggggaagcccgtaagaccttcgtcgacctcatgcgccgaggcgatttgcctgtgtggctggcttatagagttgcagccgagggaataaactacgctgacaggcggtggtgttttgatggcattaaaaataaccagatcctcgaagagaacgtggaagtcgagatttggaccaaggagggggaacgcaagaaactgaagcccagatggcttgacgccaggatctattccgatccactagcactgaaagagttcaaggagttcgcggccggacggaaaagtttgactttaaatctgataacagagatgggtcgactccctacctttatgacacagaaggctagagacgccctggataaccttgcagtgctgcatactgctgaagccggcgggaaggcatacaatcacgccctcagcgagttgccggagacgctggaaaccctactgctccttacactgttagctactgtaaccggaggcatcttcttgtttctgatgtcgggtaaagggattggcaagatgacactcggaatgtgctgcatcattaccgcgtctatcctgctttggtatgcccaaatacagccccactggattgcagcttccatcatcctggagttctttctcattgtgttgctgatcccagaacctgagaaacagcgcactccccaggacaaccaattaacgtacgttgtcatagccattctaaccgtggtggccgcaacaatggctaatgaaatgggcttcctggagaagactaaaaaggacctcgggcttggaagcatcaccacacaggagtcagaaagtaacattctggatatcgacttgaggccagcctctgcgtggaccctgtatgctgtcgccactacatttgttacgcctatgctccggcattccatagagaatagctcagtgaacgtaagtctgaccgcaatcgccaatcaggctactgtgcttatgggtctcggcaaggggtggcccctgagcaaaatggatattggagtcccgttgctggcaatcggctgttactcccaggtgaacccaattacattaaccgccgcgctactgctccttgttgctcactacgccatcattggtcctgggctgcaagcaaaggccacccgtgaagctcagaaaagagccgcagctggcatcatgaagaatcccacagtggacggaataactgtcattgatttggagccaatcccctatgaccctaaattcgaaaagcagctgggccaggtaatgctcctgatcctttgcgtgacgcaagttttaatgatgaggaccacatgggccctgtgtgaggcgctcactttggccaccgggccgatttctacactgtgggagggaaaccccggccgcttttggaataccactatagcagtgagcatggctaacatcttccggggttcctacctagccggggcaggactgctcttttcaattatgaagaatacgacaaacacccgaagaggcactggtaatatcggcgaaacccttggggagaaatggaagtctaggctgaacgctttgggaaaaagtgagttccagatttataagaaatcgggcatccaggaggtcgatcgcacactggccaaggaggggataaaacggggagaaactgaccatcacgccgtgagcagaggctccgcgaagctccgttggtttgtcgagaggaacatggtgaccccagaaggtaaggttgtggatctggggtgcggacggggcggttggtcttactattgtggcgggcttaaaaatgtacgcgaggtgaagggactaacaaaaggcgggcctggacatgaggaaccaatccctatgtcaacgtacggctggaacctggtccgactccaaagcggtgttgacgtgttcttcaccccacccgagaagtgcgatactctactgtgtgacattggggaatccagtcctaatccaacaatcgaggctggaagaaccttgagggtcctgaacctcgtggaaaattggcttaacaataacactcagttttgcattaaagtactgaatccctatatgccgtctgtgatcgagaagatggaaacattgcagcggaagtacggcggcgcactggttcgcaaccctctcagcagaaattcaacccacgagatgtactgggtgtccaacgccacggggaatatagtcagtagcgtgaacatgatttctaggatgttaatcaatcgattcaccatgaaacacaagaaagctacatatgagccagatgtcgacctgggatccggtactcggaacatcggcattgaatcagagatacccaaccttgacatcattgggaagcgtatcgagaaaattaagcaggagcatgaaaccagctggcactacgatcaagaccatccttataagacatgggcctaccacggatcgtatgagactaaacagaccggctctgcaagttccatggtgaatggtgttgtaagactgctaacaaagccatgggatgtggtccccatggtgacccagatggccatgactgacacgacaccgtttgggcagcaacgcgttttcaaagagaaggtggataccaggactcaggaacctaaagagggaaccaagaagctcatgaaaatcacagctgaatggctgtggaaggagttgggcaaaaagaaaacgccccggatgtgtaccagagaggaatttactcgcaaggtcaggagcaacgcggccctgggcgcaatattcacagacgagaataaatggaagtcagctcgagaagccgtggaggattcccggttttgggaactcgtagacagagagaggaaccttcacctggaggggaagtgcgaaacctgtgtgtacaatatgatgggaaaacgcgagaagaaattaggtgagttcggcaaggcaaaagggtctcgtgccatctggtatatgtggctgggagctcggtttttggagttcgaagccctcggctttctgaacgaggatcattggttcagcagaggtaatagtctatccggggttgagggagaaggccttcacaggctgggctacattctcaaggacgtcagcaagaaagaagggggagcgatgtacgcagatgacactgccggttgggacacacgcatcaccctggaagatttgaagaacgaggaaatggtgacaaatcatatgaaaggcgagcacaagaaactggctgaggccatttttaagctcacttatcagaacaaggtggtccgagttcagcggccaacccctagagggacggtgatggacatcatttctaggcgcgatcaaagaggatcaggccaggtaggtacctacgggcttaatacattcactaacatggaagcacagctgatacggcaaatggagggagaaggcatcttcaaaagtattcagcatttaaccgtgacagaggagatcgctgtccagaattggctggccagggtgggccgtgaacgattgtcccgcatggttatcagcggggacgattgcgtggtcaagcccctcgacgatagatttgcttctgccctgactgcactaaacgacatgggaaaagtgcggaaggatattcagcaatgggagccatcgaggggttggaatgactggacccaggtacccttctgctcacaccactttcatgaacttgttatgaaagatggccgcgtgctggtcgtgccttgtagaaaccaggacgagctcatagggcgggcgaggatcagccagggagccggctggtccctgaaggaaacggcttgcttgggtaagagttatgcccaaatgtggacattaatgtacttccaccgacgtgatctgagactcgcagctaacgccatttgttctgcagtgccaagccattgggtcccgacctcccgcactacatggtcaatccacgccaaacacgagtggatgaccactgaggacatgcttgcggtttggaatcgggtgtggattcaggaaaacccctggatggaggacaagacccctgtagaaagttgggaggaagtgccatatctggggaaaagggaggatcagtggtgcggatctctaatcggcctgacaagcagagctacgtgggccaagaatatacagaccgcaatcaaccaagtccgctccctcattggcaatgaggaatacactgactatatgccctcaatgaaacggtttaggcgagaggaagaggaagccggggtgttgtggtga

SEQ ID NO: 14645 - RNA, 9876 nt, synthetic construct
  misc_feature 1..9876: note = derived and/or modified CDS sequence (opt3) from DENV-2__EU482571__SS-prME
  source 1..9876: mol_type = other RNA
accgccggcgtgatcattatgctgatacccacggctatggcattccacctcactacgaggaacggggaacctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtcctcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttctttgcaagcattctatggtggatagaggctggggtaacgggtgtggactcttcggcaagggcgggatcgtaacctgcgccatgtttacatgcaaaaagaatatggaaggaaaagtggtgctgcctgagaaccttgaatacaccattgtcataactccacacagcggtgaggagcatgctgttggcaatgacacggggaagcacggaaaagaaatcaagattacaccgcagtcctcaatcaccgaggccgaactgactggctatggtaccgtgacaatggagtgtagtcccaggaccgggttggatttcaacgaaatggtactcctgcagatggaggacaaagcatggttagtgcaccggcaatggtttctggatctccctcttccatggctgcccggcgctgacactcagggaagcaattggatacagaaggagacattggtcacgttcaagaaccctcatgccaaaaagcaggacgtggttgtgctaggctctcaagaaggggcgatgcacaccgccctgactggagcaacagagattcagatgtcctcaggtaatctcctgtttaccggccatcttaaatgccgtctgcgcatggataagttgcagctcaaagggatgagctacagtatgtgtacaggaaagttcaagatcgtcaaagaaatcgctgagactcaacacggcaccattgtgatcagagtacagtatgagggtgacgggtctccatgcaagattcccttcgaaataatggatctggagaaaaggcatgttttaggccggctgatcacggtgaacccgattgtcaccgaaaaggactcccctgtgaacatcgaggccgaacccccatttggagatagctacatcattataggcgtcgagcctgggcagctaaaactcaattggttcaagaagggatcgtctatcggtcagatgtttgagacaactatgcgaggcgctaaacgcatggccattctgggggacaccgcatgggatttcggatcccttggcggtgtgtttacatcaatcgggaaggccttgcaccaagttttcggcgctatttacggagcggcatttagtggcgtgagctggactatgaaaatcctgataggggtaatcattacctggatcggaatgaactccagatctacgagcctctcagtcagtctggtgcttgttggcgtggtcacactgtatttgggtgccatggtgcaggctgactccgggtgtgtagtgagctggaagaataaagaactcaagtgcggatctggcattttcatcaccgataacgttcacacttggacagagcagtacaagtttcagcccgaatcaccaagtaaactggccagcgcaatacaaaaggcccatgaggaaggtatttgtggcatcaggtccgtcacccggttagagaatctgatgtggaaacagattactcccgagctaaaccacatcctctctgaaaatgaggtgaagctgaccataatgacaggggacatcaaaggaattatgcaggctggcaagcgctcgcttagacctcagccaacggaattgaaatatagctggaagacctgggggaaggccaaaatgctgtccactgagtcacataaccaaacattcctcatcgatggaccggaaaccgcagagtgccccaatacaaacagggcgtggaatagtctggaggtggaagactacggctttggtgtcttcactaccaacatttggttaaagctgcgtgagaaacaggacgtattttgtgattctaaacttatgagcgctgccatcaaagacaatcgggcagtgcacgccgatatggggtattggatagaatccgctttgaacgacacgtggaagatggagaaggcctcattcattgaggtgaaaagctgccactggcctaagtctcatacactctggtccaatggagtactggaaagtgagatgatcatccccaagaatttcgcaggccccgtcagccagcacaactaccgacctggttatcatacccagactgctggcccatggcacctagggaagctggaaatggattttgacttctgtgagggaaccacagtggttgtgactgaagattgcggcaatagagggccctctctcaggaccacaacggcctccggaaaactgattaccgagtggtgctgtcgctcatgcactcttccgcctttgcggtacagaggcgaggacggttgttggtacgggatggaaatcaggccactgaaggagaaggaagagaacttagtcaatagtctcgtgacagcgggacatggccaaattgataactttagcctgggtgttcttggcatggccctgttcttggaagagatgctccgcacccgagtggggactaaacacgctatactgctagtagcagtctcgtttgtgacactgatcaccggaaatatgtccttccgggacctcggccgtgtgatggtcatggttggggccacgatgactgatgacattggaatgggcgtgacctatctggctcttttggccgcatttaaggtaagacccacattcgcggccggtctgttactcaggaaactgacctctaaggagcttatgatggctactatcgggattgccctgctaagccagtcaacaatccctgaaaccatactcgagctgacagatgcattggctctgggaatgatggtgttaaaaatcgtccgcaacatggaaaagtaccagctcgccgtgactattatggcaatcagttgcgttcccaatgccgtgattctgcaaaacgcttggaaggtctcctgtaccatccttgcggccgtgtctgttagcccactgttgctcacgtcctcacagcagaaagcagactggatacctctggctctaacaattaagggcctgaatcccaccgccatctttcttactaccctcagccggacaagtaaaaagagatcttggccactgaacgaggccatcatggctgtgggcatggtctccattttggcaagctcgctgctaaagaatgacataccgatgactgggcctctcgtagccggaggtctgcttaccgtgtgctatgttctgacgggcaggtcagcggatttggaactcgagcgagctgccgacgtgaagtgggaggatcaggcagaaatctctgggagttcccccattctgagcatcacaatttctgaggacggaagcatgtccatcaaaaacgaagaggaggaacaaaccctaactatactgatccgcacaggccttctcgtcatttcaggtgtgttcccagtaagtatccccattaccgccgctgcatggtacctgtgggaggtgaagaagcagcgggccggggtcttgtgggatgttcctagcccaccccctgtgggaaaagcggaattagaggacggcgcttatagaatcaagcagaggggcatactggggtactctcagattggagccggtgtgtataaagaaggcacttttcacacaatgtggcatgtcacccgtggggcagtgctcatgcaccgcggaaagcggatcgagccgtcctgggccgatgttaaaaaggacctgatctcatacggcggtgggtggaaacttgagggagaatggaaagagggcgaagaggtacaagtgctggctttggaaccaggcaagaatcccagagccgtccagacgaaacctgggctattcaagactaacaccggaacaattggtgcagtgagtctggattttagcccaggcacctccgggtctcccatcgttgacaggaaaggaaaggtggtcggcctctacggtaatggggtggtaacacgatcgggagcttatgtcagcgccatagcgcagactgagaagtcaattgaggataaccctgaaatcgaggacgatattttccggaaaaagcgcctgaccatcatggaccttcatccgggcgccggcaaaacgaagagatacttacccgcaatagtgagggaagctattaaacgggggctgcgaacactcatcttggccccaactagagttgtggctgcagagatggaagaggccctgcgcggactccctatcaggtatcagacccccgccattcgtgctgagcacacaggtcgggaaatcgtcgacctgatgtgtcatgcgaccttcactatgagacttctgtccccagtgagggttcctaactacaatttgattataatggatgaggcacactttaccgaccccgccagtatcgctgcccgcggctatatttctacacgagtggaaatgggggaggcagccggaatcttcatgacggctactccaccgggcagcagagatccttttccccaatccaacgcgccaatcatggacgaggaacgggagattcccgaaaggtcatggaactctggtcacgagtgggtcaccgatttcaaggggaagacagtgtggtttgtacctagcataaaagccggaaacgacatcgcagcttgcctacgcaagaatggcaaaaaggtgattcagctgagtcgtaaaaccttcgattccgaatacgttaagactagagccaacgactgggattttgtcgtgacaaccgacatcagcgagatgggcgcaaatttcaaggccgagcgggtgattgatccaaggcgctgtatgaaacccgtcatcctcacggacggggaagaacgagtaatattagctggacctatgccggtgactcattcttcagccgcgcagagacggggtaggatcggccgcaacccaaagaatgaaaacgaccaatatatttacatgggggagcccctggaaaatgatgaggactgcgcacactggaaagaggccaagatgcttctggataacatcaatacacctgaaggaattatcccctccatgtttgagccagaaagagagaaagttgacgctatagatggcgaatacaggctccggggtgaggcccgtaagaccttcgtggacttgatgcgccgaggggatctgcctgtctggctcgcttatagagtggcagccgagggcattaactacgctgacaggcggtggtgttttgatggaatcaaaaataaccagattctggaagagaacgttgaagtggagatctggaccaaggagggcgaacgcaagaaacttaagcccagatggctagacgccaggatatatagtgatccactggcattgaaagagttcaaggagttcgcggccgggcgaaagagcttaactctgaatctcatcacagagatgggacggctgcctacctttatgacacagaaggctagagacgcccttgataacctggcagtcctccatactgctgaagccggtggccgcgcatacaatcacgccttgtcggagctgccggagacgctagaaaccctgctccttctgacattattggctactgtgaccgggggaattttcctgtttctcatgtctggcaagggtatcgggaaaatgacactgggcatgtgctgcattatcaccgcgtccatacttctgtggtatgcccagattcaaccccactggatcgcagctagcatcattctcgagttctttttgatcgtactgttaataccagaacctgagaagcagaggactccccaggacaaccagctaacgtacgtggttattgccatcctgaccgtcgtggccgcaacaatggctaatgaaatgggattcctcgagaaaactaagaaagaccttggcctggggtcaattaccacacaagagagtgaatctaacatcttggatatagacctgcggccagcctccgcgtggaccctctatgctgtggccactacatttgtcacgcctatgctgcgtcatagcatcgaaaattcaagtgttaacgtgagccttaccgcaattgccaatcaggctactgtactcatgggactgggtaagggctggcccttgtccaagatggatatcggggtgccgctgttagcaattggatgttactctcaggtcaacccaatcacactaaccgccgcgctgctccttctggtggctcactacgccattatcggccctggtttgcaggcaaaagccaccagagaagctcaaaagagggccgcagctgggataatgaaaaatcccacagttgacggcattactgtgatcgatctggagccaatcccctatgaccctaagttcgaaaaacagctcggacaggtcatgctgcttattttatgcgtaacacaggtgctgatgatgcgcaccacatgggccctctgtgaggcgttgactctggccaccggcccgataagcacactatgggaggggaaccccggacggttttggaataccactatcgcagtttccatggctaacattttccgaggctcatacctggccggtgcagggctcctattttctatcatgaagaatacgacaaacaccagaaggggaactggcaatattggtgaaaccctgggcgagaagtggaaaagtcgcttgaacgctctggggaagtcggagttccaaatctataaaaagagcggaatacaggaggtggatcggacactcgccaaagagggcatcaagagaggggaaactgaccatcacgccgtctcccgtggatctgcgaaactgaggtggtttgtggagcggaacatggtcaccccagaaggcaaggtggttgatttaggttgcgggcgcggaggctggtcatactattgtggtggccttaagaatgtgcgagaggtaaaagggctgacaaagggaggccctgggcatgaagaaccaattcctatgagcacgtacggatggaacctcgtgagactacagtccggcgtcgacgttttcttcaccccacccgagaaatgcgatactctgttgtgtgacatcggtgaaagttctcctaatccaacaattgaggctgggaggaccctgcgggtgctcaaccttgtcgaaaattggctgaacaataacactcaattttgcatcaaggtgttgaatccctatatgccgagcgtaatagagaaaatggaaacactgcagcgcaagtacggaggcgcactcgtgagaaaccctttatcaagaaattccacccacgagatgtactgggttagtaacgccacgggcaatattgtgagctctgtcaacatgatctcccgaatgctgatcaatcggttcaccatgaagcacaaaaaggctacatatgagccagatgtggaccttgggtcaggaactcgtaacattggtatagaaagcgagatccccaacctggacattatcggcaaaagaattgaaaagatcaaacaggagcatgaaacctcgtggcactacgatcaggaccatccttataagacatgggcctaccacgggtcttatgagactaagcaaaccggaagtgcatccagcatggtcaatggcgtggttcgcctactcacaaaaccatgggatgtagtgcccatggtcacccagatggccatgactgacacgacaccgtttggtcagcagagggtgttcaaggagaaagttgatacccggactcaagaacctaaggaggggaccaaaaagctgatgaagataacagctgcgtggttgtggaaagaactgggaaagaaaaagacgcccagaatgtgtacccgcgaggagtttactaggaaagtgcgatcaaacgccgcactcggcgctatcttcacagacgaaaataagtggaaatccgcccgggaggcagtcgaagattctagattttgggagcttattgacagggaacgcaacctgcacttagagggcaagtgcgagacctgtgtgtacaatatgatggggaagcgtgagaagaaactgggagagttcggtaaagccaagggcagccgggctatctggtatatgtggttgggggccagatttctcgagttcgaggcgctgggatttctaaacgaagatcattggttcagtaggggcaattcccttagcggtgtagagggggagggactgcaccgcctcggctacattctgcgagacgtgtctaaaaaggaaggcggggcaatgtacgccgatgacactgctggatgggacacacggatcaccttggaggatctgaagaacgaagagatggttacaaatcatatgaaaggtgaacacaagaaactcgccgaggcaatttttaaacttacttatcagaacaaagtcgtgagagtgcagaggccaacccctcgcggcacggtcatggacataatctcaagacgggatcagagggggagtggacaagttggcacctacggtctgaatacattcactaacatggaggctcagttaattcgtcagatggaaggggagggaatcttcaagtccatccaacatctgaccgtgacagaagagattgccgtacagaattggttggctcgagtgggccgcgagagactcagccggatggccatatctggcgacgattgcgtcgtgaagcccctggacgataggtttgcatcggcgctaactgcccttaacgacatggggaaagttcgcaaggatatccagcagtgggaaccatcaagaggatggaatgactggacccaagtgcccttctgcagccaccactttcatgagctggtcatgaaagatggtcgggtgctcgtagttccttgtaggaaccaggacgaactgattggccgagctcgtatctcccagggggccggatggagtttgaaggagacggcatgcttaggcaaatcttatgctcagatgtggacactgatgtacttccacagacgcgatctccggcttgccgcaaacgccatttgtagcgcggtgccatcccattgggtcccgacctcaaggactacatggagtatccacgctaagcacgaatggatgaccactgaggacatgctggccgtgtggaatagagtgtggatacaagagaacccctggatggaagacaagacccctgtcgagtcttgggaagaggttccatatctaggtaaacgcgaagatcagtggtgcgggagcctgatcggactcacatcccgggcaacgtgggccaagaatattcagaccgctatcaaccaggtgaggtcattgattggcaatgaggagtacactgactatatgcccagcatgaaacgatttagacgggaagaggaagaggccggcgtactgtggtga

SEQ ID NO: 14646 - RNA, 9876 nt, synthetic construct
  misc_feature 1..9876: note = derived and/or modified CDS sequence (opt3) from DENV-2__EU482572__SS-prME
  source 1..9876: mol_type = other RNA
accgcaggcgtgatcattatgctgataccaacagctatggcattccacctcactacgcggaacggggaacctcatatgatcgtcggaaggcaggaaaaaggtaaaagccttctgtttaagaccgaagacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtcgcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttctatgcaagcattctatggtggatagaggctggggtaacgggtgtggactcttcggcaagggcgggatcgtaacctgcgccatgtttacatgcaaaaagaatatggaaggaaaagtggtgcagcctgagaacctggaatacaccattgtcataactccacacagcggtgaggagcatgctgttggcaatgacacggggaagcacggaaaagaaatcaagattacaccgcagtcctcaatcaccgaggccgaacttactggctatggtaccgtgacaatggagtgtagtcccaggaccgggctggatttcaacgaaatggtattgctccaaatggaggacaaagcatggctggtgcaccggcagtggtttttagatctgcctctcccatggcttcccggcgctgacactcagggaagcaattggatacagaaggagacactggtcacgttcaagaaccctcatgccaaaaagcaagacgtggttgtgttgggctctcaggaaggggcgatgcacaccgccctaactggagcaacagagattcagatgtcctcaggtaatctgctctttaccggccatctgaaatgccgtcttcgcatggataagctgcaattgaaagggatgagctacagtatgtgtacaggaaagttcaagatcgtcaaagaaatcgctgagactcagcacggcaccattgtgatcagagtacagtatgagggtgacgggtctccatgcaagattcccttcgaaataatggatctcgagaaaaggcatgttctgggccggttaatcacggtgaacccgattgtcaccgaaaaggactcccctgtgaacatcgaggccgaacccccatttggagatagctacatcattataggcgtcgagcctgggcagctgaaactaaattggttcaagaagggatcgtctatcggtcaaatgtttgagacaactatgcgaggcgctaaacgcatggccattctcggggacaccgcatgggatttcggatccctgggcggtgtgtttacatcaatcgggaaggcccttcaccaggttttcggcgctatttacggagcggcatttagtggcgtgagctggactatgaaaatcttgataggggtaatcattacctggatcggaatgaactccagatctacgagcctgtcagtcagtctcgtgctggttggcgtggtcacactttatctgggtgccatggtgcaggctgactccgggtgtgtagtgagctggaagaataaagaattgaagtgcggatctggcattttcatcaccgataacgttcacacttggacagagcagtacaagtttcaacccgaatcaccaagtaaactcgccagcgcaatacagaaggcccatgaggaaggtatttgtggcatcaggtccgtcacccggctggagaatttaatgtggaaacaggtgactcccgagctgaaccacattctatctgaaaatgaggtgaagctcaccatcatgacaggggacataaaaggaatcatgcaggctggcaagcgctcgctgagacctcaaccaacggaacttaaatatagctggaagacctgggggaaggccaaaatgttgtccactgagtcacataaccagacattcctgattgatggaccggaaaccgcagagtgccccaatacaaacagggcgtggaatagtctcgaggtcgaagactacggctttggtgttttcactaccaacatctggctgaagttacgtgagaaacaggacgtgttttgtgattctaagctgatgagcgctgccattaaagacaatcgggcagtgcacgccgatatggggtattggatcgaatccgctcttaacgacacgtggaagatggagaaggcctcattcatagaggtaaaaagctgccactggcctaagtctcatacattgtggtccaatggagtcctcgaaagtgagatgattatccccaaaaatttcgcaggccccgtgagccagcacaactaccgacctggttatcatacccaaactgctggcccatggcacctggggaagctagaaatggattttgacttctgtgagggaaccacagttgtggtcactggcgattgcgggaatagaggaccctctctgaggaccacaacggcctccggcaaactcatcaccgaatggtgctgtcgctcatgcactctgccgcctcttcggtacagaggtgaggacgggtgttggtacggaatggagattaggccattgaaggaaaaggaggaaaacctggtgaatagtttagttacagcgggccatggtcagatcgataactttagcctcggcgtgctggggatggcccttttcctggaggaaatgttgcgcacccgagtaggaactaaacacgctattctcctggtcgcagtgtcgtttgtgacactaataaccggcaatatgtccttccgggacctggggcgtgtcatggttatggtgggagccacgatgactgatgacatcggcatgggtgtaacctatctcgctctgcttgccgcatttaaggtgagacccacattcgcggccgggttgctgttaaggaaactcacctctaaggagctgatgatggctactattggaatcgcccttctgagccagtcaacaattcctgagaccatcctagaactcacagatgcactggctttgggcatgatggtcctgaaaatagtgcgcaacatggagaagtaccaattagccgttactatcatggcaattagttgcgtgcccaatgccgtcatcctccagaacgcttggaaggtgtcctgtaccattctggcggttgtgtctgtcagcccacttctgttgacgtcctcacagcagaaagccgactggatccctctcgcactgacaataaagggcctaaatcccaccgctatttttctgactacccttagccggacaagtaaaaagagatcttggccactcaacgaagccatcatggccgtagggatggtgtccatcctggctagctcgttgctgaaaaatgacattccgatgactggacctttagttgccggtggcctcctgaccgtgtgctatgtccttacggggaggtcagccgatctggagttggaacgagcggctgacgtgaagtgggaggatcaagccgagatatctggaagttcccccatcctcagcattacaatctctgaagacggcagcatgtccattaaaaacgaggaagaggagcagaccctgactatcctaatacgcacaggtctgcttgtaatctcaggggtgttcccagtcagtattcccatcaccgcagccgcttggtacctctgggaagttaagaagcagcgggcaggagtgctgtgggatgtgcctagcccaccccctgtcggcaaagccgagttggaagacggcgcgtatagaattaagcagagggggatcttaggatactctcaaataggtgctggcgtgtataaagaggggacttttcacacaatgtggcatgttacccgtggagccgtactgatgcaccgcggcaagcggattgaaccgtcctgggcagatgtgaaaaaggacctcatctcatacggtgggggatggaagctggagggcgagtggaaagaaggcgaggaagtccaggtgcttgccctggagccagggaagaatcccagagctgttcagacgaaacctggattgttcaagactaacaccggtacaatcggcgccgtgagtctagattttagcccagggacctccggatctcccattgtcgacaggaaaggcaaggtggtaggtctgtacgggaatggagtcgtgacacgatcgggcgcatatgttagcgctatcgcccagactgaaaagtcaatagaggataaccctgagattgaagacgatatcttccggaaaaagcgcctcaccattatggacctgcatccgggcgcggggaaaacgaagagataccttcccgccatcgtgagggaggcaataaaacggggattacgaacactgattctcgctccaactagagtcgtggccgctgaaatggaggaagcattgcgcggtctgcctatcaggtatcaaacccccgccatccgtgccgagcacacaggccgggagattgttgacctcatgtgtcatgctaccttcactatgagactgctttccccagtgagggtccctaactacaatctgatcattatggatgaagcgcactttaccgaccccgcaagtatagccgctcgcgggtatatctctacacgagtggagatgggagaagccgcaggcattttcatgacggccactccaccgggtagcagagatccttttccccagtccaacgctccaatcatggacgaggagcgggaaatccccgagaggtcatggaactctgggcacgaatgggtaaccgatttcaagggaaagacagtgtggtttgttcctagcattaaagcgggcaacgacatagccgcatgcttgcgcaagaatggcaaaaaggtcatccagctaagtcgtaaaaccttcgattccgagtacgtgaagactagagctaacgactgggattttgtggtcacaaccgacattagcgaaatgggggccaatttcaaggcagagcgggtaatcgatccaaggcgctgtatgaaacccgtgattctgacggacggagaggaacgagttatcctcgccggtcctatgccggtgactcattcttcagctgcccaaagacggggcaggatagggcgcaacccaaagaatgagaacgaccagtatatctacatgggagaacccttagagaatgatgaagactgcgcgcactggaaagaggcaaagatgctgcttgataacattaatacacctgagggcatcattccctccatgtttgaaccagagagagaaaaagtcgacgccatcgatggtgagtacaggctgagaggggaagctcgtaagaccttcgtggacctcatgcgccgaggcgatttgcctgtttggctggcctatagagtggctgcagagggaataaactacgccgacaggcggtggtgttttgatggcattaaaaataaccagatcctcgaggaaaacgtcgaggtggaaatttggaccaaggagggggagcgcaagaaactgaagcccagatggcttgacgctaggatctatagtgatccactagccctgaaagagttcaaggagttcgcagcgggacgaaagagcttgactttaaatctgataacagaaatgggtcggctccctacctttatgacacagaaggccagagacgctctggataaccttgccgtactgcatactgcagaggctggcgggaaggcctacaatcacgcactctcggaattgccggagacgctggagaccctactgctccttacactgttagccactgtgaccggaggcatcttcttgtttctgatgtctggtaaagggattggcaagatgacactcggaatgtgctgcatcattaccgcttccatcctgctttggtatgcgcaaatacagccccactggattgccgcaagcatcatcctggagttctttctcattgttttgctgatcccagagcctgaaaaacagcgcactccccaggacaaccaattaacgtacgtcgtgatagctattctaaccgtggtcgccgccacaatggcaaatgagatgggcttcctggaaaagactaaaaaggacctcgggcttggatcaatcaccacacaggagagtgagtctaacattctggatatcgacttgaggccagcttccgcctggaccctgtatgcggttgctactacatttgtgacgcctatgctccggcatagcatagaaaattcaagtgtaaacgtgagcctgaccgccatcgcaaatcaggccactgtccttatgggtctcggcaaggggtggcccctgtccaaaatggatattggagtgccgttgctggctatcggctgttactctcaggttaacccaattacattaaccgcagccctactgctccttgtggcgcactacgctatcattggtcctgggctgcaagccaaggcaacccgtgaggcccagaaaagagctgccgcaggcatcatgaagaatcccacagtcgacggaataactgtaattgatttggaaccaatcccctatgaccctaaattcgagaagcagctgggccaggtgatgctcctgatcctttgcgttacgcaagtgatgatgatgaggaccacatgggctttatgtgaagccctgactctcgcgaccgggccgattagcacattgtgggagggaaaccccggccgcttttggaataccactatagccgtctccatggcaaacatcttccggggttcatacctggctggggccggactactgttttctattatgaagaatacgacaaacacccgaagaggcactggtaatatcggcgagaccctcggggaaaaatggaagagtaggcttaacgcactgggaaaatcggagttccagatttataagaaaagcggcatccaggaagtggatcgcacattggctaaggaggggataaaacggggagagactgaccatcacgccgtctccagaggctctgccaagctgcgttggtttgtggaaaggaacatggttaccccagagggtaaggtggtagatctcgggtgcggacggggcggttggtcatactattgtggcgggctgaaaaatgtgcgcgaagtcaagggattaacaaaaggcgggcctggacatgaggaacccatccctatgagcacgtacggctggaaccttgttcgactgcaatccggtgtggacgtcttcttcaccccacccgagaagtgcgatactctcctatgtgacattggggagagttctcctaatccaacaatcgaagcgggaagaaccctgagggtgttgaacctggtagagaattggctcaacaataacactcagttttgcattaaagtgcttaatccctatatgccgagcgttatcgaaaagatggagacactgcagcggaagtacggcggcgctttggtgcgcaaccctctgtcaagaaattccacccacgaaatgtactgggtcagtaacgcaacggggaatatagtgagctctgtcaacatgatttccaggatgctcatcaatcgattcaccatgaaacacaagaaagccacatatgagccagatgtggacttaggatcaggtactcggaacatcggcattgagagcgaaatacccaacctggacatcattgggaagcgtatcgagaaaattaagcaggaacatgagacctcgtggcactacgatcaagaccatccttataagacatgggcttaccacggatcttatgaagccaaacagactggcagtgcatccagcatggttaatggtgtagtgagacttctgaccaagccatgggatgtcgtgcccatggttacacagatggccatgaccgacactacgccgtttgggcagcaacgcgtgttcaaagagaaggtcgatacaaggacccaggagcctaaagaaggaactaagaagctaatgaaaatcaccgctgagtggctctggaaggaactgggcaaaaagaaaacaccccggatgtgtacgagagaggagtttacccgcaaggtgaggtcaaacgcggccttgggcgcaatattcactgacgaaaataaatggaagtccgctcgagaggccgtagaagattctcggttttgggagctggtggacagagaaaggaacctccaccttgaggggaagtgcgagacatgtgtttacaatatgatgggaaaacgcgaaaagaaactgggtgagttcggcaaggcaaaagggagccgtgccatctggtatatgtggttaggagctcggtttctggagttcgaggccttgggctttctcaacgaagatcattggttcagtagaggtaattccctgagcggggtcgagggagagggcctacacaggcttggctacattctgcgcgacgtgtctaagaaggaagggggagcgatgtacgcagatgacaccgccggttgggacactcgaatcacactcgaggatctgaaaaacgaagagatggtgaccaatcatatgaagggcgaacacaaaaagttggctgaggccatttttaaactgacatatcagaacaaggtcgttcgggtgcagagaccaactcctagggggaccgtaatggacatcatttcacgcagagatcaacggggaagtggccaggtgggtacgtacgggctcaataccttcacaaacatggaggcacagcttataaggcaaatggaaggagagggcatcttcaagtccattcagcatctgactgtcaccgaagagatcgctgtgcagaattggttagcccgtgttggccgagagcgcctgagcagaatggtgatctctggggacgattgcgtcgtgaaacccttggacgatcggtttgcttcggccctcacagcactgaacgacatgggaaaggtaaggaaagatattcagcaatgggaaccatcacgcggttggaatgactggactcaggttcccttctgcagccaccactttcatgagctagtgatgaaggatggcagagtccttgtggtgccttgtcggaaccaggacgaactgatagggagggcgcgaatctcccagggagccggctggagtctcaaagagaccgcttgcctgggtaagtcttatgcccaaatgtggacgttgatgtacttccaccgtagagatttacgcctggcagctaacgccatttgtagcgcagtcccatcccattgggttccgacatcacggaccacttggagtatccacgccaagcacgaatggatgacaaccgaggacatgctcgcggtgtggaatagggtatggattcaggagaacccctggatggaagacaaaactcctgtggagtcttgggaagaggtcccatatcttgggaagagagaagatcagtggtgcggaagcctgatcggcctaacctcccgcgctacatgggccaaaaatatacagacggcaatcaaccaagtgcggtcactgattggcaatgaggagtacaccgactatatgcccagcatgaagaggtttcgaagagaagaggaagaggccggggttctctggtga

SEQ ID NO: 14647 - RNA, 9876 nt, synthetic construct
  misc_feature 1..9876: note = derived and/or modified CDS sequence (opt3) from DENV-2__EU482573__SS-prME
  source 1..9876: mol_type = other RNA
accgccggcgtgatcattatgctgatacccacggctatggcattccacctcactacgaggaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtcctcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttctttgcaagcattctatggtggatagaggctggggtaacgggtgtggactcttcggcaagggcgggatcgtaacctgcgccatgtttacatgcaaaaagaatatggaaggaaaagtggtgctgcctgagaaccttgaatacaccattgtcataactccacacagcggtgaggagcatgctgttggcaatgacacggggaagcacggaaaagaaatcaagattacaccgcagtcctcaatcaccgaggccgaactgactggctatggtaccgtgacaatggagtgtagtcccaggaccgggttggatttcaacgaaatggtactcctgcagatggaggacaaagcatggttagtgcaccggcaatggtttctggatctccctcttccatggctgcccggcgctgacactcagggaagcaattggatacagaaggagacattggtcacgttcaagaaccctcatgccaaaaagcaggacgtggttgtgctaggctctcaagaaggggcgatgcacaccgccctgactggagcaacagagattcagatgtcctcaggtaatctcctgtttaccggccatcttaaatgccgtctgcgcatggataagttgcagctcaaagggatgagctacagtatgtgtacaggaaagttcaagatcgtcaaagaaatcgctgagactcaacacggcaccattgtgatcagagtacagtatgagggtgacgggtctccatgcaagattcccttcgaaataatggatctggagaaaaggcatgttttaggccggctgatcacggtgaacccgattgtcaccgaaaaggactcccctgtgaacatcgaggccgaacccccatttggagatagctacatcattataggcgtcgagcctgggcagctaaaactcaattggttcaagaagggatcgtctatcggtcagatgtttgagacaactatgcgaggcgctaaacgcatggccattctgggggacaccgcatgggatttcggatcccttggcggtgtgtttacatcaatcgggaaggccttgcaccaagttttcggcgctatttacggagcggcatttagtggcgtgagctggactatgaaaatcctgataggggtaatcattacctggatcggaatgaactccagatctacgagcctctcagtcagtctggtgcttgttggcgtggtcacactgtatttgggtgccatggtgcaggctgactccgggtgtgtagtgagctggaagaataaagaactcaagtgcggatctggcattttcatcaccgataacgttcacacttggacagagcagtacaagtttcagcccgaatcaccaagtaaactggccagcgcaatacaaaaggcccatgaggaaggtatttgtggcatcaggtccgtcacccggttagagaatctgatgtggaaacagattactcccgagctaaaccacatcctctctgaaaatgaggtgaagctgaccataatgacaggggacatcaaaggaattatgcaggctggcaagcgctcgcttagacctcagccaacggaattgaaatatagctggaagacctgggggaaggccaaaatgctgtccactgagtcacataaccaaacattcctcatcgatggaccggaaaccgcagagtgccccaatacaaacagggcgtggaatagtctggaggtggaagactacggctttggtgtcttcactaccaacatttggttaaagctgcgtgagaaacaggacgtattttgtgattctaaacttatgagcgctgccatcaaagacaatcgggcagtgcacgccgatatggggtattggatagaatccgctttgaacgacacgtggaagatggagaaggcctcattcattgaggtgaaaagctgccactggcctaagtctcatacactctggtccaatggagtactggaaagtgagatgatcatccccaagaatttcgcaggccccgtcagccagcacaactaccgacctggttatcatacccagactgctggcccatggcacctagggaagctggaaatggattttgacttctgtgagggaaccacagtggttgtgactgaagattgcggcaatagagggccctctctcaggaccacaacggcctccggaaaactgattaccgagtggtgctgtcgctcatgcactcttccgcctttgcggtacagaggcgaggacggttgttggtacgggatggaaatcaggccactgaaggagaaggaagagaacttagtcaatagtctcgtgacagcgggacatggccaaattgataactttagcctgggtgttcttggcatggccctgttcttggaagagatgctccgcacccgagtggggactaaacacgctatactgctagtagcagtctcgtttgtgacactgatcaccggaaatatgtccttccgggacctcggccgtgtgatggtcatggttggggccacgatgactgatgacattggaatgggcgtgacctatctggctcttttggccgcatttaaggtaagacccacattcgcggccggtctgttactcaggaaactgacctctaaggagcttatgatggctactatcgggattgccctgctaagccagtcaacaatccctgaaaccatactcgagctgacagatgcattggctctgggaatgatggtgttaaaaatcgtccgcaacatggaaaagtaccagctcgccgtgactattatggcaatcagttgcgttcccaatgccgtgattctgcaaaacgcttggaaggtctcctgtaccatccttgcggccgtgtctgttagcccactgttgctcacgtcctcacagcagaaagcagactggatacctctggctctaacaattaagggcctgaatcccaccgccatctttcttactaccctcagccggacaagtaaaaagagatcttggccactgaacgaggccatcatggctgtgggcatggtctccattttggcaagctcgctgctaaagaatgacataccgatgactgggcctctcgtagccggaggtctgcttaccgtgtgctatgttctgacgggcaggtcagcggatttggaactcgagcgagctgccgacgtgaagtgggaggatcaggcagaaatctctgggagttcccccattctgagcatcacaatttctgaggacggaagcatgtccatcaaaaacgaagaggaggaacaaaccctaactatactgatccgcacaggccttctcgtcatttcaggtgtgttcccagtaagtatccccattaccgccgctgcatggtacctgtgggaggtgaagaagcagcgggccggggtcttgtgggatgttcctagcccaccccctgtgggaaaagcggaattagaggacggcgcttatagaatcaagcagaggggcatactggggtactctcagattggagccggtgtgtataaagaaggcacttttcacacaatgtggcatgtcacccgtggggcagtgctcatgcaccgcggaaagcggatcgagccgtcctgggccgatgttaaaaaggacctgatctcatacggcggtgggtggaaacttgagggagaatggaaagagggcgaagaggtacaagtgctggctttggaaccaggcaagaatcccagagccgtccagacgaaacctgggctattcaagactaacaccggaacaattggtgcagtgagtctggattttagcccaggcacctccgggtctcccatcgttgacaggaaaggaaaggtggtcggcctctacggtaatggggtggtaacacgatcgggagcttatgtcagcgccatagcgcagactgagaagtcaattgaggataaccctgaaatcgaggacgatattttccggaaaaagcgcctgaccatcatggaccttcatccgggcgccggcaaaacgaagagatacttacccgcaatagtgagggaagctattaaacgggggctgcgaacactcatcttggccccaactagagttgtggctgcagagatggaagaggccctgcgcggactccctatcaggtatcagacccccgccattcgtgctgagcacacaggtcgggaaatcgtcgacctgatgtgtcatgcgaccttcactatgagacttctgtccccagtgagggttcctaactacaatttgattataatggatgaggcacactttaccgaccccgccagtatcgctgcccgcggctatatttctacacgagtggaaatgggggaggcagccggaatcttcatgacggctactccaccgggcagcagagatccttttccccaatccaacgcgccaatcatggacgaggaacgggagattcccgaaaggtcatggaactctggtcacgagtgggtcaccgatttcaaggggaagacagtgtggtttgtacctagcataaaagccggaaacgacatcgcagcttgcctacgcaagaatggcaaaaaggtgattcagctgagtcgtaaaaccttcgattccgaatacgttaagactagagccaacgactgggattttgtcgtgacaaccgacatcagcgagatgggcgcaaatttcaaggccgagcgggtgattgatccaaggcgctgtatgaaacccgtcatcctcacggacggggaagaacgagtaatattagctggacctatgccggtgactcattcttcagccgcgcagagacggggtaggatcggccgcaacccaaagaatgaaaacgaccaatatatttacatgggggagcccctggaaaatgatgaggactgcgcacactggaaagaggccaagatgcttctggataacatcaatacacctgaaggaattatcccctccatgtttgagccagaaagagagaaagttgacgctatagatggcgaatacaggctccggggtgaggcccgtaagaccttcgtggacttgatgcgccgaggggatctgcctgtctggctcgcttatagagtggcagccgagggcattaactacgctgacaggcggtggtgttttgatggaatcaaaaataaccagattctggaagagaacgttgaagtggagatctggaccaaggagggcgaacgcaagaaacttaagcccagatggctagacgccaggatatatagtgatccactggcattgaaagagttcaaggagttcgcggccgggcgaaagagcttaactctgaatctcatcacagagatgggacggctgcctacctttatgacacagaaggctagagacgcccttgataacctggcagtcctccatactgctgaagccggtggccgcgcatacaatcacgccttgtcggagctgccggagacgctagaaaccctgctccttctgacattattggctactgtgaccgggggaattttcctgtttctcatgtctggcaagggtatcgggaaaatgacactgggcatgtgctgcattatcaccgcgtccatacttctgtggtatgcccagattcaaccccactggatcgcagctagcatcattctcgagttctttttgatcgtactgttaataccagaacctgagaagcagaggactccccaggacaaccagctaacgtacgtggttattgccatcctgaccgtcgtggccgcaacaatggctaatgaaatgggattcctcgagaaaactaagaaagaccttggcctggggtcaattaccacacaagagagtgaatctaacatcttggatatagacctgcggccagcctccgcgtggaccctctatgctgtggccactacatttgtcacgcctatgctgcgtcatagcatcgaaaattcaagtgttaacgtgagccttaccgcaattgccaatcaggctactgtactcatgggactgggtaagggctggcccttgtccaagatggatatcggggtgccgctgttagcaattggatgttactctcaggtcaacccaatcacactaaccgccgcgctgctccttctggtggctcactacgccattatcggccctggtttgcaggcaaaagccaccagagaagctcaaaagagggccgcagctgggataatgaaaaatcccacagttgacggcattactgtgatcgatctggagccaatcccctatgaccctaagttcgaaaaacagctcggacaggtcatgctgcttattttatgcgtaacacaggtgctgatgatgcgcaccacatgggccctctgtgaggcgttgactctggccaccggcccgataagcacactatgggaggggaaccccggacggttttggaataccactatcgcagtttccatggctaacattttccgaggctcatacctggccggtgcagggctcctattttctatcatgaagaatacgacaaacaccagaaggggaactggcaatattggtgaaaccctgggcgagaagtggaaaagtcgcttgaacgctctggggaagtcggagttccaaatctataaaaagagcggaatacaggaggtggatcggacactcgccaaagagggcatcaagagaggggaaactgaccatcacgccgtctcccgtggatctgcgaaactgaggtggtttgtggagcggaacatggtcaccccagaaggcaaggtggttgatttaggttgcgggcgcggaggctggtcatactattgtggtggccttaagaatgtgcgagaggtaaaagggctgacaaagggaggccctgggcatgaagaaccaattcctatgagcacgtacggatggaacctcgtgagactacagtccggcgtcgacgttttcttcaccccacccgagaaatgcgatactctgttgtgtgacatcggtgaaagttctcctaatccaacaattgaggctgggaggaccctgcgggtgctcaaccttgtcgaaaattggctgaacaataacactcaattttgcatcaaggtgttgaatccctatatgccgagcgtaatagagaaaatggaaacactgcagcgcaagtacggaggcgcactcgtgagaaaccctttatcaagaaattccacccacgagatgtactgggttagtaacgccacgggcaatattgtgagctctgtcaacatgatctcccgaatgctgatcaatcggttcaccatgaagcacaaaaaggctacatatgagccagatgtggaccttgggtcaggaactcgtaacattggtatagaaagcgagatccccaacctggacattatcggcaaaagaattgaaaagatcaaacaggagcatgaaacctcgtggcactacgatcaggaccatccttataagacatgggcctaccacgggtcttatgagactaagcaaaccggaagtgcatccagcatggtcaatggcgtggttcgcctactcacaaaaccatgggatgtagtgcccatggtcacccagatggccatgactgacacgacaccgtttggtcagcagagggtgttcaaggagaaagttgatacccggactcaagaacctaaggaggggaccaaaaagctgatgaagataacagctgaatggttgtggaaagagctgggaaagaaaaagacgcccagaatgtgtacccgcgaggaatttactaggaaagtgcgatcaaacgcggccctcggcgcaatcttcacagacgagaataagtggaaatccgctcgggaagccgtcgaggattctagattttgggaacttattgacagggagcgcaacctgcacttagagggcaagtgcgaaacctgtgtgtacaatatgatggggaagcgtgagaaaaagctgggagagttcggtaaagcaaagggcagccgggccatctggtatatgtggttgggggctagatttctcgagttcgaagccctgggatttctaaacgaggatcattggttcagtaggggcaattcccttagcggtgtagagggggaaggactgcaccgcctcggctacattctgcgagacgtgtctaaaaaggagggcggggcgatgtacgcagatgacactgccggatgggacacacggatcaccttggaagatctgaagaacgaggaaatggttacaaatcatatgaaaggtgagcacaagaaactcgctgaggccatttttaaacttacttatcagaacaaagtcgtgagagtgcagaggccaacccctcgcggcacggtcatggacataatctcaagacgggatcagagggggagtggacaagttggcacctacggtctgaatacattcactaacatggaagcacagttaattcgtcagatggagggggaaggaatcttcaagtccatccaacatctgaccgtgacagaggagattgctgtacagaattggttggcccgagtgggccgcgaaagactcagccggatggctatatctggcgacgattgcgtcgtgaagcccctggacgataggtttgcctcggcactaactgcgcttaacgacatggggaaagttcgcaaggatatccagcagtgggagccatcaagaggatggaatgactggacccaagtgcccttctgcagccaccactttcatgaactggtcatgaaagatggtcgggtgctcgtagttccttgtaggaaccaggacgagctgattggccgagcccgtatctcccagggggctggatggagtttgaaggaaacggcctgcttaggcaaatcttatgcacagatgtggacactgatgtacttccacagacgcgatctccggcttgctgccaacgcaatttgtagcgccgtgccatcccattgggtcccgacctcaaggactacatggagtatccacgcgaagcacgagtggatgaccactgaggacatgctggctgtgtggaatagagtgtggatacaagaaaacccctggatggaggacaagacccctgtcgaatcttgggaggaagttccatatctaggtaaacgcgaggatcagtggtgcgggagcctgatcggactcacatcccgggccacgtgggcaaagaatattcagaccgccatcaaccaggtgaggtcattgattggcaatgaggaatacactgactatatgcccagcatgaaacgatttagacgggaggaagaggaagctggcgtactgtggtga

SEQ ID NO: 14648 - RNA, 9876 nt, synthetic construct
  misc_feature 1..9876: note = derived and/or modified CDS sequence (opt3) from DENV-2__EU482574__SS-prME
  source 1..9876: mol_type = other RNA
accgccggcgtgatcattatgctgatacccacggctatggcattccacctcactacgaggaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtcctcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttctttgcaagcattctatggtggatagaggctggggtaacgggtgtggactcttcggcaagggcgggatcgtaacctgcgccatgtttacatgcaaaaagaatatggaaggaaaagtggtgctgcctgagaaccttgaatacaccattgtcataactccacacagcggtgaggagcatgctgttggcaatgacacggggaagcacggaaaagaaatcaagattacaccgcagtcctcaatcaccgaggccgaactgactggctatggtaccgtgacaatggagtgtagtcccaggaccgggttggatttcaacgaaatggtactcctgcacatggaggacaaagcatggttagtgcatcggcagtggtttctggatctccctcttccatggctgcccggcgctgacactcaaggaagcaattggatacagaaggagacattggtcacgttcaagaaccctcacgccaaaaagcaggacgtggttgtgctaggctctcaggaaggggcgatgcataccgccctgactggagcaacagagattcaaatgtcctcaggtaatctcctgtttaccggccaccttaaatgccgtctgcgcatggataagttgcagctcaaagggatgagctacagtatgtgtacaggaaagttcaagatcgtcaaagaaatcgctgagactcagcatggcaccattgtgatcagagtacaatatgagggtgacgggtctccatgcaagattcccttcgaaataatggatctggagaaaaggcacgttttaggccggctgatcacggtgaacccgattgtcaccgaaaaggactcccctgtgaacatcgaggccgaacccccatttggagatagctacatcattataggcgtcgagcctgggcagctaaaactcaattggttcaagaagggatcgtctatcggtcagatgtttgagacaactatgcgaggcgctaaacgcatggccattctgggggacaccgcatgggatttcggatcccttggcggtgtgtttacatcaatcgggaaggccttgcaccaggttttcggcgctatttacggagcggcatttagtggcgtgagctggactatgaaaatcctgataggggtaatcattacctggatcggaatgaactccagatctacgagcctctcagtcagtctggtgcttgttggcgtggtcacactgtatttgggtgccatggtgcaagctgactccgggtgtgtagtgagctggaagaataaagaactcaagtgcggatctggcattttcatcaccgataacgttcatacttggacagagcagtacaagtttcagcccgaatcaccaagtaaactggccagcgcaatacagaaggcccacgaggaaggtatttgtggcatcaggtccgtcacccggttagagaatctgatgtggaaacaaattactcccgagctaaaccatatcctctctgaaaatgaggtgaagctgaccataatgacaggggacatcaaaggaattatgcaggctggcaagcgctcgcttagacctcagccaacggaattgaaatatagctggaagacctgggggaaggccaaaatgctgtccactgagtcacacaaccagacattcctcatcgatggaccggaaaccgcagagtgccccaatacaaacagggcgtggaatagtctggaggtggaagactacggctttggtgtcttcactaccaacatttggttaaagctgcgtgagaaacaagacgtattttgtgattctaaacttatgagcgctgccatcaaagacaatcgggcagtgcacgccgatatggggtattggatagaatccgctttgaacgacacgtggaagatggagaaggcctcattcattgaggtgaaaagctgccattggcctaagtctcacacactctggtccaatggagtactggaaagtgagatgatcatccccaagaatttcgcaggccccgtcagccagcataactaccgacctggttatcacacccagactgctggcccatggcatctagggaagctggaaatggattttgacttctgtgagggaaccacagtggttgtgactgaagattgcggcaatagagggccctctctcaggaccacaacggcctccggaaaactgattaccgagtggtgctgtcgctcatgcactcttccgcctttgcggtacagaggcgaggacggttgttggtacgggatggaaatcaggccactgaaggagaaggaagagaacttagtcaatagtctcgtgacagcgggacacggccagattgataactttagcctgggtgttcttggcatggccctgttcttggaagagatgctccgcacccgagtggggactaaacacgctatactgctagtagcagtctcgtttgtgacactgatcaccggaaatatgtccttccgggacctcggccgtgtgatggtcatggttggggccacgatgactgatgacattggaatgggcgtgacctatctggctcttttggccgcatttaaggtaagacccacattcgcggccggtctgttactcaggaaactgacctctaaggagcttatgatggctactatcgggattgccctgctaagccaatcaacaatccctgaaaccatactcgagctgacagatgcattggctctgggaatgatggtgttaaaaatcgtccgcaacatggaaaagtaccagctcgccgtgactattatggcaatcagttgcgttcccaatgccgtgattctgcagaacgcttggaaggtctcctgtaccatccttgcggccgtgtctgttagcccactgttgctcacgtcctcacaacagaaagcagactggatacctctggctctaacaattaagggcctgaatcccaccgccatctttcttactaccctcagccggacaagtaaaaagagatcttggccactgaacgaggccatcatggctgtgggcatggtctccattttggcaagctcgctgctaaagaatgacataccgatgactgggcctctcgtagccggaggtctgcttaccgtgtgctatgttctgacgggcaggtcagcggatttggaactcgagcgagctgccgacgtgaagtgggaggatcaggcagaaatctctgggagttcccccattctgagcatcacaatttctgaggacggaagcatgtccatcaaaaacgaagaggaggaacagaccctaactatactgatccgcacaggccttctcgtcatttcaggtgtgttcccagtaagtatccccattaccgccgctgcatggtacctgtgggaggtgaagaagcaacgggccggggtcttgtgggatgttcctagcccaccccctgtgggaaaagcggaattagaggacggcgcttatagaatcaagcagaggggcatactggggtactctcagattggagccggtgtgtataaagaaggcacttttcatacaatgtggcacgtcacccgtggggcagtgctcatgcatcgcggaaagcggatcgagccgtcctgggccgatgttaaaaaggacctgatctcatacggcggtgggtggaaacttgagggagaatggaaagagggcgaagaggtacaggtgctggctttggaaccaggcaagaatcccagagccgtccaaacgaaacctgggctattcaagactaacaccggaacaattggtgcagtgagtctggattttagcccaggcacctccgggtctcccatcgttgacaggaaaggaaaggtggtcggcctctacggtaatggggtggtaacacgatcgggagcttatgtcagcgccatagcgcagactgagaagtcaattgaggataaccctgaaatcgaggacgatattttccggaaaaagcgcctgaccatcatggaccttcacccgggcgccggcaaaacgaagagatacttacccgcaatagtgagggaagctattaaacgggggctgcgaacactcatcttggccccaactagagttgtggctgcagagatggaagaggccctgcgcggactccctatcaggtatcagacccccgccattcgtgctgagcatacaggtcgggaaatcgtcgacctgatgtgtcacgcgaccttcactatgagacttctgtccccagtgagggttcctaactacaatttgattataatggatgaggcacactttaccgaccccgccagtatcgctgcccgcggctatatttctacacgagtggaaatgggggaggcagccggaatcttcatgacggctactccaccgggcagcagagatccttttccccagtccaacgcgccaatcatggacgaggaacgggagattcccgaaaggtcatggaactctggtcatgagtgggtcaccgatttcaaggggaagacagtgtggtttgtacctagcataaaagccggaaacgacatcgcagcttgcctacgcaagaatggcaaaaaggtgattcaactgagtcgtaaaaccttcgattccgaatacgttaagactagagccaacgactgggattttgtcgtgacaaccgacatcagcgagatgggcgcaaatttcaaggccgagcgggtgattgatccaaggcgctgtatgaaacccgtcatcctcacggacggggaagaacgagtaatattagctggacctatgccggtgactcactcttcagccgcgcagagacggggtaggatcggccgcaacccaaagaatgaaaacgaccagtatatttacatgggggagcccctggaaaatgatgaggactgcgcacattggaaagaggccaagatgcttctggataacatcaatacacctgaaggaattatcccctccatgtttgagccagaaagagagaaagttgacgctatagatggcgaatacaggctccggggtgaggcccgtaagaccttcgtggacttgatgcgccgaggggatctgcctgtctggctcgcttatagagtggcagccgagggcattaactacgctgacaggcggtggtgttttgatggaatcaaaaataaccaaattctggaagagaacgttgaagtggagatctggaccaaggagggcgaacgcaagaaacttaagcccagatggctagacgccaggatatatagtgatccactggcattgaaagagttcaaggagttcgcggccgggcgaaagagcttaactctgaatctcatcacagagatgggacggctgcctacctttatgacacagaaggctagagacgcccttgataacctggcagtcctccacactgctgaagccggtggccgcgcatacaatcacgccttgtcggagctgccggagacgctagaaaccctgctccttctgacattattggctactgtgaccgggggaattttcctgtttctcatgtctggcaagggtatcgggaaaatgacactgggcatgtgctgcattatcaccgcgtccatacttctgtggtatgcccagattcagccccattggatcgcagctagcatcattctcgagttctttttgatcgtactgttaataccagaacctgagaagcaaaggactccccaggacaaccagctaacgtacgtggttattgccatcctgaccgtcgtggccgcaacaatggctaatgaaatgggattcctcgagaaaactaagaaagaccttggcctggggtcaattaccacacaggagagtgaatctaacatcttggatatagacctgcggccagcctccgcgtggaccctctatgctgtggccactacatttgtcacgcctatgctgcgtcacagcatcgaaaattcaagtgttaacgtgagccttaccgcaattgccaatcaagctactgtactcatgggactgggtaagggctggcccttgtccaagatggatatcggggtgccgctgttagcaattggatgttactctcaggtcaacccaatcacactaaccgccgcgctgctccttctggtggctcattacgccattatcggccctggtttgcaggcaaaagccaccagagaagctcagaagagggccgcagctgggataatgaaaaatcccacagttgacggcattactgtgatcgatctggagccaatcccctatgaccctaagttcgaaaaacaactcggacaggtcatgctgcttattttatgcgtaacacaggtgctgatgatgcgcaccacatgggccctctgtgaggcgttgactctggccaccggcccgataagcacactatgggaggggaaccccggacggttttggaataccactatcgcagtttccatggctaacattttccgaggctcatacctggccggtgcagggctcctattttctatcatgaagaatacgacaaacaccagaaggggaactggcaatattggtgaaaccctgggcgagaagtggaaaagtcgcttgaacgctctggggaagtcggagttccagatctataaaaagagcggaatacaagaggtggatcggacactcgccaaagagggcatcaagagaggggaaactgaccaccatgccgtctcccgtggatctgcgaaactgaggtggtttgtggagcggaacatggtcaccccagaaggcaaggtggttgatttaggttgcgggcgcggaggctggtcatactattgtggtggccttaagaatgtgcgagaggtaaaagggctgacaaagggaggccctgggcacgaagaaccaattcctatgagcacgtacggatggaacctcgtgagactacagtccggcgtcgacgttttcttcaccccacccgagaaatgcgatactctgttgtgtgacatcggtgaaagttctcctaatccaacaattgaggctgggaggaccctgcgggtgctcaaccttgtcgaaaattggctgaacaataacactcagttttgcatcaaggtgttgaatccctatatgccgagcgtaatagagaaaatggaaacactgcaacgcaagtacggaggcgcactcgtgagaaaccctttatcaagaaattccacccacgagatgtactgggttagtaacgccacgggcaatattgtgagctctgtcaacatgatctcccgaatgctgatcaatcggttcaccatgaagcataaaaaggctacatatgagccagatgtggaccttgggtcaggaactcgtaacattggtatagaaagcgagatccccaacctggacattatcggcaaaagaattgaaaagatcaaacaggagcacgaaacctcgtggcattacgatcaggaccacccttataagacatgggcctaccacgggtcttatgagactaagcagaccggaagtgcatccagcatggtcaatggcgtggttcgcctactcacaaaaccatgggatgtagtgcccatggtcacccaaatggccatgactgacacgacaccgtttggtcagcagagggtgttcaaggagaaagttgatacccggactcaggaacctaaggaggggaccaaaaagctgatgaagataacagctgaatggttgtggaaagagctgggaaagaaaaagacgcccagaatgtgtacccgcgaggaatttactaggaaagtgcgatcaaacgcggccctcggcgcaatcttcacagacgagaataagtggaaatccgctcgggaagccgtcgaggattctagattttgggaacttattgacagggagcgcaacctgcatttagagggcaagtgcgaaacctgtgtgtacaatatgatggggaagcgtgagaaaaagctgggagagttcggtaaagcaaagggcagccgggccatctggtatatgtggttgggggctagatttctcgagttcgaagccctgggatttctaaacgaggatcactggttcagtaggggcaattcccttagcggtgtagagggggaaggactgcatcgcctcggctacattctgcgagacgtgtctaaaaaggagggcggggcgatgtacgcagatgacactgccggatgggacacacggatcaccttggaagatctgaagaacgaggaaatggttacaaatcacatgaaaggtgagcataagaaactcgctgaggccatttttaaacttacttatcaaaacaaagtcgtgagagtgcagaggccaacccctcgcggcacggtcatggacataatctcaagacgggatcagagggggagtggacaggttggcacctacggtctgaatacattcactaacatggaagcacaattaattcgtcagatggagggggaaggaatcttcaagtccatccagcacctgaccgtgacagaggagattgctgtacaaaattggttggcccgagtgggccgcgaaagactcagccggatggctatatctggcgacgattgcgtcgtgaagcccctggacgataggtttgcctcggcactaactgcgcttaacgacatggggaaagttcgcaaggatatccagcagtgggagccatcaagaggatggaatgactggacccaggtgcccttctgcagccaccattttcacgaactggtcatgaaagatggtcgggtgctcgtagttccttgtaggaaccaagacgagctgattggccgagcccgtatctcccagggggctggatggagtttgaaggaaacggcctgcttaggcaaatcttatgcacagatgtggacactgatgtacttccatagacgcgatctccggcttgctgccaacgcaatttgtagcgccgtgccatcccactgggtcccgacctcaaggactacatggagtatccacgcgaagcatgagtggatgaccactgaggacatgctggctgtgtggaatagagtgtggatacaggaaaacccctggatggaggacaagacccctgtcgaatcttgggaggaagttccatatctaggtaaacgcgaggatcaatggtgcgggagcctgatcggactcacatcccgggccacgtgggcaaagaatattcagaccgccatcaaccaggtgaggtcattgattggcaatgaggaatacactgactatatgcccagcatgaaacgatttagacgggaggaagaggaagctggcgtactgtggtga

SEQ ID NO: 14649 - RNA, 9876 nt, synthetic construct
  misc_feature 1..9876: note = derived and/or modified CDS sequence (opt3) from DENV-2__EU482575__SS-prME
  source 1..9876: mol_type = other RNA
accgccggcgtgatcattatgctgatacccacagctatggcattccacctcactacgcgaaacggggaacctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcgccgacgtgaaaagagatcagttgcgctggtgccccacgtcggtatggggcttgagaccaggacagaaacttggatgagtagcgagggagcttggaaacatgtgcagcggatcgagacctggatactgcgccaccctggcttcacaatcatggccgcaattttggcctacaccatcggcacgactcattttcagagagctctcattttcatcctgctgacagcagttgccccatccatgaccatgaggtgcatagggatttctaaccgggattttgtggaaggagtctcgggtggctcatgggtggacatcgtcctcgagcacgggagctgtgttactacaatggctaagaataagcccaccttagatttcgaactgattaaaacggaggccaagcagcctgcgacccttcgcaaatattgcatcgaagcaaagttgacaaacactaccacagagagtcgatgtccaactcaaggagagccctccctgaatgaagaacaggacaaaagatttctatgcaagcactctatggtggataggggctggggtaacgggtgtggactcttcggcaagggcgggatcgtaacctgcgccatgtttacatgcaaaaagaatatggaaggaaaagtggtgctgcctgagaaccttgaatacaccattgtcataactccacatagcggtgaggagcacgctgttggcaatgacacggggaagcatggaaaagaaatcaagattacaccgcagtcctcaatcaccgaggccgaactgactggctatggtaccgtgacaatggagtgtagtccccggaccgggttggatttcaacgaaatggtactcctgcagatggaggacaaagcatggttagtgcaccgtcaatggtttctggatctccctcttccatggctgcccggcgctgacactcagggaagcaattggatacagaaggagacattggtcacgttcaagaaccctcacgccaaaaagcaggacgtggttgtgctaggctctcaagaaggggcgatgcataccgccctgactggagcaacagagattcagatgtcctcaggtaatctcctgtttaccggccaccttaaatgccgcctgagaatggataagttgcagctcaaagggatgagctacagtatgtgtacaggaaagttcaagatcgtcaaagaaatcgctgagactcaacatggcaccattgtgatcagggtacagtatgagggtgacgggtctccatgcaagattcccttcgaaataatggatctggagaaacggcacgttttaggccgactgatcacggtgaacccgattgtcaccgaaaaggactcccctgtgaacatcgaggccgaacccccatttggagatagctacatcattataggcgtcgagcctgggcagctaaaactcaattggttcaagaagggatcgtctatcggtcagatgtttgagacaactatgcgcggcgctaaaagaatggccattctgggggacaccgcatgggatttcggatcccttggcggtgtgtttacatcaatcgggaaggccttgcatcaagttttcggcgctatttacggagcggcatttagtggcgtgagctggactatgaaaatcctgataggggtaatcattacctggatcggaatgaactccaggtctacgagcctctcagtcagtctggtgcttgttggcgtggtcacactgtatttgggtgccatggtgcaggctgactccgggtgtgtagtgagctggaagaataaagaactcaagtgcggatctggcattttcatcaccgataacgttcacacttggacagagcagtacaagtttcagcccgaatcaccaagtaaactggccagcgcaatacaaaaggcccacgaggaaggtatttgtggcatccggtccgtcacccgcttagagaatctgatgtggaaacagattactcccgagctaaaccatatcctctctgaaaatgaggtgaagctgaccataatgacaggggacatcaaaggaattatgcaggctggcaagagatcgcttaggcctcagccaacggaattgaaatatagctggaagacctgggggaaggccaaaatgctgtccactgagtcacacaaccaaacattcctcatcgatggaccggaaaccgcagagtgccccaatacaaaccgtgcgtggaatagtctggaggtggaagactacggctttggtgtcttctctactaacatttggttaaagctgcgggagaaacaggacgtattttgtgatagcaaacttatgtccgctgccatcaaagacaatcgagcagtgcatgccgatatggggtattggatagaatcagctttgaacgacacctggaagatggagaaggccagcttcattgaggtgaaatcttgccactggcctaagtcccacacgctctggagtaatggagtactggaaagcgagatgatcatccccaagaacttcgcaggccccgtctctcagcataactacagacctggttatcacacacagaccgctggcccatggcatctagggaagctggaaatggattttgacttctgtgagggaactaccgtggttgtgacagaagattgcggcaatagggggccctccctccgcactaccacagcctcaggaaaactgattacggagtggtgctgtcggagttgcacccttccgcctttgagatacaggggcgaggacggttgttggtacgggatggaaatccgcccactgaaggagaaggaagagaacttagtcaatagcctcgtgactgcgggacacggccaaattgataacttttcgctgggtgttcttggcatggccctgttcttggaagagatgctccgaacacgggtggggaccaaacatgctatactgctagtagcagtctcctttgtgactctgatcacaggaaatatgtctttccgtgacctcggcagagtgatggtcatggttggggccaccatgacggatgacattggaatgggcgtgacttatctggctcttttggccgcatttaaggtaaggcccaccttcgcggccggtctgttactccgcaaactgacaagcaaggagcttatgatggctaccatcgggattgccctgctatcacagagtactatccctgaaacaatactcgagctgaccgatgcattggctctgggaatgatggtgttaaaaatcgtccggaacatggaaaagtaccagctcgccgtgacaattatggcaatctcctgcgttcccaatgccgtgattctgcaaaacgcttggaaggtctcttgtactatccttgcggccgtgagcgtttccccactgttgctcacctcaagccagcagaaagcagactggatacctctggctctaacgattaagggcctgaatcccacagccatctttcttaccactctcagtagaacctctaaaaagaggtcctggccactgaacgaggccatcatggctgtgggcatggtcagcattttggcatcgtcactgctaaagaatgacataccgatgacagggcctctcgtagccggaggtctgcttactgtgtgctatgttctgaccggccgatctgcggatttggaactcgagcgcgctgccgacgtgaagtgggaggatcaggcagaaatcagtgggtccagccccattctgtctatcacgattagcgaggacggatccatgtcaatcaaaaacgaagaggaggaacaaacactaaccatactgatccggactggccttctcgtcattagtggtgtgttcccagtaagcatccccattacagccgctgcatggtacctgtgggaggtgaagaagcagagagccggggtcttgtgggatgttccttctccaccccctgtgggaaaagcggaattagaggacggcgcttataggatcaagcagcgtggcatactggggtactcccagattggagccggtgtgtataaagaaggcacctttcacactatgtggcacgtcacacgcggggcagtgctcatgcatcggggaaagagaatcgagccgtcatgggccgatgttaaaaaggacctgatcagttacggcggtgggtggaaacttgagggagaatggaaagagggcgaagaggtacaagtgctggctttggaaccaggcaagaatcccagggccgtccagaccaaacctgggctattcaagacgaacactggaaccattggtgcagtgagcctggatttttccccaggcacatctgggtcgcccatcgttgaccgaaaaggaaaggtggtcggcctctacggtaatggggtggtaacccggagcggagcttatgtctcagccatagcgcagacagagaagtccattgaggataaccctgaaatcgaggacgatattttccgcaaaaagagactgactatcatggaccttcacccgggcgccggcaaaaccaagaggtacttacccgcaatagtgcgggaagctattaaacgagggctgagaacgctcatcttggccccaacacgcgttgtggctgcagagatggaagaggccctgaggggactccctatccgttatcagactcccgccattcgggctgagcataccggtagagaaatcgtcgacctgatgtgtcacgcgacattcaccatgaggcttctgagtccagtgcgcgttcctaactacaatttgattataatggatgaggcacattttactgaccccgcctctatcgctgcccgaggctatattagcaccagagtggaaatgggggaggcagccggaatcttcatgacagctacgccaccgggctcccgggatccttttccccaatcaaacgcgccaatcatggacgaggaaagggagattcccgaacgctcttggaatagcggtcacgagtgggtcactgatttcaaggggaagaccgtgtggtttgtacctagtataaaagccggaaacgacatcgcagcttgcctacgtaagaatggcaaaaaggtgattcagctgtccagaaaaacattcgatagcgaatacgttaagacccgggccaacgactgggattttgtcgtgactacagacatctctgagatgggcgcaaatttcaaggccgagagggtgattgatccacgccgatgtatgaaacccgtcatcctcaccgacggggaagagagagtaatattagctggacctatgccggtgacgcactcatccgccgcgcagcggaggggtcgcatcggcagaaacccaaagaatgaaaacgaccaatatatttacatgggggagcccctggaaaatgatgaggactgcgcacattggaaagaggccaagatgcttctggataacatcaatactcctgaaggaattatccccagtatgtttgagccagaaagggagaaagttgacgctatagatggcgaataccggctccgtggtgaggcccgcaagacattcgtggacttgatgcgaagaggggatctgcctgtctggctcgcttatagggtggcagccgagggcattaactacgctgaccggcgctggtgttttgatggaatcaaaaataaccagattctggaagagaacgttgaagtggagatctggaccaaggagggcgaaagaaagaaacttaagcccaggtggctagacgcccggatatatagcgatccactggcattgaaagagttcaaggagttcgcggccgggcgaaaatcgttaaccctgaatctcatcactgagatgggaagactgcctacatttatgacccagaaggctcgcgacgcccttgataacctggcagtcctccacacagctgaagccggtggcagggcatacaatcatgccttgtctgagctgccggagactctagaaacgctgctccttctgaccttattggctacagtgactgggggaattttcctgtttctcatgtccggcaagggtatcgggaaaatgaccctgggcatgtgctgcattatcacagcgagcatacttctgtggtatgcccagattcaaccccactggatcgcagcttcaatcattctcgagttctttttgatcgtactgttaataccagaacctgagaagcagcggaccccacaggacaaccagctaacttacgtggttattgccatcctgacggtcgtggccgcaaccatggctaatgaaatgggattcctcgagaaaacaaagaaagaccttggcctggggagtattactacccaagagtctgaatccaacatcttggatatagacctgcgtccagccagcgcgtggacactctatgctgtggccaccacttttgtcacacctatgctgagacactcaatcgagaatagtagcgttaacgtgtcccttacggcaattgccaatcaggctaccgtactcatgggactgggtaagggctggcccttgtctaagatggatatcggggtgccgctgttagcaattggatgttacagccaggtcaacccaatcactctaacagccgcgctgctccttctggtggctcattacgccattatcggccctggtttgcaggcaaaagccaccagggaagctcaaaagcgcgccgcagctgggataatgaaaaatcccaccgttgacggcattacagtgatcgatctggagccaatcccctatgaccctaagttcgaaaaacagctcggacaggtcatgctgcttattttatgcgtaactcaggtgctgatgatgcggacgacctgggccctctgtgaggcgttgacactggccactggcccgatatccaccctatgggaggggaaccccggacgattttggaatacaaccatcgcagtttcaatggctaacattttcagaggctcttacctggccggtgcagggctcctttttagtatcatgaagaatactacgaacacaaggcgcggaaccggcaatattggtgaaactctgggcgagaagtggaaatcgcggttgaacgctctggggaagtcagagttccaaatctataaaaagtccggaatacaggaggtggatagaaccctcgccaaagagggcatcaagcgtggggaaacagaccaccatgccgtctctaggggatcagcgaaactgcggtggtttgtggagcgcaacatggtcactccagaaggcaaggtggttgatttaggttgcgggcgaggaggctggagctactattgtggtggccttaagaatgtgagagaggtaaaagggctgaccaagggaggccctgggcacgaagaacccattcctatgtccacatacggatggaacctcgtgaggctacagagtggcgtcgacgttttcttcacgccacccgagaaatgcgataccctgttgtgtgacatcggtgaatctagccctaatccaactattgaggctgggcggacactgcgcgtgctcaaccttgtcgaaaattggctgaacaataacacccaattttgcatcaaggtgttgaatccctatatgccgtcagtaatagagaaaatggaaactctgcagagaaagtacggaggcgcactcgtgaggaaccctttatcccgaaatagtacacatgagatgtactgggttagcaacgccaccggcaatattgtgtcttccgtcaacatgatctcacggatgctgatcaatcgtttcacgatgaagcacaaaaaggctacctatgagccagatgtggaccttgggagcggaacaagaaacattggtatagaatcggagatccccaacctggacattatcggcaaacgcattgaaaagatcaaacaggagcacgaaacttcttggcattacgatcaggaccacccttataagacctgggcctaccatgggagttatgagacaaagcaaactggatccgcaagctcaatggtcaatggcgtggttaggctactcaccaaaccatgggatgtagtgcccatggtcacacagatggccatgaccgacactacgccgtttggtcagcagcgggtgttcaaggagaaagttgatacaagaacccaagaacctaaggaggggactaaaaagctgatgaagataaccgctgaatggttgtggaaagagctgggaaagaaaaagacaccccgcatgtgtacgagggaggaatttacccgaaaagtgcggtccaacgcggccctcggcgcaatcttcactgacgagaataagtggaaatctgctagagaagccgtcgaggatagcaggttttgggaacttattgaccgcgagcgtaacctgcacttagagggcaagtgcgaaacatgtgtgtacaatatgatggggaagcgggagaaaaagctgggagagttcggtaaagcaaagggcagtagagccatctggtatatgtggttgggggctaggtttctcgagttcgaagccctgggatttctaaacgaggatcactggttctcccgcggcaatagcctttctggtgtagagggggaaggactgcatcgactcggctacattctgcgggacgtgagcaagaaggagggcggggcgatgtacgcagatgacaccgccggatgggacactagaatcacattggaagatctgaagaacgaggaaatggttaccaatcacatgaaaggtgagcataagaaactcgctgaggccatttttaaacttacatatcagaacaaagtcgtgagggtgcagcgcccaactcctagaggcaccgtcatggacataatcagtcggagggatcagcgtgggtccggacaagttggcacgtacggtctgaataccttcacaaacatggaagcacagttaattcgacagatggagggggaaggaatcttcaagagcatccaacacctgactgtgaccgaggagattgctgtacagaattggttggcccgcgtgggcagagaacggctctctaggatggctatatcgggcgacgattgcgtcgtgaagcccctggacgatcgctttgcctcagcactaacagcgcttaacgacatggggaaagttagaaaggatatccagcagtgggagccaagccggggatggaatgactggactcaagtgcccttctgctcccatcactttcacgaactggtcatgaaagatggtagggtgctcgtagttccttgtcgaaaccaggacgagctgattggccgtgccagaatcagtcagggggctggatggtctttgaaggaaaccgcctgcttaggcaaaagctatgcacagatgtggacgctgatgtacttccatcgccgggatctcaggcttgctgccaacgcaatttgttccgccgtgccatcacactgggtcccgacaagtagaaccacttggtctatccatgcgaagcacgagtggatgacaaccgaggacatgctggctgtgtggaatcgcgtgtggatacaagaaaacccctggatggaggacaagactcctgtcgaaagctgggaggaagttccatatctaggtaaacgggaggatcagtggtgcgggtccctgatcggactcacctcaagggccacatgggcaaagaatattcagacggccatcaaccaggtgcggagcttgattggcaatgaggaatacaccgactatatgccctctatgaaaagatttagaagggaggaagaggaagctggcgtactgtggtga

SEQ ID NO: 14650 - RNA, 9876 nt, synthetic construct
  misc_feature 1..9876: note = derived and/or modified CDS sequence (opt3) from DENV-2__EU482578__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtgaccgaaaaggactcccctgtcaacatcgaggccgaacccccatttggagatagctacatcattataggcgtggagcctgggcagctgaaactaaattggttcaagaagggatcgtctatcggtcagatgtttgagacaactatgcgaggcgctaaacgcatggccattctcggggacaccgcatgggatttcggatccctgggcggtgtttttacatcaatcgggaaggcccttcaccaagtgttcggcgctatttacggagcggcatttagtggcgtaagctggactatgaaaatcttgataggggtcatcattacctggatcggaatgaactccagatctacgagcctgtcagtgagtctcgttctggtgggcgtcgtgacactttatctgggtgccatggtacaggctgactccgggtgtgtggttagctggaagtctaaagaattgaagtgcggatcaggcattttcatcaccgataatgtccacacttggacagagcagtacaagtttcagcccgaaagtccaagcaaactcgcctccgcaatacaaaaggcccatgaggaaggtatttgtggcatcaggtctgtgacccggctggagaacttaatgtggaaacagattactcccgagctgaatcacatcctatcggaaaacgaggtgaagctcaccataatgacaggggacatcaaaggaattatgcaggctggcaagcgcagcctgagacctcagccaacggaacttaaatattcctggaagacctgggggaaggccaaaatgttgtcaactgagagtcataatcaaacattcctgatcgatggaccggaaaccgcagagtgccccaacacaaatagggcgtggaactctctcgaggtcgaagactacggctttggtgttttcactaccaatatttggctgaagttacgtgagaaacaggacgtgttttgtgatagcaagctgatgtccgctgccatcaaagacaaccgggcagtgcacgccgatatggggtattggatagaatcagctcttaatgacacgtggaagatggagaaggccagcttcattgaggtaaaatcttgccactggcctaagtcccatacattgtggagtaacggagtcctcgaaagcgagatgatcatcccaaaaaatttcgcaggccccgtgtctcagcacaactaccgacctggttatcatacccagactgctggcccatggcacctggggaagctagaaatggattttgacttctgtgagggaaccacagttgtggtcactgaagattgcggcaacagagggccctccctgaggaccacaacggcctcaggaaaactcattaccgagtggtgctgtcgcagttgcactctgccgcctcttcggtacagaggcgaggacggttgttggtacgggatggaaatcaggccattgaaggagaaggaagagaatctggtgaacagcttagttacagcgggacatggccaaattgataatttttcgctcggtgtgctgggcatggcccttttcctggaagagatgttgcgcacccgagtagggactaaacacgctatactcctggtcgcagtgtcctttgtgacactaatcaccggaaacatgtctttccgggacctgggccgtgtcatggttatggtgggggccacgatgactgatgacattggaatgggcgtaacctatctcgctctgcttgccgcatttaaggtgagacccacattcgcggccggtttgctgttaaggaaactcaccagcaaggagctgatgatggctactatcgggattgcccttctgtcacagagtacaatccctgaaaccatactagagctcacagatgcactggctttgggaatgatggtcctgaaaatcgtgcgcaatatggaaaagtaccagttagccgttactattatggcaatctcctgcgtgcccaacgccgtcattctccaaaatgcttggaaggtgtcttgtaccatcctggcggccgttagcgtgtccccacttctgttgacgtcaagccagcagaaagcagactggatacctctcgctctgacaattaagggcctaaaccccaccgccatctttctgactacccttagtcggacatctaaaaagagatcctggccactcaatgaggccatcatggctgtcggcatggtaagcattctggcatcgtcattgctgaaaaacgacataccgatgactgggcctttagtggccggaggtctcctgaccgtttgctatgtgcttacgggcaggtctgcggatctggaattggagcgagctgccgacgtcaagtgggaggatcaggcagaaatcagtgggtccagccccattctctctatcacaattagcgaggacggatccatgtcaatcaaaaatgaagaggaggaacaaaccctgactatactaatccgcacaggcctgcttgtgattagtggtgtattcccagtgagcatccccattaccgccgctgcatggtacctctgggaggtcaagaagcagcgggccggggttctgtgggatgtgccttctccaccccctgtgggaaaagcggaattggaggacggcgcttatagaatcaagcagaggggcatattagggtactcccagattggagccggtgtctataaagaaggcacttttcacacaatgtggcatgtgacccgtggggcagttctgatgcaccgcggaaagcggatcgagccgtcatgggccgatgtaaaaaaggacctcatcagttacggcggtgggtggaagctggagggagaatggaaagagggcgaagaggtgcaagtccttgctctggaaccaggcaagaaccccagagccgtgcagacgaaacctgggttgttcaagactaataccggaacaattggtgcagttagcctagatttttccccaggcacctctgggtcgcccatcgtggacaggaaaggaaaggtcgtgggcctgtacggtaacggggtagtcacacgaagcggagcttatgtgtcagccatagcgcagactgagaagtccattgaggataatcctgaaatcgaggacgatattttccggaaaaagcgcctcaccatcatggacctgcatccgggcgccggcaaaacgaagagataccttcccgcaatagttagggaagctattaaacgggggttacgaacactgatcctcgccccaactagagtggtcgctgcagagatggaagaggccttgcgcggactgcctatcaggtatcagacccccgccattcgtgctgagcacacaggtcgggaaatcgtggacctcatgtgtcatgcgaccttcactatgagactgcttagtccagttagggtgcctaactacaacctgattataatggatgaggcacactttaccgaccccgcctctatcgctgcccgcggctatattagcacacgagtcgaaatgggggaggcagccggaatcttcatgacggctactccaccgggctccagagatccttttccccaatcaaatgcgccaatcatggacgaggaacgggagattcccgaaaggtcttggaacagcggtcacgagtgggtgaccgatttcaaggggaagacagtatggtttgtgcctagtataaaagccggaaatgacatcgcagcttgcttgcgcaagaacggcaaaaaggttattcagctatcccgtaaaaccttcgatagcgaatacgtcaagactagagccaatgactgggattttgtggtgacaaccgacatctctgagatgggcgcaaacttcaaggccgagcgggtcattgatccaaggcgctgtatgaaacccgtaatcctgacggacggggaagagcgagtgatactcgctggacctatgccggttactcattcatccgccgcgcagagacggggtaggatcggccgcaatccaaagaacgaaaatgaccaatatatttacatgggggagcccttagaaaacgatgaggactgcgcacactggaaagaggccaagatgctgcttgataatatcaacacacctgaaggaattatccccagtatgtttgagccagaaagagagaaagtggacgctatagatggcgaatacaggctgcggggtgaggcccgtaagaccttcgtcgacctcatgcgccgaggggatttgcctgtgtggctggcttatagagttgcagccgagggcattaattacgctgacaggcggtggtgttttgatggaatcaaaaacaatcagattctcgaagagaacgtggaagtcgagatctggaccaaggagggcgaacgcaagaaactgaagcccagatggcttgacgccaggatatatagcgatccactagcactgaaagagttcaaggaattcgcggccgggcggaaatcgttgactttaaacctgatcacagagatgggacgactccctacctttatgacacagaaggctagagacgccctggataatcttgcagtgctgcatactgctgaagccggtggccgcgcatacaaccacgccctctctgagttgccggagacgctggaaaccctactgctccttacactgttagctactgtaaccgggggaattttcttgtttctgatgtccggcaagggtatcgggaaaatgacactcggcatgtgctgcattatcaccgcgagcatactgctttggtatgcccagattcaaccccactggatcgcagcttcaatcattctggagttctttctcatcgtgttgctgataccagaacctgagaagcagaggactccccaggacaatcagttaacgtacgttgtcattgccatcctaaccgtggtggccgcaacaatggctaacgaaatgggattcctggagaaaactaagaaagacctcggccttgggagtattaccacacaagagtctgaatccaatatcctggatatagacttgcggccagccagcgcgtggaccctgtatgctgtcgccactacatttgttacgcctatgctccgtcattcaatcgagaacagtagcgtgaatgtatccctgaccgcaattgccaaccaggctactgtgcttatgggactcggtaagggctggcccctgtctaagatggatatcggggtcccgttgctggcaattggatgttacagccaggtgaatccaatcacattaaccgccgcgctactgctccttgttgctcactacgccattatcggccctggtctgcaggcaaaagccaccagagaagctcaaaagagggccgcagctgggataatgaaaaaccccacagtggacggcattactgtcatcgatttggagccaatcccctatgaccctaagttcgaaaaacagctgggacaggtaatgctcctgattctttgcgtgacgcaggttttaatgatgcgcaccacatgggccctgtgtgaggcgctcactttggccaccggcccgatatccacactgtgggaggggaatcccggacggttttggaacaccactatcgcagtgtcaatggctaatattttccgaggctcttacctagccggtgcagggctgctctttagtatcatgaagaacacgacaaataccagaaggggaactggcaacattggtgaaacccttggcgagaagtggaaatcgcgcctgaatgctttggggaagagcgaattccaaatctataaaaagtccggaatacaggaggtcgatcggacactggccaaagagggcatcaagagaggggaaactgaccatcacgccgtgtctcgtggatcagcgaaactcaggtggtttgtcgagcggaacatggtgaccccagaaggcaaggttgtggatctgggttgcgggcgcggaggctggagctactattgtggtggcttaaagaacgtacgagaggtgaaagggcttacaaagggaggccctgggcatgaagagcccattcctatgtccacgtacggatggaatctggtcagactccagagtggcgttgacgtgttcttcaccccacccgagaaatgcgatactctactgtgtgacatcggtgaatctagccctaacccaacaattgaggctgggaggaccttgcgggtcctgaatctcgtggaaaactggcttaataacaatactcaattttgcatcaaggtactgaacccctatatgccgtcagtgatagagaaaatggaaacattgcagcgcaagtacggaggcgcactggttagaaatcctctctccaggaacagtacccacgagatgtactgggtgagcaatgccacgggcaacattgtctcttccgtgaatatgatctcacgaatgttaatcaaccggttcaccatgaagcacaaaaaggctacatatgagccagatgtcgacctggggagcggaactcgtaatattggtatagaatcggagatccccaaccttgacattatcggcaaaagaattgaaaagatcaaacaggagcatgaaacctcttggcactacgatcaggaccatccttataagacatgggcctaccacgggagttatgagactaagcaaaccggatccgcaagctcaatggtgaacggcgttgtacgcctgctaacaaaaccatgggatgtggtccccatggtgacccagatggccatgactgacacgacaccgtttggtcagcagagggttttcaaggagaaagtggatacccggactcaagaacctaaggaggggaccaaaaagctcatgaagataacagctgaatggctgtggaaagagttgggaaagaaaaagacgcccagaatgtgtacccgcgaggaatttactaggaaagtccgatccaatgcggccctgggcgcaatcttcacagacgagaacaagtggaaatctgctcgggaagccgtggaggatagcagattttgggaactcattgacagggagcgcaatcttcacctggagggcaagtgcgaaacctgtgtatacaacatgatggggaagcgtgagaaaaagttaggagaattcggtaaagcaaagggcagtcgggccatctggtatatgtggctgggggctagatttttggagttcgaagccctcggatttctgaatgaggatcattggttctccaggggcaacagcctatctggtgtggagggggaaggacttcaccgcctgggctacattctccgagacgtttcaaaaaaggagggcggggcgatgtacgcagatgacactgccggatgggacacacggatcaccctggaagatttgaagaatgaggaaatggtcacaaaccatatgaaaggtgagcacaagaaactggctgaggccatttttaagctcacttatcagaataaagtggtgagagtccagaggccaacccctcgcggcacggttatggacataatcagtagacgggatcagagggggtccggacaagtgggcacctacggtcttaacacattcactaatatggaagcacagctgattcgtcagatggagggggaaggaatcttcaagagcatccaacatttaaccgtaacagaggagattgctgtgcagaactggctggcccgagtcggccgcgaaagattgtctcggatggctatatcgggcgacgattgcgtggttaagcccctcgacgataggtttgcctcagcactgactgcgctaaatgacatggggaaagtgcgcaaggatatccagcagtgggagccaagcagaggatggaacgactggacccaagtccccttctgctcccaccactttcatgaacttgtgatgaaagatggtcgggtactggttgtgccttgtaggaatcaggacgagctcattggccgagcccgtatcagtcagggggctggatggtctctgaaggaaacggcctgcttgggcaaaagctatgcacagatgtggacattaatgtacttccacagacgcgatctgcggctcgctgccaacgcaatttgttccgccgtcccatcacattgggtgccgaccagtaggactacatggtctatccacgcgaagcacgagtggatgaccactgaggacatgcttgctgtgtggaacagagtctggatacaagaaaatccctggatggaggacaagacccctgttgaaagctgggaggaagtgccatatctgggtaaacgcgaggatcagtggtgcgggtccctaatcggactgacatcacgggccacgtgggcaaagaacattcagaccgccatcaatcaggtaaggagcctcattggcaacgaggaatacactgactatatgccctctatgaaacgatttagacgggaggaagaggaagctggcgtgttgtggtga

SEQ ID NO: 14651 - RNA, 9876 nt, synthetic construct
  misc_feature 1..9876: note = derived and/or modified CDS sequence (opt3) from DENV-2__EU482580__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccatggatttaggggaactgtgtgaggacactattacctacaaatgcccactactccggcaaaacgaaccggaggatatcgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggattgagacctggatcctgcggcatcctggcttcacaataatggccgcaatcttggcctacaccattggcacgactcactttcagcgcgctctcatcttcattctgctgacagcagttgccccatccatgaccatgagatgcatcgggatatctaacagggattttgtggaaggagtctcgggtggctcatgggtggacattgtactcgagcacgggagctgtgttactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttctatgcaagcattctatggtggatagaggctggggtaacgggtgtggactcttcggcaagggcgggatcgtcacctgcgccatgtttacatgcaaaaagaatatggaaggaaaagtggtgcagcctgagaacctggaatacaccatcgtcattactccacacagcggtgaggagcatgctgttggcaatgacacggggaagcacggaaaagaaataaagatcacaccgcagtcctcaattaccgaggccgaacttactggctatggtaccgtgacaatggagtgtagtcccaggaccgggctggatttcaacgaaatggtattgctccaaatggaggacaaagcatggctggtgcaccggcagtggtttttagatctgcctctcccatggcttcccggcgctgacactcagggaagcaattggatccagaaggagacactggtcacgttcaagaaccctcatgccaaaaagcaagacgtggttgtgttgggctctcaggaaggggcgatgcacaccgccctaactggagcaacagagatacagatgtcctcaggtaatctgctctttaccggccatctgaaatgccgtcttcgcatggataagctgcaattgaaagggatgagctacagtatgtgtacaggaaagttcaagattgtcaaagaaatcgctgagactcagcacggcaccatcgtgattagagtacagtatgagggtgacgggtctccatgcaagatccccttcgaaattatggatctcgagaaaaggcatgttctgggccggttaataacggtgaacccgatcgtcaccgaaaaggactcccctgtgaacattgaggccgaacccccatttggagatagctacatcatcattggcgtcgagcctgggcagctgaaactaaattggttcaagaagggatcgtctataggtcaaatgtttgagacaactatgcgaggcgctaaacgcatggccatcctcggggacaccgcatgggatttcggatccctgggcggtgtgtttacatcaattgggaaggcccttcaccaggttttcggcgctatctacggagcggcatttagtggcgtgagctggactatgaaaattttcatcggggtaataatcacctggattggaatgaactccagatctacgagcttgtcagtcagtctggtgctcgttggcgtggtcacactgtatcttggtgccatggtgcaggctgactccgggtgtgtagtgagctggaagaataaagaactgaagtgcggatctggcatctttattaccgataacgttcacacttggacagagcagtacaagttccaacccgaatcaccaagtaaattggccagcgcaatccagaaggcccatgaggaaggtatatgtggcattaggtccgtcacccggctcgagaatctgatgtggaaacagatcactcccgagttaaaccacattctgtctgaaaatgaggtgaagctaaccatcatgacaggggacataaaaggaatcatgcaggctggcaagcgctcgctcagacctcaaccaacggaactgaaatatagctggaagacctgggggaaggccaaaatgctttccactgagtcacataaccagacatttttgattgatggaccggaaaccgcagagtgccccaatacaaacagggcgtggaatagtctggaggtggaagactacggcttcggtgtctttactaccaacatctggctcaagctgcgtgagaaacaggacgttttctgtgattctaagttaatgagcgctgccattaaagacaatcgggcagtgcacgccgatatggggtattggatcgaatccgctctgaacgacacgtggaagatggagaaggcctcattcatagaggtgaaaagctgccactggcctaagtctcatacactttggtccaatggagtattggaaagtgagatgattatcccaaaaaactttgcaggccccgtcagccagcacaactaccgacctggttatcatacccaaactgctggcccatggcacctcgggaagctggaaatggatttcgacttttgtgagggaaccacagtggttgtgactgaagattgcggcaatagagggccctctctaaggaccacaacggcctccggaaaactgatcaccgagtggtgctgtcgctcatgcactctcccgcctctgcggtacagaggcgaggacggttgttggtacgggatggaaattaggccacttaaggagaaggaagagaacttggtcaatagtctggtgacagcgggacatggccagatcgataacttcagcttaggtgttctcggcatggccctgtttcttgaagagatgctgcgcacccgagtggggactaaacacgctattttgctcgtagcagtctcgttcgtgacactgataaccggaaatatgtcctttcgggacctaggccgtgtgatggtcatggttggggccacgatgactgatgacatcggaatgggcgtgacctatctggctctcctggccgcattcaaggtaagacccacatttgcggccggtcttttgctgaggaaattaacctctaaggagctcatgatggctactattgggatcgccctgcttagccagtcaacaattcctgaaaccatcctggagctaacagatgcactcgctctgggaatgatggtgttgaaaatagtccgcaacatggaaaagtaccaactggccgtgactatcatggcaattagttgcgttcccaatgccgtgatcttacagaacgcttggaaggtctcctgtaccattctcgcggccgtgtctgttagcccactgcttctgacgtcctcacagcagaaagcagactggatccctttggctctcacaataaagggcctgaatcccaccgccattttcctaactaccctgagccggacaagtaaaaagagatcttggccacttaacgaggccatcatggctgtgggcatggtctccatcctcgcaagctcgctgttgaaaaatgacattccgatgactgggcctctggtagccggaggtttactcaccgtgtgctatgttctgacgggcaggtcagcggatcttgaactggagcgagctgccgacgtgaagtgggaggatcaagcagaaatatctgggagttcccccatcttgagcattacaatctctgaggacggaagcatgtccattaaaaacgaagaggaggaacagaccctcactatcctgatacgcacaggcctactggtcatctcaggtgtgtttccagtaagtattcccatcaccgccgctgcatggtacctttgggaggtgaagaagcagcgggccggggtcctctgggatgttcctagcccaccccctgtgggaaaagcggaactggaggacggcgcttatagaattaagcagaggggcatcttggggtactctcaaataggagccggtgtgtataaagaaggcactttccacacaatgtggcatgtcacccgtggggcagtgttaatgcaccgcggaaagcggattgagccgtcctgggccgatgttaaaaaggacctgatctcatacggcggtgggtggaagctcgagggagaatggaaagagggcgaagaggtacaggtgctggctcttgaaccaggcaagaatcccagagccgtccagacgaaacctgggctgtttaagactaacaccggaacaatcggtgcagtgagtttggatttcagcccaggcacctccgggtctcccattgttgacaggaaaggaaaggtggtcggcctatacggtaatggggtggtaacacgatcgggagcttatgtcagcgccatcgcgcagactgagaagtcaatagaggataaccctgaaattgaggacgatatcttccggaaaaagcgcctgaccattatggacctccatccgggcgccggcaaaacgaagagatacctgcccgcaatcgtgagggaagctataaaacgggggcttcgaacattaattctggccccaactagagttgtggctgcagagatggaagaggccctccgcggattgcctatcaggtatcaaacccccgccatccgtgctgagcacacaggtcgggaaattgtcgacctgatgtgtcatgcgacctttactatgagactcctgtccccagtgagggttcctaactacaatcttatcattatggatgaggcacacttcaccgaccccgccagtatagctgcccgcggctatatctctacacgagtggaaatgggggaggcagccggaatttttatgacggctactccaccgggcagcagagatcctttcccccagtccaacgcgccaatcatggacgaggaacgggagatccccgaaaggtcatggaattctggtcacgagtgggtcaccgattttaaggggaagacagtgtggttcgtacctagcattaaagccggaaacgacatagcagcttgcctgcgcaagaatggcaaaaaggtgatccagttgagtcgtaaaacctttgattccgaatacgttaagactagagccaacgactgggatttcgtcgtgacaaccgacattagcgagatgggcgcaaattttaaggccgagcgggtgatcgatccaaggcgctgtatgaaacccgtcattctaacggacggggaagagcgagtaatcctggctggacctatgccggtgactcattcttcagccgcgcaaagacggggtaggataggccgcaacccaaagaatgaaaacgaccagtatatctacatgggggagcccctcgaaaatgatgaggactgcgcacactggaaagaggccaagatgttactggataacattaatacacctgaaggaatcattccctccatgttcgagccagaaagagagaaagttgacgctatcgatggcgaatacaggcttcggggtgaggcccgtaagacctttgtggacctgatgcgccgaggggatctccctgtctggttggcttatagagtggcagccgagggcataaactacgctgacaggcggtggtgtttcgatggaattaaaaataaccagatcctggaagagaacgttgaagtggagatttggaccaaggagggcgaacgcaagaaactcaagcccagatggctggacgccaggatctatagtgatccacttgcactaaaagagttcaaggaatttgcggccgggcggaaaagcctgactttgaatttaataacagagatgggacgactgcctaccttcatgacacagaaggctagagacgccctcgataacctggcagtccttcatactgctgaagccggtggcaaggcatacaatcacgccctgtcggagctcccggagacgttggaaaccctgctactgctcacacttctggctactgtgaccgggggaatctttttattcttgatgtctggcaaaggtattgggaagatgacactgggcatgtgctgcatcattaccgcgtccatcctcctgtggtatgcccaaatacagccccactggattgcagctagcatcatccttgagtttttcctgattgtactcttgatcccagaacctgagaaacagcgcactccccaggacaaccaactgacgtacgtggttatagccattttaaccgtcgtggccgcaacaatggctaatgaaatgggatttctagagaagactaaaaaggacctgggcctcgggtcaatcaccacacaggagagtgaatctaacattcttgatatcgacctgaggccagcctccgcgtggaccttgtatgctgtggccactacattcgtcacgcctatgctgcggcatagcatagagaattcaagtgttaacgtgagcctcaccgcaatcgccaatcaggctactgtactgatgggacttggtaagggctggcccctctccaaaatggatattggggtgccgctgttggcaatcggatgttactctcaggtcaacccaattacactgaccgccgcgttactactgctcgtggctcactacgccatcattggccctggtcttcaagcaaaggccacccgtgaagctcagaaaagagccgcagctgggatcatgaagaatcccacagttgacggcataactgtgattgatctggagccaatcccctatgaccctaaatttgaaaagcagttgggacaggtcatgctgctcatcctgtgcgtaacgcaagtgcttatgatgaggaccacatgggccttatgtgaggcgctgactctcgccaccggcccgattagcacattgtgggaggggaaccccggacgcttctggaataccactatagcagtttccatggctaacatctttcggggctcatacctggccggtgcagggctactgttctctattatgaagaatacgacaaacacccgaagaggaactggcaatatcggtgaaaccctcggcgagaaatggaagagtaggcttaacgctctggggaaatcggaatttcagatttataagaaaagcggaatccaggaggtggatcgcacattggccaaggagggcataaaacggggggaaactgaccatcacgccgtctccagaggatctgcgaagctgcgttggttcgtggagaggaacatggtcaccccagaaggcaaggtggttgatctcggttgcgggcggggaggctggtcatactattgtggtggcctgaaaaatgtgcgcgaggtaaaggggttaacaaaaggaggccctgggcatgaagagcccatccctatgagcacgtacggatggaaccttgtgcgactgcaatccggcgtcgacgttttctttaccccacccgagaagtgcgatactctcctatgtgacattggtgaaagttctcctaatccaacaatcgaggctgggagaaccctgagggtgttgaacctggtcgaaaattggctcaacaataacactcagttctgcattaaagtgcttaatccctatatgccgagcgtaatcgagaagatggaaacactgcagcggaagtacggaggcgcattggtgcgcaaccctctgtcaagaaattccacccacgagatgtactgggttagtaacgccacgggcaatatagtgagctctgtcaacatgatttccaggatgctcatcaatcgatttaccatgaaacacaagaaagctacatatgagccagatgtggacttagggtcaggaactcggaacatcggtattgaaagcgagatacccaacctggacatcattggcaagcgtatcgaaaaaattaagcaggagcatgaaacctcgtggcactacgatcaagaccatccttataagacatgggcctaccacgggtcttatgagactaaacagaccggaagtgcatccagcatggtcaatggcgtggttagacttctgacaaagccatgggatgtagtgcccatggtcacccagatggccatgactgacacgacaccgttcggtcagcaacgcgtgtttaaagagaaggttgataccaggactcaggaacctaaagaggggaccaagaagctaatgaaaatcacagctgaatggctctggaaggagctgggaaaaaagaaaacgccccggatgtgtaccagagaggaattcactcgcaaggtgaggtcaaacgcggccttgggcgcaatatttacagacgagaataaatggaagtccgctcgagaagccgtcgaggattctcggttctgggaactggtggacagagagaggaacctccaccttgagggcaagtgcgaaacctgtgtatacaatatgatggggaaacgcgagaagaaactgggagaatttggtaaggcaaaaggcagccgtgccatctggtatatgtggttaggggctcggttcctggagtttgaagccttgggattcctcaacgaggatcattggtttagtagaggcaattccctgagcggtgtggagggggaaggactacacaggcttggctacattctgcgcgacgtttctaagaaggagggcggggcgatgtacgcagatgacactgccggatgggacacacgaatcaccctcgaagatctgaaaaacgaggaaatggtcacaaatcatatgaagggtgagcacaaaaagttggctgaggccattttcaaactgacttatcagaacaaggtggtgcgggtccagagaccaacccctaggggcacggttatggacatcatttcacgcagagatcaacgggggagtggacaggtgggcacctacggtctcaatacattcactaacatggaagcacagcttataaggcaaatggagggggaaggaatctttaagtccattcagcatctgaccgtaacagaggagatcgctgtgcagaattggttagcccgtgtcggccgagaacgcctgagcagaatggctatctctggcgacgattgcgtggttaaacccttggacgatcggttcgcctcggcactcactgcgctgaacgacatggggaaggtgaggaaagatattcagcaatgggagccatcacgcggatggaatgactggacccaggtccccttttgcagccaccacttccatgaactagtgatgaaggatggtagagtacttgttgtgccttgtcggaaccaggacgagctgataggcagggcccgaatctcccagggggctggatggagtctcaaagaaacggcctgcctgggcaagtcttatgcacaaatgtggacattgatgtactttcaccgtagagatttacgcctggctgccaacgcaatttgtagcgccgtcccatcccattgggtgccgacctcacggactacatggagtatccacgcgaagcacgagtggatgaccactgaggacatgctcgctgtgtggaatagggtctggattcaggaaaacccctggatggaggacaaaacccctgttgaatcttgggaggaagtgccatatcttggtaagagagaggatcagtggtgcgggagcctgatcggactaacatcccgcgccacgtgggcaaaaaatatacagaccgccatcaaccaagtacggtcactgattggcaatgaggaatacactgactatatgcccagcatgaagaggttccgaagagaggaagaggaagctggcgtgctctggtga

SEQ ID NO: 14652 - RNA, 9876 nt, synthetic construct
  misc_feature 1..9876: note = derived and/or modified CDS sequence (opt3) from DENV-2__EU482581__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtgaccggaaaggactcccctgtcaacatcgaagccgagcccccatttggcgatagctacatcattataggggtggaacctggacagctgaaactaaattggttcaagaagggttcgtctatcggccagatgtttgagacaactatgcgaggggctaaacgcatggccattctcggagacaccgcatgggatttcggctccctgggtggggtttttacatcaatcggcaaggcccttcaccaagtgttcggagctatttacggcgcggcatttagtggggtaagctggactatgaaaatcttgataggagtcatcattacctggatcggcatgaactccagatctacgagcctgtcagtgagtctcgttctggtgggtgtcgtgacactttatctgggggccatggtacaggctgactccggatgtgtggttagctggaagtctaaagagttgaagtgcggctcaggtattttcatcaccgataatgtccacacttggacagaacagtacaagtttcagcccgagagtccaagcaaactcgcctccgcaatacaaaaggcccatgaagagggcatttgtgggatcaggtctgtgacccggctggaaaacttaatgtggaaacagattactcccgagctgaatcacatcctatcggagaacgaagtgaagctcaccataatgacaggagacatcaaaggcattatgcaggctgggaagcgcagcctgagacctcagccaacggagcttaaatattcctggaagacctggggaaaggccaaaatgttgtcaactgaaagtcataatcaaacattcctgatcgatggcccggagaccgcagaatgccccaacacaaatagggcgtggaactctctcgaggtcgaggactacggttttggggttttcactaccaatatttggctgaagttacgtgaaaaacaggacgtgttttgtgatagcaagctgatgtccgctgccatcaaagacaaccgggcagtgcacgccgatatgggatattggatagagtcagctcttaatgacacgtggaagatggaaaaggccagcttcattgaggtaaaatcttgccactggcctaagtcccatacattgtggagtaacggcgtcctcgagagcgaaatgatcatcccaaaaaatttcgcaggtcccgtgtctcagcacaactaccgacctggctatcatacccagactgctgggccatggcacctgggaaagctagagatggattttgacttctgtgaaggcaccacagttgtggtcactgaggattgcgggaacagaggaccctccctgaggaccacaacggcctcaggcaaactcattaccgaatggtgctgtcgcagttgcactctgccgcctcttcggtacagaggtgaggacgggtgttggtacggaatggagatcaggccattgaaggaaaaggaggaaaatctggtgaacagcttagttacagcgggccatggtcaaattgataatttttcgctcggcgtgctggggatggcccttttcctggaggaaatgttgcgcacccgagtaggaactaaacacgctatactcctggtcgcagtgtcctttgtgacactaatcaccggcaacatgtctttccgggacctggggcgtgtcatggttatggtgggagccacgatgactgatgacattggcatgggtgtaacctatctcgctctgcttgccgcatttaaggtgagacccacattcgcggccgggttgctgttaaggaaactcaccagcaaggagctgatgatggctactatcggaattgcccttctgtcacagagtacaatccctgagaccatactagaactcacagatgcactggctttgggcatgatggtcctgaaaatcgtgcgcaatatggagaagtaccagttagccgttactattatggcaatctcctgcgtgcccaacgccgtcattctccaaaatgcttggaaggtgtcttgtaccatcctggcggccgttagcgtgtccccacttctgttgacgtcaagccagcagaaagcagactggatacctctcgctctgacaattaagggcctaaaccccaccgccatctttctgactacccttagtcggacatctaaaaagagatcctggccactcaatgaagccatcatggctgtcgggatggtaagcattctggcatcgtcattgctgaaaaacgacataccgatgactggacctttagtggccggtggcctcctgaccgtttgctatgtgcttacggggaggtctgcggatctggagttggaacgagctgccgacgtcaagtgggaggatcaggcagagatcagtggatccagccccattctctctatcacaattagcgaagacggctccatgtcaatcaaaaatgaggaagaggagcaaaccctgactatactaatccgcacaggtctgcttgtgattagtggggtattcccagtgagcatccccattaccgccgctgcatggtacctctgggaagtcaagaagcagcgggccggagttctgtgggatgtgccttctccaccccctgtgggcaaagcggagttggaagacggcgcttatagaatcaagcagagggggatattaggatactcccagattggtgccggcgtctataaagaggggacttttcacacaatgtggcatgtgacccgtggagcagttctgatgcaccgcggcaagcggatcgaaccgtcatgggccgatgtaaaaaaggacctcatcagttacggtgggggatggaagctggagggcgagtggaaagaaggcgaggaagtgcaagtccttgctctggagccagggaagaaccccagagccgtgcagacgaaacctggattgttcaagactaataccggtacaattggcgcagttagcctagatttttccccagggacctctggatcgcccatcgtggacaggaaaggcaaggtcgtgggtctgtacgggaacggagtagtcacacgaagcggcgcttatgtgtcagccatagcgcagactgaaaagtccattgaggataatcctgagatcgaagacgatattttccggaaaaagcgcctcaccatcatggacctgcatccgggcgccgggaaaacgaagagataccttcccgcaatagttagggaggctattaaacggggattacgaacactgatcctcgccccaactagagtggtcgctgcagaaatggaggaagccttgcgcggtctgcctatcaggtatcagacccccgccattcgtgctgagcacacaggccgggagatcgtggacctcatgtgtcatgcgaccttcactatgagactgcttagtccagttagggtgcctaactacaacctgattataatggatgaagcacactttaccgaccccgcctctatcgctgcccgcgggtatattagcacacgagtcgagatgggagaagcagccggcatcttcatgacggctactccaccgggttccagagatccttttccccaatcaaatgcgccaatcatggacgaggagcgggaaattcccgagaggtcttggaacagcgggcacgaatgggtgaccgatttcaagggaaagacagtatggtttgtgcctagtataaaagccggcaatgacatcgcagcttgcttgcgcaagaacggcaaaaaggttattcagctatcccgtaaaaccttcgatagcgagtacgtcaagactagagccaatgactgggattttgtggtgacaaccgacatctctgaaatgggggcaaacttcaaggccgagcgggtcattgatccaaggcgctgtatgaaacccgtaatcctgacggacggagaggaacgagtgatactcgctggtcctatgccggttactcattcatccgccgcgcagagacggggcaggatcgggcgcaatccaaagaacgagaatgaccaatatatttacatgggagaacccttagagaacgatgaagactgcgcacactggaaagaggccaagatgctgcttgataatatcaacacacctgagggcattatccccagtatgtttgaaccagagagagaaaaagtggacgctatagatggtgagtacaggctgcggggggaagcccgtaagaccttcgtcgacctcatgcgccgaggcgatttgcctgtgtggctggcttatagagttgcagccgagggaattaattacgctgacaggcggtggtgttttgatggcatcaaaaacaatcagattctcgaggaaaacgtggaggtcgaaatctggaccaaggagggggagcgcaagaaactgaagcccagatggcttgacgccaggatatatagcgatccactagcactgaaagaattcaaggagttcgcggccggacggaaatcgttgactttaaacctgatcacagaaatgggtcgactccctacctttatgacacagaaggctagagacgccctggataatcttgcagtgctgcatactgctgaggccggcgggcgcgcatacaaccacgccctctctgaattgccggagacgctggagaccctactgctccttacactgttagctactgtaaccggaggcattttcttgtttctgatgtccggtaaggggatcggcaaaatgacactcggaatgtgctgcattatcaccgcgagcatactgctttggtatgcccagattcaaccccactggatcgcagcttcaatcattctggaattctttctcatcgtgttgctgataccagagcctgaaaagcagaggactccccaggacaatcagttaacgtacgttgtcattgccatcctaaccgtggtggccgcaacaatggctaacgagatgggcttcctggaaaaaactaagaaagacctcgggcttggaagtattaccacacaagagtctgagtccaatatcctggatatagacttgcggccagccagcgcgtggaccctgtatgctgtcgccactacatttgttacgcctatgctccgtcattcaatcgaaaacagtagcgtgaatgtatccctgaccgcaattgccaaccaggctactgtgcttatgggtctcggcaaggggtggcccctgtctaagatggatatcggagtcccgttgctggcaattggctgttacagccaggtgaatccaatcacattaaccgccgcgctactgctccttgttgctcactacgccattatcggtcctgggctgcaggcaaaagccaccagagaggctcaaaagagggccgcagctggcataatgaaaaaccccacagtggacggaattactgtcatcgatttggaaccaatcccctatgaccctaagttcgagaaacagctgggccaggtaatgctcctgattctttgcgtgacgcaggttttaatgatgcgcaccacatgggccctgtgtgaagcgctcactttggccaccgggccgatatccacactgtgggagggaaatcccggccggttttggaacaccactatcgcagtgtcaatggctaatattttccgaggttcttacctagccggggcaggactgctctttagtatcatgaagaacacgacaaataccagaaggggcactggtaacattggcgagacccttggggaaaagtggaaatcgcgcctgaatgctttgggaaagagcgagttccaaatctataaaaagtccggcatacaggaagtcgatcggacactggccaaagaggggatcaagagaggagagactgaccatcacgccgtgtctcgtggctcagcgaaactcaggtggtttgtcgaacggaacatggtgaccccagagggtaaggttgtggatctggggtgcggacgcggcggttggagctactattgtggcgggttaaagaacgtacgagaagtgaaaggacttacaaagggcgggcctggacatgaggaacccattcctatgtccacgtacggctggaatctggtcagactccagagtggtgttgacgtgttcttcaccccacccgagaaatgcgatactctactgtgtgacatcggggagtctagccctaacccaacaattgaagctggaaggaccttgcgggtcctgaatctcgtggagaactggcttaataacaatactcaattttgcatcaaggtactgaacccctatatgccgtcagtgatagaaaaaatggagacattgcagcgcaagtacggcggcgcactggttagaaatcctctctccaggaacagtacccacgaaatgtactgggtgagcaatgccacggggaacattgtctcttccgtgaatatgatctcacgaatgttaatcaaccggttcaccatgaagcacaaaaaggctacatatgagccagatgtcgacctgggaagcggtactcgtaatattggcatagagtcggaaatccccaaccttgacattatcgggaaaagaattgagaagatcaaacaggaacatgagacctcttggcactacgatcaggaccatccttataagacatgggcctaccacggaagttatgaaactaagcaaaccggctccgcaagctcaatggtgaacggtgttgtacgcctgctaacaaaaccatgggatgtggtccccatggtgacccagatggccatgactgacacgacaccgtttgggcagcagagggttttcaaggagaaagtggatacccggactcaagagcctaaggaaggaaccaaaaagctcatgaagataacagctgagtggctgtggaaagaattgggcaagaaaaagacgcccagaatgtgtacccgcgaggagtttactaggaaagtccgatccaatgcggccctgggcgcaatcttcacagacgaaaacaagtggaaatctgctcgggaggccgtggaagatagcagattttgggagctcattgacagggaacgcaatcttcacctggaggggaagtgcgagacctgtgtatacaacatgatgggaaagcgtgaaaaaaagttaggtgagttcggcaaagcaaaggggagtcgggccatctggtatatgtggctgggagctagatttttggaattcgaggccctcggctttctgaatgaagatcattggttctccaggggtaacagcctatctggggtggagggagagggccttcaccgcctgggctacattctccgagacgtttcaaaaaaggaagggggagcgatgtacgcagatgacactgccggttgggacacacggatcaccctggaggatttgaagaatgaagagatggtcacaaaccatatgaaaggcgaacacaagaaactggctgaggccatttttaagctcacttatcagaataaagtggtgagagtccagaggccaacccctcgcgggacggttatggacataatcagtagacgggatcagaggggatccggccaagtgggtacctacgggcttaacacattcactaatatggaggcacagctgattcgtcagatggaaggagagggcatcttcaagagcatccaacatttaaccgtaacagaagagattgctgtgcagaactggctggcccgagtcggccgcgagagattgtctcggatggctatatcgggggacgattgcgtggttaagcccctcgacgataggtttgcctcagcactgactgcgctaaatgacatgggaaaagtgcgcaaggatatccagcagtgggaaccaagcagaggttggaacgactggacccaagtccccttctgctcccaccactttcatgagcttgtgatgaaagatggccgggtactggttgtgccttgtaggaatcaggacgaactcattgggcgagcccgtatcagtcagggagctggctggtctctgaaggagacggcctgcttgggtaaaagctatgcacagatgtggacattaatgtacttccacagacgcgatctgcggctcgctgccaacgcaatttgttccgccgtcccatcacattgggtgccgaccagtaggactacatggtctatccacgcgaagcacgaatggatgaccactgaggacatgcttgctgtgtggaacagagtctggatacaagagaatccctggatggaagacaagacccctgttgagagctgggaagaggtgccatatctggggaaacgcgaagatcagtggtgcggatccctaatcggcctgacatcacgggccacgtgggcaaagaacattcagaccgccatcaatcaggtaaggagcctcattggcaacgaggagtacactgactatatgccctctatgaaacgatttagacgggaagaggaagaggctggggtgttgtggtga

SEQ ID NO: 14653 - RNA, 9876 nt, synthetic construct
  misc_feature 1..9876: note = derived and/or modified CDS sequence (opt3) from DENV-2__EU482582__SS-prME
  source 1..9876: mol_type = other RNA
accgccggcgtgatcattatgctgatacccacggctatggctttccacctcactacgagaaatggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgaaccactttcagcgcgctctcattttcatcctgctgactgcagttgccccatccatgacaatgagatgcatagggatttctaatagggattttgtggaaggagtctcgggtggctcatgggtggacatcgtactcgagcacgggagctgtgttaccactatggctaagaacaagcccacattagatttcgaactgattaaaaccgaggccaagcagcctgcgacgcttcggaaatattgcatcgaagcaaagttgaccaatacaactaccgagagtcgctgtccaacacaaggagagccctccctgaacgaagaacaggacaaacgatttgtgtgcaagcattctatggtcgatagaggctggggtaatgggtgtggactattcggcaagggcgggatcgtgacttgcgccatgtttacctgcaaaaagaacatggaaggaaaagtggtcctccctgagaatctggaatacacaattgttataaccccacacagcggtgaggagcatgctgtgggcaacgacactgggaagcacggaaaagaaatcaagattacgccgcagtcctcaatcacagaggccgaacttaccggctatggtactgtaaccatggagtgtagtcccaggacagggctggatttcaatgaaatggtgttgctccagatggaggacaaagcatggctggtccaccggcaatggtttttagatctgcctctcccatggcttcccggcgctgacacccagggaagcaactggatacagaaggagactctggtgacattcaagaatcctcatgccaaaaagcaggacgttgtggtcttgggctctcaagaaggggcgatgcacacggccctaaccggagcaactgagattcagatgtcctcaggtaacctgctctttacaggccatctgaaatgccgtcttcgcatggataagctgcagttgaaagggatgagctacagtatgtgtaccggaaagttcaagatcgtgaaagaaatcgctgagacacaacacggcactattgtaatcagagttcagtatgagggtgacgggtctccatgcaagattcccttcgaaataatggatctcgagaaaaggcatgtgctgggccggttaatcaccgtcaacccgattgtgacggaaaaggactcccctgtcaatatcgaggccgaacccccatttggagatagctacatcattataggcgtggagcctgggcagctgaaactaaactggttcaagaagggatcgtctatcggtcagatgtttgagaccacaatgcgaggcgctaaacgcatggccattctcggggacactgcatgggatttcggatccctgggcggtgtttttacctcaatcgggaaggcccttcaccaagtgttcggcgctatttacggagcggtatttagtggcgtcagctggacaatgaaaatcttgataggggtgatcattacttggatcggaatgaactccagatctaccagcctgtcagttagtctcgtgctggtcggcgtggtaacgctttatctgggtgcaatggtgcaggccgactccgggtgtgttgtcagctggaagtctaaagaattgaagtgcggatcaggcattttcatcacagataacgtgcacacctggactgagcagtacaagtttcagcccgaaagtccaagcaaactcgcttccgccatacaaaaggcacatgaggaaggtatttgtggcatcaggtctgtgacacggctggagaatttaatgtggaaacagattacccccgagctgaaccacatcctatcggaaaatgaggtcaagctcactataatgaccggggacatcaaaggaattatgcaggccggcaagcgcagcctgagacctcagccaacagaacttaaatattcctggaagacgtgggggaaggctaaaatgttgtcaaccgagagtcataaccaaactttcctgatcgatggaccggaaacagccgagtgccccaataccaacagggcatggaactctctcgaggttgaagactacggctttggtgtgttcacaactaacatttggctgaagttacgtgagaaacaggacgtgttttgtgatagcaagctgatgtccgcggctatcaaagacaatcgggccgtacacgcagatatggggtattggatagaatcagcccttaacgacacctggaagatggagaaggctagcttcattgaggtcaaatcttgccactggcctaagtcccatacgttgtggagtaatggagtgctcgaaagcgagatgatcatccccaaaaatttcgccggccccgtttctcagcacaactaccgacctggttatcatacacagaccgcaggcccatggcacctggggaagctagaaatggattttgacttctgtgagggaactaccgtggtcgtgacagaagattgcggcaatagagggccctccctgaggactaccacagcttcaggaaaactcattacggagtggtgctgtcgcagttgcaccctgccgcctcttcggtacagaggcgaggacggttgttggtacgggatggaaatcaggccattgaaggagaaggaagagaacctggttaatagcttagtgactgccggacatggccaaattgataacttttcgctcggtgtactgggcatggcgcttttcctggaagagatgttgcgcacacgagtcgggaccaaacacgccatactcctggtggctgtgtcctttgtcactctaatcacaggaaatatgtctttccgggacctgggccgtgttatggtgatggtaggggcaaccatgacggatgacattggaatgggcgtgacttatctcgccctgcttgctgcctttaaggtcagacccaccttcgcagcgggtttgctgttaaggaaactcacaagcaaggagctgatgatggccaccatcgggattgcacttctgtcacagagtactatccctgaaacaatactagagctcaccgatgccctggcattgggaatgatggtgctgaaaatcgttcgcaacatggaaaagtaccagttagctgtgacaattatggccatctcctgcgtccccaatgcagtgattctccaaaacgcctggaaggtttcttgtactatcctggctgcggtgagcgtctccccacttctgttgacctcaagccagcagaaagccgactggatacctctcgcactgacgattaagggcctaaatcccacagctatctttctgaccactcttagtcggacctctaaaaagagatcctggccactcaacgaggccatcatggccgtaggcatggtgagcattctggcttcgtcattgctgaaaaatgacataccgatgacagggcctttagttgcaggaggtctcctgactgtgtgctatgtccttaccggcaggtctgccgatctggaattggagcgagcggctgacgtgaagtgggaggatcaggccgaaatcagtgggtccagccccattctctctatcacgattagcgaggacggatccatgtcaatcaaaaacgaagaggaggaacaaacactgaccatactaatccgcactggcctgcttgtaattagtggtgtgttcccagtcagcatccccattacagcagccgcttggtacctctgggaggttaagaagcagcgggcaggggtgctgtgggatgtgccttctccaccccctgtcggaaaagccgaattggaggacggcgcgtatagaatcaagcagaggggcatattagggtactcccagattggagctggtgtgtataaagaaggcacctttcacactatgtggcatgttacacgtggggccgtactgatgcaccgcggaaagcggatcgagccgtcatgggcagatgtgaaaaaggacctcatcagttacggcggtgggtggaagctggagggagaatggaaagagggcgaagaggtccaagtgcttgccctggaaccaggcaagaatcccagagctgttcagaccaaacctgggttgttcaagacgaacactggaaccattggtgccgtgagcctagatttttccccaggcacatctgggtcgcccatcgtcgacaggaaaggaaaggtggtaggcctgtacggtaatggggtcgtgacccgaagcggagcatatgtttcagctatagcccagacagagaagtccattgaggataaccctgaaatcgaggacgatattttccggaaaaagcgcctcactatcatggacctgcatccgggcgcgggcaaaaccaagagataccttcccgccatagtgagggaagcaattaaacgggggttacgaacgctgatcctcgctccaacaagagtcgtggccgctgagatggaagaggcattgcgcggactgcctatcaggtatcagactcccgccattcgtgccgagcacaccggtcgggaaatcgttgacctcatgtgtcatgctacattcaccatgagactgcttagtccagtgagggtccctaactacaatctgattataatggatgaggcgcactttactgaccccgcatctatcgccgctcgcggctatattagcacccgagtggaaatgggggaggccgcaggaatcttcatgacagccacgccaccgggctccagagatccttttccccaatcaaacgctccaatcatggacgaggaacgggagattcccgaaaggtcttggaatagcggtcacgagtgggtaactgatttcaaggggaagaccgtgtggtttgttcctagtataaaagcgggaaacgacatcgccgcatgcttgcgcaagaatggcaaaaaggtcattcagctatcccgtaaaacattcgatagcgaatacgtgaagaccagagctaacgactgggattttgtggtcactacagacatctctgagatgggcgccaatttcaaggcagagcgggtaattgatccaaggcgctgtatgaaacccgtgatcctgaccgacggggaagaacgagttatactcgccggacctatgccggtgacgcattcatccgctgcccagagacggggtaggatcggccgcaacccaaagaatgaaaacgaccaatatatttacatgggggagcccttagaaaatgatgaggactgcgcgcactggaaagaggcaaagatgctgcttgataacatcaatactcctgaaggaattatccccagtatgtttgagccagaaagagagaaagtcgacgccatagatggcgaatacaggctgcggggtgaggctcgtaagacattcgtggacctcatgcgccgaggggatttgcctgtttggctggcctatagagtggctgcagagggcattaactacgccgacaggcggtggtgttttgatggaatcaaaaataaccagattctcgaagagaacgtcgaagtggagatctggaccaaggagggcgaacgcaagaaactgaagcccagatggcttgacgctaggatatatagcgatccactagccctgaaagagttcaaggagttcgcagcggggcggaaatcgttgaccttaaatctgatcactgagatgggacgactccctacatttatgacccagaaggccagagacgctctggataaccttgccgtactgcatacagcagaagctggtggccgcgcctacaatcacgcactctctgagttgccggagactctggaaacgctactgctccttaccctgttagccacagtgactgggggaattttcttgtttctgatgtccggcaagggtatcgggaaaatgaccctcggcatgtgctgcattatcacagctagcatactgctttggtatgcgcagattcaaccccactggatcgccgcatcaatcattctggagttctttctcatcgttttgctgataccagaacctgagaagcagaggaccccacaggacaaccagttaacttacgtcgtgattgctatcctaacggtggtcgccgccaccatggcaaatgaaatgggattcctggagaaaacaaagaaagacctcggccttgggagtactaccacacaagagtctgaatccaacattctggatatcgacttgcggccagctagcgcctggaccctgtatgcggttgctactacatttgtgacgcctatgctccgtcattcaatagagaatagtagcgtaaacgtgtccctgaccgccatcgcaaatcaggccactgtccttatgggactcggtaagggctggcccctgtctaagatggatattggggtgccgttgctggctatcggatgttacagccaggttaacccaattacattaaccgcagccctactgctccttgtggcgcactacgctatcattggccctggtctgcaggccaaagcaaccagagaagcccaaaagagggctgccgcagggatcatgaaaaatcccacagtcgacggcataactgtaattgatttggagccaatcccctatgaccctaagttcgaaaaacagctgggacaggtgatgctcctgatcctttgcgttacacaggtgttaatgatgcgcaccacatgggctctgtgtgaggccctcactttggcgaccggcccgatttccacactgtgggaggggaaccccggacggttttggaataccactatagccgtctcaatggcaaacatcttccgaggctcttacctagctggtgccgggctgctctttagtattatgaagaatacgacaaacaccagaaggggaactggcaatatcggtgaaacccttggcgagaagtggaaatcgcgcctgaacgcattgggaaagagcgagttccaaatttataaaaagtccggaatccaggaggtggatcggacactggctaaagagggcataaagagaggggaaactgaccatcacgccgtctctcgtggatcagccaaactcaggtggtttgtggagcggaacatggttaccccagaaggcaaggtggtagatctgggttgcgggcgcggaggctggagctactattgtggtggcttaaagaatgtgcgagaggtcaaagggcttacaaagggaggccctgggcatgaagaacccatccctatgtccacgtacggatggaacctggttagactccagagtggcgtggacgtcttcttcaccccacccgagaaatgcgatactctactgtgtgacattggtgaatctagccctaatccaacaatcgaggcggggaggaccttgcgggtgctgaacctcgtagaaaattggcttaacaataacactcaattttgcattaaggtgctgaatccctatatgccgtcagttatcgagaaaatggaaacattgcagcgcaagtacggaggcgctctggtgagaaaccctctctccaggaatagtacccacgagatgtactgggtcagcaacgcaacgggcaatatagtgtctaccgtcaacatgatttcccgaatgttaatcaatcggttcacaatgaagcacaaaaaggccacttatgagccagatgtggacctggggtcaggaacccgtaacatcggtattgaaagcgagatacccaaccttgacatcattggcaaaagaatcgaaaagattaaacaggagcatgaaacatcgtggcactacgatcaggaccatccttataagacttgggcttaccacgggtcttatgagaccaagcaaacaggaagtgcctccagcatggttaatggcgtagtgcgcctgctaaccaaaccatgggatgtcgtgcccatggttactcagatggcaatgacggacacaaccccgtttggtcagcagagggtgttcaaggagaaagtcgatactcggacccaagaacctaaggaggggacgaaaaagctcatgaagatcacagccgaatggctgtggaaagagttgggaaagaaaaagacccccagaatgtgtactcgcgaggaatttacaaggaaagtgcgatcaaacgctgcgctgggcgccatattcaccgacgagaataagtggaaatccgcacgggaagctgtagaggattctagattttgggaactcatcgacagggagcgcaaccttcacctggagggcaagtgcgaaacttgtgtgtacaatatgatggggaagcgtgagaaaaagttaggagagttcggtaaagccaagggcagccgggcaatttggtatatgtggctgggggccagatttttggagttcgaagctctcggatttctgaacgaggatcattggttcagtaggggcaattccctaagcggtgttgagggggaaggacttcaccgcctgggctacatcctccgagacgtctctaaaaaggagggcggggccatgtacgcggatgacacagcaggatgggacacccggattacactggaagatttgaagaacgaggaaatggtgactaatcatatgaaaggtgagcacaagaaactggccgaggctatctttaagctcacctatcagaacaaagtggtcagagttcagaggccaacgcctcgcggcaccgtgatggacattatatcaagacgggatcagagggggagtggacaagtaggcacatacggtcttaatactttcaccaacatggaagcccagctgatccgtcagatggagggggaaggaattttcaagtccatccaacatttaacagtgactgaggagatcgcagtccagaattggctggctcgagtgggccgcgaaagattgagccggatggccatttctggcgacgattgcgttgtgaagcccctcgacgataggtttgcttcggccctgaccgcactaaacgacatggggaaagtccgcaaggatatacagcagtgggagccatcaagaggatggaatgactggacgcaagtgcccttctgcagccaccactttcatgaacttgtaatgaaagatggtcgggttctggtggtcccttgtaggaaccaggacgagctcatcggccgagcgcgtatttcccagggggccggatggagtctgaaggaaacagcttgcttgggcaaatcttatgcccagatgtggaccttaatgtacttccacagacgcgatctgcggctcgcagctaacgccatctgtagcgcagtgccatcccattgggtgccgacttcaaggacaacctggagtattcacgccaagcacgagtggatgactaccgaggacatgcttgcggtctggaatagagtttggatccaagaaaacccctggatggaggacaagacacctgtggaatcttgggaggaagtaccatatctgggtaaacgcgaggatcagtggtgcgggagcctaataggactgacgtcccgggctacctgggccaagaatatccagactgcaattaaccaggtgaggtcactcatcggcaatgaggaatacacagactatatgcccagcatgaaacgatttagacgggaggaagaggaagccggcgtcttgtggtga

SEQ ID NO: 14654 - RNA, 9876 nt, synthetic construct
  misc_feature 1..9876: note = derived and/or modified CDS sequence (opt3) from DENV-2__EU482583__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtgaccgaaaaggactcccctgtcaacatcgaggccgaacccccatttggagatagctacatcattataggcgtggagcctgggcagctgaaactaaattggttcaagaagggatcgtctatcggtcagatgtttgagacaactatgcgaggcgctaaacgcatggccattctcggggacaccgcatgggatttcggatccctgggcggtgtttttacatcaatcgggaaggcccttcaccaagtgttcggcgctatttacggagcggcatttagtggcgtaagctggactatgaaaatcttgataggggtcatcattacctggatcggaatgaactccagatctacgagcctgtcagtgagtctcgttctggtgggcgtcgtgacactttatctgggtgccatggtacaggctgactccgggtgtgtggttagctggaagaataaagaattgaagtgcggatctggcattttcatcaccgataacgtccacacttggacagagcagtacaagtttcagcccgaatcaccaagtaaactcgccagcgcaatacaaaaggcccatgaggaaggtatttgtggcatcaggtccgtgacccggctggagaatttaatgtggaaacagattactcccgagctgaaccacatcctatctgaaaatgaggtgaagctcaccataatgacaggggacatcaaaggaattatgcaggctggcaagcgctcgctgagacctcagccaacggaacttaaatatagctggaagacctgggggaaggccaaaatgttgtccactgagtcacataaccaaacattcctgatcgatggaccggaaaccgcagagtgccccaatacaaacagggcgtggaatagtctcgaggtcgaagactacggctttggtgttttcactaccaacatttggctgaagttacgtgagaaacaggacgtgttttgtgattctaagctgatgagcgctgccatcaaagacaatcgggcagtgcacgccgatatggggtattggatagaatccgctcttaacgacacgtggaagatggagaaggcctcattcattgaggtaaaaagctgccactggcctaagtctcatacattgtggtccaatggagtcctcgaaagtgagatgatcatcccaaaaaacttcgcaggccccgtgagccagcacaactaccgacctggttatcatacccagactgctggcccatggcacctggggaagctagaaatggattttgacttctgtgagggaaccacagttgtggtcactgaagattgcggcaatagagggccctctctgaggaccacaacggcctccggaaaactcattaccgagtggtgctgtcgctcatgcactctgccgcctcttcggtacagaggcgaggacggttgttggtacgggatggaaatcaggccattgaaggagaaggaagagaacctggtgaatagtttagttacagcgggacatggccaaattgataactttagcctcggtgtgctgggcatggcccttttcctggaagagatgttgcgcacccgagtagggactaaacacgctatactcctggtcgcagtgtcgtttgtgacactaatcaccggaaatatgtccttccgggacctgggccgtgtcatggttatggtgggggccacgatgactgatgacattggaatgggcgtaacctatctcgctctgcttgccgcatttaaggtgagacccacattcgcggccggtttgctgttaaggaaactcacctctaaggagctgatgatggctactatcgggattgcccttctgagccagtcaacaatccctgaaaccatactagagctcacagatgcactggctttgggaatgatggtcctgaaaatcgtgcgcaacatggaaaagtaccagttagccgttactattatggcaatcagttgcgtgcccaatgccgtcattctccaaaacgcttggaaggtgtcctgtaccatcctggcggccgtttctgtgagcccacttctgttgacgtcctcacagcagaaagcagactggatacctctcgctctgacaattaagggcctaaatcccaccgccatctttctgactacccttagccggacaagtaaaaagagatcttggccactcaacgaggccatcatggctgtcggcatggtatccattctggcaagctcgttgctgaaaaatgacataccgatgactgggcctttagtggccggaggtctcctgaccgtttgctatgtgcttacgggcaggtcagcggatctggaattggagcgagctgccgacgtcaagtgggaggatcaggcagaaatctctgggagttcccccattctcagcatcacaatttctgaggacggaagcatgtccatcaaaaacgaagaggaggaacaaaccctgactatactaatccgcacaggcctgcttgtgatttcaggtgtattcccagtgagtatccccattaccgccgctgcatggtacctctgggaggtcaagaagcagcgggccggggttctgtgggatgtgcctagcccaccccctgtgggaaaagcggaattggaggacggcgcttatagaatcaagcagaggggcatattagggtactctcagattggagccggtgtctataaagaaggcacttttcacacaatgtggcatgtgacccgtggggcagttctgatgcaccgcggaaagcggatcgagccgtcctgggccgatgtaaaaaaggacctcatctcatacggcggtgggtggaagctggagggagaatggaaagagggcgaagaggtgcaagtccttgctctggaaccaggcaagaatcccagagccgtgcagacgaaacctgggttgttcaagactaacaccggaacaattggtgcagttagtctagattttagcccaggcacctccgggtctcccatcgtggacaggaaaggaaaggtcgtgggcctgtacggtaatggggtagtcacacgatcgggagcttatgtgagcgccatagcgcagactgagaagtcaattgaggataaccctgaaatcgaggacgatattttccggaaaaagcgcctcaccatcatggacctgcatccgggcgccggcaaaacgaagagataccttcccgcaatagttagggaagctattaaacgggggttacgaacactgatcctcgccccaactagagtggtcgctgcagagatggaagaggccttgcgcggactgcctatcaggtatcagacccccgccattcgtgctgagcacacaggtcgggaaatcgtggacctcatgtgtcatgcgaccttcactatgagactgctttccccagttagggtgcctaactacaatctgattataatggatgaggcacactttaccgaccccgccagtatcgctgcccgcggctatatttctacacgagtcgaaatgggggaggcagccggaatcttcatgacggctactccaccgggcagcagagatccttttccccaatccaacgcgccaatcatggacgaggaacgggagattcccgaaaggtcatggaattctggtcacgagtgggtgaccgatttcaaggggaagacagtatggtttgtgcctagcataaaagccggaaacgacatcgcagcttgcttgcgcaagaatggcaaaaaggttattcagctaagtcgtaaaaccttcgatgccgaatacgtcaagactagagcaaacgactgggattttgtggtgacaaccgacatctccgagatgggcgccaatttcaaggctgagcgggtcattgatccaaggcgctgtatgaaacccgtaatcctgacggacggggaagagcgagtgatactcgccggacctatgccggttactcatagctctgcggcacagagacggggtaggatcggccgcaacccaaagaatgaaaacgaccaatatatttacatgggggagcccttagaaaatgatgaggactgcgcccactggaaagaggctaagatgctgcttgataacatcaatacacctgaaggaattatcccctcaatgtttgagccagaaagagagaaagtggacgccatagatggcgaatacaggctgcggggtgaggctcgtaagaccttcgtcgacctcatgcgccgaggggatttgcctgtgtggctggcatatagagttgccgctgagggcattaactacgccgacaggcggtggtgttttgatggaatcaaaaataaccagattctcgaagagaacgtggaagtcgagatctggaccaaggagggcgaacgcaagaaactgaagcccagatggcttgacgcaaggatatattccgatccactagcgctgaaagagttcaaggaattcgccgctgggcggaaaagtttgactttaaatctgatcacagagatgggacgactccctacctttatgacacagaaggccagagacgcactggataaccttgctgtgctgcatactgccgaagcaggtggccgcgcctacaatcacgctctcagcgagttgccggagacgctggaaaccctactgctccttacactgttagcgactgtaaccgggggaattttcttgtttctgatgtcgggcaagggtatcgggaaaatgacactcggcatgtgctgcattatcaccgcctctatactgctttggtatgcacagattcaaccccactggatcgctgcctccatcattctggagttctttctcatcgtgttgctgataccagaacctgagaagcagaggactccccaggacaaccagttaacgtacgttgtcattgccatcctaaccgtggtggcagctacaatggccaatgaaatgggattcctggagaaaactaagaaagacctcggccttgggagcattaccacacaagagtcagaaagtaacatcctggatatagacttgcggccagcgtctgcttggaccctgtatgccgtcgcaactacatttgttacgcctatgctccgtcattccatcgagaatagctcagtgaacgtaagtctgaccgccattgctaatcaggcaactgtgcttatgggactcggtaagggctggcccctgagcaagatggatatcggggtcccgttgctggccattggatgttactcccaggtgaacccaatcacattaaccgcggctctactgctccttgttgcccactacgcaattatcggccctggtctgcaggccaaagctaccagagaagcccaaaagagggcagctgccgggataatgaaaaatcccacagtggacggcattactgtcatcgatttggagccaatcccctatgaccctaagttcgaaaaacagctgggacaggtaatgctcctgattctttgcgtgacgcaggttttaatgatgcgcaccacatgggcgctgtgtgaggccctcactttggcaaccggcccgatatctacactgtgggaggggaaccccggacggttttggaataccactatcgctgtgagcatggccaacattttccgaggctcctacctagcaggtgctgggctgctcttttcaatcatgaagaatacgacaaacaccagaaggggaactggcaatattggtgaaacccttggcgagaagtggaaatctcgcctgaacgccttggggaagagtgaattccaaatctataaaaagtcgggaatacaggaggtcgatcggacactggccaaagagggcatcaagagaggggaaactgaccatcacgcggtgagccgtggatccgctaaactcaggtggtttgtcgagcggaacatggtgaccccagaaggcaaggttgtggatctgggttgcgggcgcggaggctggtcttactattgtggtggcttaaagaatgtacgagaggtgaaagggcttacaaagggaggccctgggcatgaagagcccattcctatgtcaacgtacggatggaacctggtcagactccagagcggcgttgacgtgttcttcaccccacccgagaaatgcgatactctactgtgtgacatcggtgaatccagtcctaatccaacaattgaggcagggaggaccttgcgggtcctgaacctcgtggaaaattggcttaacaataacactcaattttgcatcaaggtactgaatccctatatgccgtctgtgatagagaaaatggaaacattgcagcgcaagtacggaggcgccctggttagaaaccctctcagcaggaattcaacccacgagatgtactgggtgtccaacgctacgggcaatattgtcagtagcgtgaacatgatctctcgaatgttaatcaatcggttcaccatgaagcacaaaaaggccacatatgagccagatgtcgacctggggtccggaactcgtaacattggtatagaatcagagatccccaaccttgacattatcggcaaaagaattgaaaagatcaaacaggagcatgaaaccagctggcactacgatcaggaccatccttataagacatgggcataccacgggtcgtatgagactaagcaaaccggatctgccagttccatggtgaatggcgttgtacgcctgctaacaaaaccatgggatgtggtccccatggtgacccagatggctatgactgacacgacaccgtttggtcagcagagggttttcaaggagaaagtggatacccggactcaagaacctaaggaggggaccaaaaagctcatgaagataacagcggaatggctgtggaaagagttgggaaagaaaaagacgcccagaatgtgtacccgcgaggaatttactaggaaagtccgaagcaacgccgcactgggcgctatcttcacagacgagaataagtggaaatcagcccgggaagcagtggaggattccagattttgggaactcattgacagggagcgcaaccttcacctggagggcaagtgcgaaacctgtgtatacaatatgatggggaagcgtgagaaaaagttaggagaattcggtaaagccaagggctctcgggctatctggtatatgtggctgggggccagatttttggagttcgaagcgctcggatttctgaacgaggatcattggttcagcaggggcaatagtctatccggtgtggagggggaaggacttcaccgcctgggctacattctccgagacgttagcaaaaaggagggcggggcaatgtacgccgatgacactgctggatgggacacacggatcaccctggaagatttgaagaacgaggaaatggtcacaaatcatatgaaaggtgagcacaagaaactggccgaggcaatttttaagctcacttatcagaacaaagtggtgagagtccagaggccaacccctcgcggcacggttatggacataatctctagacgggatcagagggggtcaggacaagtgggcacctacggtcttaatacattcactaacatggaagctcagctgattcgtcagatggagggggaaggaatcttcaagagtatccaacatttaaccgtaacagaggagattgccgtgcagaattggctggctcgagtcggccgcgaaagattgtcccggatggccataagcggcgacgattgcgtggttaagcccctcgacgataggtttgcatctgcgctgactgccctaaacgacatggggaaagtgcgcaaggatatccagcagtgggagccatcgagaggatggaatgactggacccaagtccccttctgctcacaccactttcatgaacttgtgatgaaagatggtcgggtactggttgtgccttgtaggaaccaggacgagctcattggccgagctcgtatcagccagggggccggatggtccctgaaggaaacggcatgcttgggcaaaagttatgctcagatgtggacattaatgtacttccacagacgcgatctgcggctcgccgcaaacgccatttgttctgcggtcccaagccattgggtgccgacctccaggactacatggtcaatccacgctaagcacgagtggatgaccactgaggacatgcttgccgtgtggaatagagtctggatacaagaaaacccctggatggaggacaagacccctgttgaaagttgggaggaagtgccatatctgggtaaacgcgaggatcagtggtgcgggtctctaatcggactgacaagccgggcaacgtgggccaagaatattcagaccgctatcaaccaggtaaggtccctcattggcaatgaggaatacactgactatatgccctcaatgaaacgatttagacgggaggaagaggaagccggcgtgttgtggtga

SEQ ID NO: 14655 - RNA, 9876 nt, synthetic construct
  misc_feature 1..9876: note = derived and/or modified CDS sequence (opt3) from DENV-2__EU482585__SS-prME
  source 1..9876: mol_type = other RNA
accgccggcgtgatcattatgctgatacccacggctatcgcattccacctcactacgcggaacggggagcctcatatgattgtcggaaggcaggaaaagggtaaaagccttctgtttaagaccgaggacggcgttaatatgtgcacattgatggccatcgatttaggggaactgtgtgaggacactattacctacaaatgcccactactccggcaaaacgaaccggaggatatcgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatagagacctggatcctgcggcatcctggcttcacaattatggccgcaatcttggcctacaccattggcacgactcactttcagcgcgctctcatcttcatactgctgacagcagttgccccatccatgaccatgagatgcattgggatctctaacagggattttgtggaaggagtctcgggtggctcatgggtggacattgtactcgagcacgggagctgtgttactacaatggctaagaataagcccaccttagatttcgaactgatcaaaacggaggccaagcagcctgcgacccttcggaaatattgcatcgaagcaaagttgacaaacactaccacagagagtcgctgtccaactcaaggagagccctccctgaatgaggaacaggacaaacgatttgtgtgcaagcattctatggtcgatagaggctggggtaacgggtgtggactattcggcaagggcgggattgtgacctgcgccatgtttacatgcaaaaagaatatggaaggaaaagtggtcctccctgagaacctggaatacaccatagttatcactccacacagcggtgaggagcatgctgtgggcaatgacacggggaagcacggaaaagaaattaagatcacaccgcagtcctcaataaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggattcagaaggagacactggtgacgttcaagaaccctcatgccaaaaagcaggacgttgtggtcttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtgaaagaaattgctgagactcaacacggcaccatcgtaattagagttcagtatgagggtgacgggtctccatgcaagatacccttcgaaatcatggatctcgagaaaaggcatgtgctgggccggttaattacggtcaacccgatcgtgaccgaaaaggactcccctgtcaacatcgaggccgaacccccatttggagatagctacattataatcggcgtggagcctgggcagctgaaactaaattggttcaagaagggatcgtctattggtcagatgtttgagacaactatgcgaggcgctaaacgcatggccatcctcggggacaccgcatgggatttcggatccctgggcggtgtttttacatcaattgggaaggcccttcaccaagtgttcggcgctatctacggagcggcatttagtggcgtaagctggactatgaaaatattgatcggggtcattatcacctggattggaatgaactccagatctacgagcctgtcagtgagtctcgttctggtgggcgtcgtgacactttatctgggtgccatggtacaggctgactccgggtgtgtggttagctggaagtctaaagaattgaagtgcggatcaggcatcttcataaccgataatgtccacacttggacagagcagtacaagtttcagcccgaaagtccaagcaaactcgcctccgcaattcaaaaggcccatgaggaaggtatctgtggcattaggtctgtgacccggctggagaacttaatgtggaaacagatcactcccgagctgaatcacatactatcggaaaacgaggtgaagctcaccatcatgacagggggaattaaaggcatcatgcaggctgggaagcgcagcctgagacctcagccaacggaacttaaatattcctggaagacctggggaaaggccaaaatgttgtcaactgagagtcataatcaaacattcctgattgacggcccggaaaccgcagagtgccccaacacaaatagggcgtggaactctctcgaggtcgaagattacggttttggggttttcactaccaatatctggctgaagttacgtgagaaacaggacgtgttttgtgacagcaagctgatgtccgctgccataaaagataaccgggcagtgcacgccgacatgggatattggattgaatcagctcttaatgatacgtggaagatggagaaggccagcttcatcgaggtaaaatcttgccactggcctaagtcccatacattgtggagtaacggcgtcctcgaaagcgagatggtgatccccaaaaatttcgcaggtcccgtttctcagcacaactaccgacctggctatcatacccagactgctgggccatggcacctgggaaagctagaaatggactttgatttctgtgagggcaccacagtggtcgtgactgaagactgcgggaacagaggaccctccctgaggaccacaacggcctcaggcaaactcattaccgagtggtgctgtcgcagttgcactctgccgcctcttcggtacagaggtgaggatgggtgttggtacggaatggaaatcaggccattgaaggagaaggaagagaatctggttaacagcttagtgacagcgggccatggtcaaattgacaatttttcgctcggcgtactggggatggcccttttcctggaagagatgttgcgcacccgagtcggaactaaacacgctatactcctggtggcagtgtcctttgtcacactaatcaccggcaacatgtctttccgggatctggggcgtgttatggtgatggtaggagccacgatgactgacgatattggcatgggtgtgacctatctcgctctgcttgccgcatttaaggtcagacccacattcgcggccgggttgctgttaaggaaactcaccagcaaggagctgatgatggctactatcggaattgcccttctgtcacagagtacaatccctgaaaccatactagagctcacagacgcactggctttgggcatgatggtgctgaaaatcgttcgcaatatggaaaagtaccagttagccgtgactattatggcaatctcctgcgtccccaacgccgtgattctccaaaatgcttggaaggtttcttgtaccatcctggcggccgtgagcgtctccccacttctgttgacgtcaagccagcagaaagcagattggatacctctcgctctgacaattaagggcctaaaccccaccgccatctttctgactacccttagtcggacatctaaaaagagatcctggccactcaatgaggccatcatggctgtagggatggtgagcattctggcatcgtcattgctgaaaaacgacataccgatgactggacctttagttgccggtggcctcctgaccgtgtgctatgtccttacggggaggtctgcggacctggaattggagcgagctgccgatgtgaagtgggaggaccaggcagaaatcagtggatccagccccattctctctatcacaattagcgaggatggctccatgtcaatcaaaaatgaagaggaggaacaaaccctgactatactaatccgcacaggtctgcttgtaattagtggggtgttcccagtcagcatccccattaccgccgctgcatggtacctctgggaggttaagaagcagcgggccggagtgctgtgggacgtgccttctccaccccctgtcggcaaagcggaattggaggatggcgcttatagaatcaagcagagggggatattaggatactcccagattggtgccggcgtgtataaagaagggacttttcacacaatgtggcatgttacccgtggagcagtactgatgcaccgcggcaagcggatcgagccgtcatgggccgacgtgaaaaaggatctcatcagttacggtgggggatggaagctggagggcgaatggaaagagggcgaagaggtccaagtgcttgctctggaaccagggaagaaccccagagccgttcagacgaaacctggattgttcaagactaataccggtacaattggcgcagtgagcctagacttttccccagggacctctggatcgcccatcgtcgataggaaaggcaaggtggtaggtctgtacgggaacggagtcgtgacacgaagcggcgcttatgtttcagccatagcgcagactgagaagtccattgaggacaatcctgaaatcgaggatgacattttccggaaaaagcgcctcaccatcatggatctgcatccgggcgccgggaaaacgaagagataccttcccgcaatagtgagggaagctattaaacggggattacgaacactgatcctcgccccaactagagtcgtggctgcagagatggaagaggccttgcgcggtctgcctatcaggtatcagacccccgccattcgtgctgagcacacaggccgggaaatcgttgacctcatgtgtcatgcgaccttcactatgagactgcttagtccagtgagggtccctaactacaacctgattataatggacgaggcacactttaccgatcccgcctctatcgctgcccgcgggtatattagcacacgagtggaaatgggagaggcagccggcatcttcatgacggctactccaccgggttccagagacccttttccccaatcaaatgcgccaatcatggatgaggaacgggagattcccgaaaggtcttggaacagcgggcacgagtgggtaaccgacttcaagggaaagacagtgtggtttgttcctagtataaaagccggcaatgatatcgcagcttgcttgcgcaagaacggcaaaaaggtcattcagctatcccgtaaaaccttcgacagcgaatacgtgaagactagagccaatgattgggactttgtggtcacaaccgatatctctgagatgggggcaaacttcaaggccgagcgggtaattgacccaaggcgctgtatgaaacccgtgatcctgacggatggagaagaacgagttatactcgctggtcctatgccggtgactcattcatccgccgcgcagagacggggcaggatcgggcgcaatccaaagaacgaaaatgaccaatatatttacatgggagagcccttagaaaacgacgaggattgcgcacactggaaagaggccaagatgctgcttgacaatatcaacacacctgaaggcattatccccagtatgtttgagccagaaagagagaaagtcgatgctatagacggtgaatacaggctgagaggggaagcccgtaagaccttcgtggatctcatgcgccgaggcgacttgcctgtttggctggcttatagagtggcagccgagggaattaattacgctgataggcggtggtgttttgacggcatcaaaaacaatcagattctcgaagagaacgtcgaagtggagatctggaccaaggagggggaacgcaagaaactgaagcccagatggcttgatgccaggatatatagcgacccactagcactgaaagagttcaaggagttcgcggccggacggaaatcgttgactttaaacctgatcacagagatgggtcgactccctacctttatgacacagaaggctagagatgccctggacaatcttgcagtactgcatactgctgaagccggcgggcgcgcatacaaccacgccctctctgagttgccggagacgctggaaaccctactgctccttacactgttagctactgtgaccggaggcattttcttgtttctgatgtccggtaaggggatcggcaaaatgacactcggaatgtgctgcattatcaccgcgagcatactgctttggtatgcccagattcaaccccactggatcgcagcttcaatcattctggagttctttctcatcgttttgctgataccagaacctgagaagcagaggactccccaggataatcagttaacgtacgtcgtgattgccatcctaaccgtggtcgccgcaacaatggctaacgaaatgggcttcctggagaaaactaagaaagacctcgggcttggaagtattaccacacaagagtctgaatccaatatcctggacatagatttgcggccagccagcgcgtggaccctgtatgctgttgccactacatttgtgacgcctatgctccgtcattcaatcgagaacagtagcgtaaatgtgtccctgaccgcaattgccaaccaggctactgtccttatgggtctcggcaaggggtggcccctgtctaagatggacatcggagtgccgttgctggcaattggctgttacagccaggttaatccaatcacattaaccgccgcgctactgctccttgtggctcactacgccattatcggtcctgggctgcaggcaaaagccaccagagaagctcaaaagagggccgcagctggcataatgaaaaaccccacagtcgatggaattactgtaatcgacttggagccaatcccctatgatcctaagttcgaaaaacagctgggccaggtgatgctcctgattctttgcgttacacaggtgttaatgatgcgcaccacatgggccctgtgtgaggcgctcactttggccaccgggccgatatccacactgtgggagggaaatcccggccggttttggaacaccactatcgcagtctcaatggctaatattttccgaggttcttacctagccggggcaggactgctctttagtatcatgaagaacacgacaaataccagaaggggcactggtaacattggcgaaacccttggggagaagtggaaatcgcgcctgaatgctttgggaaagagcgagttccaaatctataaaaagtccggcatacaggaggtggaccggacactggccaaagaggggatcaagagaggagaaactgatcatcacgccgtctctcgtggctcagcgaaactcaggtggtttgtggagcggaacatggttaccccagaaggtaaggtggtagacctggggtgcggacgcggcggttggagctactattgtggcgggttaaagaacgtgcgagaggtcaaaggacttacaaagggcgggcctggacatgaggaaccaattcctatgtccacgtacggctggaatctggttagactccagagtggtgtggatgtcttcttcaccccacccgagaaatgcgacactctactgtgtgatatcggggaatctagccctaacccaacaattgaggctggaaggaccttgcgggtgctgaatctcgtagaaaactggcttaattcaaacactcaattttgcatcaaggtgctgaatccctatatgccgtccgttatagagaaaatggaaacattgcagcgcaagtacggcggcgcactggtgagaaaccctctcagtaggaatagcacccacgagatgtactgggtctctaacgccacggggaatattgtgtcctcagtcaacatgatcagccgaatgttaatcaatcggttcaccatgaagcacaaaaaggctacatatgagccagacgtggatctgggatcgggtactcgtaacattggcatagaatctgagatccccaatcttgacattatcgggaaaagaattgaaaagatcaaacaggagcatgaaaccagttggcactacgaccaggatcatccttataagacatgggcctaccacggatcctatgagactaagcaaaccggcagcgcatcatccatggttaacggtgtagtgcgcctgctaacaaaaccatgggacgtcgtgcccatggttacccagatggccatgactgatacgacaccgtttgggcagcagagggtgttcaaggagaaagtcgacacccggactcaagaacctaaggagggaaccaaaaagctcatgaagataacagctgaatggctgtggaaagagttgggcaagaaaaagacgcccagaatgtgtacccgcgaggaatttactaggaaagtgcgatctaacgcggccctgggcgcaatcttcacagatgagaataagtggaaaagcgctcgggaagccgtagaggacagtagattttgggaactcattgatagggagcgcaaccttcacctggaggggaagtgcgaaacctgtgtgtacaatatgatgggaaagcgtgagaaaaagttaggtgagttcggcaaagcaaaggggtcccgggccatctggtatatgtggctgggagctagatttttggagttcgaagccctcggctttctgaacgaggaccattggttcagcaggggtaattctctatcaggggttgagggagaaggccttcaccgcctgggctacattctccgagatgtcagtaaaaaggaagggggagcgatgtacgcagacgatactgccggttgggacacacggatcaccctggaagacttgaagaacgaggaaatggtgacaaatcatatgaaaggcgagcacaagaaactggctgaggccatttttaagctcacttatcagaacaaagtggtcagagttcagaggccaacccctcgcgggacggtgatggatataatctccagacgggaccagaggggaagcggccaagtaggtacctacgggcttaatacattcactaacatggaagcacagctgattcgtcagatggagggagaaggcatcttcaagtctatccaacatttaaccgtgacagaggagattgctgtccagaattggctggcccgagtgggccgcgaaagattgtcgcggatggctatatcaggggatgactgcgttgtgaagcccctcgatgacaggtttgccagcgcactgactgcgctaaacgatatgggaaaagtccgcaaggacatccagcagtgggagccatccagaggttggaatgattggacccaagtgcccttctgcagtcaccactttcatgaacttgtaatgaaagacggccgggttctggtggtcccttgtaggaaccaggatgagctcattgggcgagcccgtatctctcagggagctggctggagcctgaaggaaacggcctgcttgggtaaatcctatgcacagatgtggacattaatgtacttccacagacgcgacctgcggctcgctgccaatgcaatttgttcagccgtgccaagtcattgggtgccgacctctaggactacatggagcatccacgcgaagcacgagtggatgaccactgaggatatgcttgctgtctggaacagagtttggatacaagaaaacccctggatggaggacaagacccctgtggaatcctgggaggaaatcccatatctggggaaacgcgaggaccagtggtgcggatcactaattggcctgacaagccgggccacgtgggcaaagaatatccagaccgccattaaccaggtaaggtctctcatcggcaatgaggaatacactgattatatgccctccatgaaacgatttagacgggaggaagaggaagctggggtgttgtggtga

SEQ ID NO: 14656 - RNA, 9876 nt, synthetic construct
  misc_feature 1..9876: note = derived and/or modified CDS sequence (opt3) from DENV-2__EU482587__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggtagaacttactggctatggtaccgtgacaatggagtgtagtcccaggaccgggctggatttcaacgaaatggtcttgctccagatggaggacaaagcctggctggtgcaccggcaatggtttttagatctgcctctcccatggcttcccggcgcagacactcagggaagcaattggatacagaaggagacactggttacgttcaagaaccctcatgctaaaaagcaggacgtggtcgtgttgggctctcaagaaggggccatgcacaccgcgctaactggagccacagagattcagatgtcctcaggtaatctgctctttaccggccatctgaaatgccgtcttcgcatggataagctgcagttgaaagggatgagctacagtatgtgtacaggaaagttcaagatcgtaaaagaaatcgcagagactcaacacggcaccattgttatcagagtgcagtatgagggtgacgggtctccatgcaagattcccttcgaaataatggatctcgagaaaaggcatgtcctgggccggttaatcacggtgaacccgattgtcaccgaaaaggactcccctgtgaacatcgaggctgaacccccatttggagatagctacatcattataggcgttgagcctgggcagctgaaactaaattggttcaagaagggatcgtctatcggtcagatgtttgagacaactatgcgaggcgccaaacgcatggctattctcggggacaccgcctgggatttcggatccctgggcggtgtgtttacatcaatcgggaaggcacttcaccaagtattcggcgccatttacggagctgcgtttagtggcgtcagctggactatgaaaatcttgataggggtgatcattacctggatcggaatgaactccagatctacgagcctgtcagttagtctcgtgctggtcggcgtggtaacactttatctgggtgcaatggtgcaggccgactccgggtgtgttgtcagctggaagtctagggaattgaaatgcggatcaggcattttcatcaccgataatgtgcacacttggacagagcagtacaagtttcagcccgaaagtccaagcaagctcgcttccgccatacaaaaagcacatgaggaaggtatttgtggcatccggtctgtgacccgcctggagaacttaatgtggaagcagattactcccgagctgaatcacatcctatcggaaaacgaggtcaaactcaccataatgacaggggacatcaagggaattatgcaggccggcaaaagaagcctgaggcctcagccaacggaacttaagtattcctggaaaacctgggggaaggctaagatgttgtcaactgagagtcataatcgtacattcctgatcgatggaccggaaaccgccgagtgccccaacacaaatcgggcatggaactctctcgaggttgaagactacggctttggtgtgttcactaccaatatttggctgaaattacgagagaagcaagacgtgttttgtgatagcaaactgatgtccgcggctatcaaggacaacagagccgtacacgcagatatggggtattggatagaatcagcccttaatgacacgtggaaaatggagaaggctagcttcattgaggtcaagtcttgccactggcctaaatcccatacattgtggagtaacggagtgctcgaaagcgagatgatcatcccaaagaatttcgccggccccgtttctcagcacaactacaggcctggttatcatacccagactgcaggcccatggcacctggggaaactagaaatggattttgacttctgtgagggaaccacagtggtcgtgactgaagattgcggcaaccgcgggccctccctgcggaccacaacggcttcaggaaagctcattaccgagtggtgctgtagaagttgcactctgccgcctcttaggtaccgcggcgaggacggttgttggtacgggatggaaatccgaccattgaaagagaaggaagagaatctggttaacagcttagtgacagccggacatggccagattgataatttttcgctcggtgtactgggcatggcgcttttcctggaagagatgttgcggacccgtgtcgggactaagcacgccatactcctggtggctgtgtcctttgtcacactaatcaccggaaacatgtctttcagagacctgggcagggttatggtgatggtaggggcaacgatgactgatgacattggaatgggcgtgacctatctcgccctgcttgctgcctttaaagtccgccccacattcgcagcgggtttgctgttacggaagctcaccagcaaagagctgatgatggccactatcgggattgctcttctgtcacaaagtacaatccctgaaaccatactagagctcacagatgccctggcattgggaatgatggtgctgaagatcgttagaaatatggaaaaataccagttagctgtgactattatggccatctcctgcgtccccaacgcagtgattctccagaatgcctggaaggtttcttgtaccatcctggctgcggtgagcgtctccccacttctgttgacgtcaagccaacagaaggccgactggatacctctcgcactgacaattaaaggcctaaaccccaccgctatctttctgactacccttagtaggacatctaagaaacgatcctggccactcaatgaggccatcatggccgtaggcatggtgagcattctggcttcgtcattgctgaagaacgacataccgatgactgggcctttagttgcaggaggtctcctgaccgtgtgctatgtccttacgggccgctctgccgatctggaattggagcgggcggctgacgtgaaatgggaggatcaggccgaaatcagtgggtccagccccattctctctatcacaattagcgaggacggatccatgtcaatcaagaatgaagaggaggaacagaccctgactatactaatcagaacaggcctgcttgtaattagtggtgtgttcccagtcagcatccccattaccgcagccgcttggtacctctgggaggttaaaaagcaaagggcaggggtgctgtgggatgtgccttctccaccccctgtcggaaaggccgaattggaggacggcgcgtatcgtatcaaacagcgcggcatattagggtactcccagattggagctggtgtgtataaggaaggcacttttcacacaatgtggcatgttacccggggggccgtactgatgcacagaggaaaaaggatcgagccgtcatgggcagatgtgaagaaagacctcatcagttacggcggtgggtggaagctggagggagaatggaaggagggcgaagaggtccaggtgcttgccctggaaccaggcaaaaacccccgagctgttcaaacgaagcctgggttgttcaaaactaataccggaacaattggtgccgtgagcctagatttttccccaggcacctctgggtcgcccatcgtcgaccggaagggaaaagtggtaggcctgtacggtaacggggtcgtgacacgcagcggagcatatgtttcagctatagcccagactgagaagtccattgaggataatcctgaaatcgaggacgatattttcagaaagaaaaggctcaccatcatggacctgcatccgggcgcgggcaagacgaaacggtaccttcccgccatagtgcgagaagcaattaagagagggttacgcacactgatcctcgctccaactagggtcgtggccgctgagatggaagaggcattgcgtggactgcctatccggtatcagacccccgccattagagccgagcacacaggtagggaaatcgttgacctcatgtgtcatgctaccttcactatgcgcctgcttagtccagtgcgagtccctaactacaacctgattataatggatgaggcgcactttaccgaccccgcatctatcgccgctagaggctatattagcacacgggtggaaatgggggaggccgcaggaatcttcatgacggccactccaccgggctccagggatccttttccccagtcaaatgctccaatcatggacgaggaacgcgagattcccgaacgttcttggaacagcggtcacgagtgggtaaccgatttcaaagggaagacagtgtggtttgttcctagtataaaggcgggaaatgacatcgccgcatgcttgagaaaaaacggcaagaaagtcattcaactatcccggaagaccttcgatagcgaatacgtgaaaactagggctaatgactgggattttgtggtcacaaccgacatctctgagatgggcgccaacttcaaggcagagcgcgtaattgatccacgaagatgtatgaagcccgtgatcctgacggacggggaagagcgggttatactcgccggacctatgccggtgactcattcatccgctgcccagaggcgcggtagaatcggcaggaatccaaaaaacgaaaatgaccagtatatttacatgggggagcccttagaaaacgatgaggactgcgcgcactggaaggaggcaaaaatgctgcttgataatatcaacacacctgaaggaattatccccagtatgtttgagccagaacgggagaaggtcgacgccatagatggcgaataccgtctgcgcggtgaggctcgaaaaaccttcgtggacctcatgagaaggggggatttgcctgtttggctggcctatcgggtggctgcagagggcattaattacgccgaccgcagatggtgttttgatggaatcaagaacaatcaaattctcgaagagaacgtcgaagtggagatctggaccaaagagggcgaaaggaagaagctgaaaccccggtggcttgacgctcgaatatatagcgatccactagccctgaaggagttcaaagaattcgcagcggggagaaagtcgttgactttaaacctgatcacagagatgggacgcctccctacctttatgacacagaaagccagggacgctctggataatcttgccgtactgcatactgcagaagctggtggccgggcctacaaccacgcactctctgagttgccggagacgctggaaaccctactgctccttacactgttagccactgtgaccgggggaattttcttgtttctgatgtccggcaagggtatcgggaagatgacactcggcatgtgctgcattatcaccgctagcatactgctttggtatgcgcagattcagccccactggatcgccgcatcaatcattctggagttctttctcatcgttttgctgataccagaacctgagaaacaacgtactccccaggacaatcagttaacgtacgtcgtgattgctatcctaaccgtggtcgccgccacaatggcaaacgaaatgggattcctggagaagactaaaaaggacctcggccttgggagtattaccacacaggagtctgaatccaatatcctggatatagacttgagaccagctagcgcctggaccctgtatgcggttgctactacatttgtgacgcctatgctcaggcattcaatcgagaacagtagcgtaaatgtgtccctgaccgccattgcaaaccaagccactgtccttatgggactcggtaaaggctggcccctgtctaagatggatatcggggtgccgttgctggctattggatgttacagccaggttaatccaatcacattaaccgcagccctactgctccttgtggcgcactacgctattatcggccctggtctgcaggccaaggcaacccgcgaagcccagaaacgggctgccgcagggataatgaagaaccccacagtcgacggcattactgtaatcgatttggagccaatcccctatgaccctaaattcgaaaagcaactgggacaggtgatgctcctgattctttgcgttacgcaggtgttaatgatgcgaaccacatgggctctgtgtgaggccctcactttggcgaccggcccgatatccacactgtgggaggggaatcccggaagattttggaacaccactatcgccgtctcaatggcaaatattttcaggggctcttacctagctggtgccgggctgctctttagtatcatgaaaaacacgacaaatacccgccggggaactggcaacattggtgaaacccttggcgagaagtggaagtcgagactgaatgcattggggaaaagcgaattccagatctataagaaatccggaatacaagaggtggatcgtacactggctaaggagggcatcaaaaggggggaaactgaccatcacgccgtctctcggggatcagccaagctccgctggtttgtggagcgaaacatggttaccccagaaggcaaagtggtagatctgggttgcgggagaggaggctggagctactattgtggtggcttaaagaacgtgagggaggtcaaggggcttacaaaaggaggccctgggcatgaagagcccattcctatgtccacgtacggatggaatctggttcggctccagagtggcgtggacgtcttcttcaccccacccgagaagtgcgatactctactgtgtgacatcggtgaatctagccctaacccaacaattgaggcggggcgcaccttgagagtgctgaatctcgtagaaaactggcttaataacaatactcagttttgcatcaaagtgctgaacccctatatgccgtcagttatagagaagatggaaacattgcaaaggaaatacggaggcgctctggtgcgaaatcctctctcccggaacagtacccacgagatgtactgggtcagcaatgcaacgggcaacattgtgtcttccgtcaatatgatctcacgtatgttaatcaacagattcaccatgaagcacaagaaagccacatatgagccagatgtggacctggggagcggaactcgcaatattggtatagaatcggagatccccaaccttgacattatcggcaagaggattgaaaaaatcaagcaggagcatgaaacctcttggcactacgatcaggaccatccttataaaacatgggcttaccacgggagttatgagactaagcagaccggatccgccagctcaatggttaacggcgtagtgcggctgctaacaaagccatgggatgtcgtgcccatggttacccaaatggcaatgactgacacgacaccgtttggtcagcagagagtgttcaaagagaaggtcgatacccgcactcaggaacctaaagaggggaccaagaaactcatgaagataacagccgaatggctgtggaaggagttgggaaaaaagaaaacgcccaggatgtgtacccgagaggaatttactcggaaggtgagatccaatgctgcgctgggcgccatcttcacagacgagaacaaatggaagtctgcaagggaagctgtagaggatagccgcttttgggaactcattgaccgtgagcggaatcttcacctggagggcaaatgcgaaacctgtgtgtacaacatgatggggaagagagagaagaaattaggagaattcggtaaggccaaaggcagtagggcaatctggtatatgtggctgggggcccgctttttggagttcgaagctctcggatttctgaatgaggatcattggttctcccgaggcaacagcctatctggtgttgagggggaaggacttcaccggctgggctacattctcagagacgtctcaaagaaagagggcggggccatgtacgcggatgacactgcaggatgggacacaaggatcaccctggaagatttgaagaatgaggaaatggtgacaaaccatatgaagggtgagcacaaaaagctggccgaggctatttttaaactcacttatcaaaataaggtggtccgcgttcagagaccaacccctcggggcacggtgatggacataatcagtaggcgtgatcagcgagggtccggacaggtaggcacctacggtcttaacacattcactaatatggaagcccaactgattcgccagatggagggggaaggaatcttcaaaagcatccagcatttaaccgtgacagaggagattgcagtccaaaactggctggctagagtgggccgggaaaggttgtctcgcatggccatatcgggcgacgattgcgttgtgaagcccctcgacgatagatttgcttcagccctgactgcactaaatgacatggggaaggtccggaaagatatccagcagtgggagccaagcaggggatggaacgactggacccaggtgcccttctgctcccaccactttcatgaaattgtaatgaaggatggtcgagttcttgtggtcccttgtcgtaatcaagacgagctgatcggcagagcgcgcattagtcagggggccggatggtctctcaaagaaacggcttgcctgggcaagagctatgcccagatgtggacattgatgtacttccaccggagggatttaagactggcagctaacgccatctgttccgcagtgccatcacattgggtgccgaccagtcgcactacatggtctatacacgccaaacacgagtggatgaccactgaggacatgctcgcggtctggaaccgggtttggatccaggaaaatccctggatggaggacaagacccctgtggaaagctgggaggaagtaccatatcttggtaagagggaggatcaatggtgcgggtccctgattggactaacatcacgagctacgtgggccaaaaacatccagaccgcaattaatcaggtgagaagcctgatcggcaacgaggaatacactgactatatgccctctatgaagcggtttaggcgcgaggaagaggaagccggcgtcctctggtga

SEQ ID NO: 14657 - RNA, 9876 nt, synthetic construct
  misc_feature 1..9876: note = derived and/or modified CDS sequence (opt3) from DENV-2__EU482588__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaaggtgcccttcgaaattatggatctcgagaaaaggcatgtcctgggccggttaataacggtgaacccgatcgtcaccgaaaaggactcccctgtgaacattgaggccgaacccccatttggagatagctacatcatcattggcgttgagcctgggcagctgaaactaaattggttcaagaagggatcgtctataggtcagatgtttgagacaactatgcgaggcgctaaacgcatggccatcctcggggacaccgcatgggatttcggatccctgggcggtgtgtttacatcaattgggaaggcccttcaccaagtattcggcgctatctacggagcggcatttagtggcgtcagctggactatgaaaattttgatcggggtgataatcacctggattggaatgaactccagatctacgagcctgtcagttagtctcgtgctggtcggcgtggtaacactttatctgggtgccatggtgcaggctgactccgggtgtgttgtcagctggaagtctaaagaattgaagtgcggatcaggcatcttcgtgaccgataatgtgcacacttggacagagcagtacaagtttcagcccgaaagtccaagcaaactcgcctccgcaattcaaaaggcccatgaggaaggtatctgtggcataaggtctgtcacccggctggagaacttaatgtggaaacagattactcccgagctgaatcacatcctatcggaaaacgaggttaagctcaccattatgacaggggacatcaaaggaataatgcaggctggcaagcgcagcctgagacctcagccaacggaacttaaatattcctggaagacctgggggaaggccaaaatgttgtcaactgagagtcataatcaaacattcctgatcgatggaccggaaaccgcagagtgccccaacacaaatagggcgtggaactctctcgaggtggaagactacggctttggtgtgttcactaccaatatttggctgaagttacgtgagaaacaggacgtattttgtgatagcaagctgatgtccgctgccatcaaagacaaccgggcagtccacgccgatatggggtattggattgaatcagctcttaatgacacgtggaagatggagaaggccagcttcatcgaggtgaaatcttgccactggcctaagtcccatacattgtggagtaacggagttctcgaaagcgagatgataattccaaaaaatttcgcaggccccgtgtctcagcacaactaccgacctggttatcatacccagactgctggcccatggcacctggggaagctagaaatggattttgacttctgtgagggaaccacagtcgtggttactgaagattgcggcaacagagggccctccctgaggaccacaacggcctcaggaaaactcatcaccgagtggtgctgtcgcagttgcactctgccgcctcttcggtacagaggcgaggacggttgttggtacgggatggaaatcaggccattgaaggagaaggaagagaatctggtgaacagcttagtaacagcgggacatggccaaattgataatttttcgctcggtgtcctgggcatggcccttttcctggaagagatgttgcgcacccgagtggggactaaacacgctatcctcctggtggcagtctcctttgttacactaattaccggaaacatgtctttccgggacctgggccgtgtgatggtaatggtgggggccacgatgactgatgacataggaatgggcgtcacctatctcgctctgcttgccgcatttaaggtgagacccacattcgcggccggtttgctgttaaggaaactcaccagcaaggagctgatgatggctactatcgggattgcccttctgtcacagagtacaatccctgaaaccattctagagctcacagatgcactggctttgggaatgatggttctgaaaatcgtgcgcaatatggaaaagtaccagttagccgtcactataatggcaatctcctgcgtgcccaacgccgttattctccaaaatgcttggaaggtgtcttgtaccatcctggcggccgtcagcgtatccccacttctgttgacgtcaagccagcagaaagcagactggattcctctcgctctgacaatcaagggcctaaaccccaccgccatatttctgactacccttagtcggacatctaaaaagagatcctggccactcaatgaggccattatggctgtgggcatggttagcatcctggcatcgtcattgctgaaaaacgacatcccgatgactgggcctttagtggccggaggtctcctgaccgtctgctatgtgcttacgggcaggtctgcggatctggaattggagcgagctgccgacgtaaagtgggaggatcaggcagaaattagtgggtccagccccatactctctatcacaattagcgaggacggatccatgtcaatcaaaaatgaagaggaggaacaaaccctgactattctaatccgcacaggcctgcttgtgataagtggtgtcttcccagttagcatccccattaccgccgctgcatggtacctctgggaggtgaagaagcagcgggccggggtgctgtgggatgtcccttctccaccccctgtgggaaaagcggaattggaggacggcgcttatagaatcaagcagaggggcattttagggtactcccagatcggagccggtgtttataaagaaggcacttttcacacaatgtggcatgtaacccgtggggcagtgctgatgcaccgcggaaagcggatagagccgtcatgggccgatgtcaaaaaggacctcattagttacggcggtgggtggaagctggagggagaatggaaagagggcgaagaggtgcaagttcttgctctggaaccaggcaagaaccccagagccgtgcagacgaaacctgggttgttcaagactaataccggaacaatcggtgcagtcagcctagatttttccccaggcacctctgggtcgcccatcgtggacaggaaaggaaaggtagtcggcctgtacggtaacggggtggttacacgaagcggagcttatgtgtcagccattgcgcagactgagaagtccatcgaggataatcctgaaatagaggacgatattttccggaaaaagcgcctcaccatcatggacctgcatccgggcgccggcaaaacgaagagataccttcccgcaattgtcagggaagctatcaaacgggggttacgaacactgatactcgccccaactagagtggttgctgcagagatggaagaggccttgcgcggactgcctattaggtatcagacccccgccatccgtgctgagcacacaggtcgggaaatcgtggacctcatgtgtcatgcgaccttcactatgagactgcttagtccagtcagggtgcctaactacaacctgattatcatggatgaggcacactttaccgaccccgcctctattgctgcccgcggctatataagcacacgagtagaaatgggggaggcagccggaatcttcatgacggctactccaccgggctccagagatccttttccccaatcaaatgcgccaattatggacgaggaacgggagatccccgaaaggtcttggaacagcggtcacgagtgggtgaccgatttcaaggggaagacagtttggtttgtccctagtatcaaagccggaaatgacattgcagcttgcttgcgcaagaacggcaaaaaggtgatacagctatcccgtaaaaccttcgatagcgaatacgtgaagactagagccaatgactgggattttgtcgtaacaaccgacatctctgagatgggcgcaaacttcaaggccgagcgggtgattgatccaaggcgctgtatgaaacccgttatcctgacggacggggaagagcgagtgattctcgctggacctatgccggtcactcattcatccgccgcgcagagacggggtaggatcggccgcaatccaaagaacgaaaatgaccaatatatatacatgggggagcccttagaaaacgatgaggactgcgcacactggaaagaggccaagatgctgcttgataatatcaacacacctgaaggaattatccccagtatgtttgagccagaaagagagaaagtggacgctattgatggcgaatacaggctgcggggtgaggcccgtaagaccttcgttgacctcatgcgccgaggggatttgcctgtgtggctggcttatagagtcgcagccgagggcatcaattacgctgacaggcggtggtgttttgatggaataaaaaacaatcagattctcgaagagaacgtggaagtagagatctggaccaaggagggcgaacgcaagaaactgaagcccagatggcttgacgccaggatttatagcgatccactagcactgaaagagttcaaggaattcgcggccgggcggaaatcgttgactttaaacctgatcacagagatgggacgactccctacctttatgacacagaaggctagagacgccctggataatcttgcagtgctgcatactgctgaagccggtggccgcgcatacaaccacgccctctctgagttgccggagacgctggaaaccctactgctccttacactgttagctactgttaccgggggaatattcttgtttctgatgtccggcaagggtatcgggaaaatgacactcggcatgtgctgcattatcaccgcgagcattctgctttggtatgcccagatccaaccccactggatagcagcttcaattatcctggagttctttctcatcgtcttgctgattccagaacctgagaagcagaggactccccaggacaatcagttaacgtacgtggtgatcgccatactaaccgtcgttgccgcaacaatggctaacgaaatgggattcctggagaaaactaagaaagacctcggccttgggagtattaccacacaagagtctgaatccaatatcctggatattgacttgcggccagccagcgcgtggaccctgtatgctgtggccactacatttgtaacgcctatgctccgtcattcaatcgagaacagtagcgtgaatgtctccctgaccgcaatagccaaccaggctactgtgcttatgggactcggtaagggctggcccctgtctaagatggatatcggggttccgttgctggcaattggatgttacagccaggtgaatccaatcacattaaccgccgcgctactgctccttgtcgctcactacgccattatcggccctggtctgcaggcaaaagccaccagagaagctcaaaagagggccgcagctgggattatgaaaaaccccacagtagacggcatcactgtgatagatttggagccaattccctatgaccctaagttcgaaaaacagctgggacaggttatgctcctgatcctttgcgtgacgcaggtcttaatgatgcgcaccacatgggccctgtgtgaggcgctcactttggccaccggcccgatctccacactgtgggaggggaatcccggacggttttggaacaccactattgcagtgtcaatggctaatatattccgaggctcttacctagccggtgcagggctgctctttagtatcatgaagaacacgacaaataccagaaggggaactggcaacattggtgaaacccttggcgagaagtggaaatcgcgcctgaatgctttggggaagagcgaattccaaatctataaaaagtccggaattcaggaggtcgatcggacactggccaaagagggcatcaagagaggggaaactgaccatcacgccgtgtctcgtggatcagcgaaactcaggtggtttgttgagcggaacatggtgaccccagaaggcaaggtagtggatctgggttgcgggcgcggaggctggagctactattgtggtggcttaaagaacgtccgagaggttaaagggcttacaaagggaggccctgggcatgaagagcccatacctatgtccacgtacggatggaatctggtgagactccagagtggcgtcgacgtgttcttcaccccacccgagaaatgcgatactctactgtgtgacatcggtgaatctagccctaacccaacaattgaggctgggaggaccttgcgggtactgaatctcgtggaaaactggcttaataacaatactcaattttgcatcaaggttctgaacccctatatgccgtcagtgattgagaaaatggaaacattgcagcgcaagtacggaggcgcactggtcagaaatcctctctccaggaacagtacccacgagatgtactgggtgagcaatgccacgggcaacatcgtctcttccgtgaatatgatatcacgaatgttaattaaccggttcaccatgaagcacaaaaaggctacatatgagccagatgttgacctggggagcggaactcgtaatatcggtatcgaatcggagattcccaaccttgacataatcggcaaaagaattgaaaagatcaaacaggagcatgaaacctcttggcactacgatcaggaccatccttataagacatgggcctaccacgggagttatgagactaagcaaaccggatccgcaagctcaatggtaaacggcgtggtccgcctgctaacaaaaccatgggatgtggttcccatggtgacccagatggccatgactgacacgacaccgtttggtcagcagagggtcttcaaggagaaagtggatacccggactcaagaacctaaggaggggaccaaaaagctcatgaagattacagctgaatggctgtggaaagagttgggaaagaaaaagacgcccagaatgtgtacccgcgaggaatttactaggaaagtacgatccaatgcggccctgggcgcaatcttcacagacgagaacaagtggaaatctgctcgggaagccgtggaggatagcagattttgggaactcatagacagggagcgcaatcttcacctggagggcaagtgcgaaacctgtgtttacaacatgatggggaagcgtgagaaaaagttaggagaattcggtaaagcaaagggcagtcgggccatctggtatatgtggctgggggctagatttttggagttcgaagccctcggatttctgaatgaggatcattggttctccaggggcaacagcctatctggtgtcgagggggaaggacttcaccgcctgggctacattctccgagacgtgtcaaaaaaggagggcggggcgatgtacgcagatgacactgccggatgggacacacggatcaccctggaagatttgaagaatgaggaaatggtgacaaaccatatgaaaggtgagcacaagaaactggctgaggccatttttaagctcacttatcagaataaagtcgttagagtgcagaggccaacccctcgcggcacggtaatggacatcattagtagacgggatcagagggggtccggacaagtgggcacctacggtcttaacacattcactaatatggaagcacagctgatacgtcagatggagggggaaggaatcttcaagagcattcaacatttaaccgtcacagaggagatcgctgtgcagaactggctggcccgagttggccgcgaaagattgtctcggatggctatctcgggcgacgattgcgtggtcaagcccctcgacgataggtttgcctcagcactgactgcgctaaatgacatggggaaagtgcgcaaggatattcagcagtgggagccaagcagaggatggaacgactggacccaagtacccttctgctcccaccactttcatgaacttgttatgaaagatggtcgggtgctggtcgtgccttgtaggaatcaggacgagctcataggccgagcccgtatcagtcagggggctggatggtctctgaaggaaacggcctgcttgggcaaaagctatgcacagatgtggacattaatgtacttccacagacgcgatctgcggctcgctgccaacgcaatttgttccgccgtgccatcacattgggtcccgaccagtaggactacatggtctatccacgcgaagcacgagtggatgaccactgaggacatgcttgctgtttggaacagagtgtggattcaagaaaatccctggatggaggacaagacccctgtagaaagctgggaggaagtgccatatctgggtaaacgcgaggatcagtggtgcgggtccctaatcggactgacatcacgggccacgtgggcaaagaacatacagaccgccatcaatcaggtcaggagcctcattggcaacgaggaatacactgactatatgccctctatgaaacgatttagacgggaggaagaggaagctggcgtgttgtggtga

SEQ ID NO: 14658 - RNA, 9876 nt, synthetic construct
  misc_feature 1..9876: note = derived and/or modified CDS sequence (opt3) from DENV-2__EU569705__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtggccgaaaaggactcccctgtcaacatcgaggctgaacccccatttggagatagctacatcattataggcgtggagcctgggcagctgaaactaaattggttcaagaagggatcgtctatcggtcagatgtttgagaccacaatgcgaggcgccaaacgcatggcaattctcggggacactgcctgggatttcggatccctgggcggtgtttttacctcaatcgggaaggctcttcaccaagtgttcggcgcgatttacggagcagcctttagtggcgtaagctggacaatgaaaatcttgataggggtcatcattacttggatcggaatgaactccagatctaccagcctgtcagtgagtctcgttctggtgggcgtcgtgacgctttatctgggtgctatggtacaggccgactccgggtgtgtggttagctggaagtctaaagaattgaagtgcggatcaggcattttcatcacagataatgtccacacctggactgagcagtacaagtttcagcccgaaagtccaagcaaactcgcatccgccatacaaaaggctcatgaggaaggtatttgtggcatcaggtctgtgacacggctggagaacttaatgtggaaacagattacccccgagctgaatcacatcctatcggaaaacgaggtgaagctcactataatgaccggggacatcaaaggaattatgcaggccggcaagcgcagcctgagacctcagccaacagaacttaaatattcctggaagacgtgggggaaggcaaaaatgttgtcaaccgagagtcataatcaaactttcctgatcgatggaccggaaacagcggagtgccccaacaccaatagggcttggaactctctcgaggtcgaagactacggctttggtgttttcacaactaatatttggctgaagttacgtgagaaacaggacgtgttttgtgatagcaagctgatgtccgccgcaatcaaagacaaccgggccgtgcacgctgatatggggtattggatagaatcagcccttaatgacacctggaagatggagaaggcaagcttcattgaggtaaaatcttgccactggcctaagtcccatacgttgtggagtaacggagtcctcgaaagcgagatgatcatcccaaaaaatttcgctggccccgtgtctcagcacaactaccgacctggttatcatacacagaccgccggcccatggcacctggggaagctagaaatggattttgacttctgtgagggaactaccgttgtggtcacagaagattgcggcaacagagggccctccctgaggactaccacagcgtcaggaaaactcattacggagtggtgctgtcgcagttgcaccctgccgcctcttcggtacagaggcgaggacggttgttggtacgggatggaaatcaggccattgaaggagaaggaagagaatctggtgaacagcttagttactgccggacatggccaaattgataatttttcgctcggtgtgctgggcatggctcttttcctggaagagatgttgcgcacacgagtagggaccaaacacgcaatgctcctggtcgccgtgtcctttgtgactctaataacaggaaacatgtctttccgggacctgggccgtgtcatggttatggtgggggctaccatgacggatgacatcggaatgggcattacttatctcgccctgcttgcagcgtttaaggtaagacccaccttcgccgctggtttgctgttaaggaaactcacaagcaaggagctgatgatggccaccatcgggattgcacttctgtcacagagtactatccctgaaacaatactagagctcaccgatgctctggccttgggaatgatggtgctgaaaatcgtccgcaatatggaaaagtaccagttagcagtgacaattatggccatctcctgcgttcccaacgctgtgattctccaaaatgcgtggaaggtctcttgtactatcctggccgcagtgagcgtttccccacttctgttgacctcaagccagcagaaagctgactggatacctctcgccctgacgattaagggcctaaaccccacagccatctttctgaccactcttagtcggacctctaaaaagagatcctggccactcaatgaggctatcatggcagtgggcatggtcagcattctggcctcgtcattgctgaaaaacgacataccgatgacagggcctttagtagcgggaggtctcctgactgtgtgctatgttcttaccggcaggtctgctgatctggaattggagcgagccgcagacgtgaagtgggaggatcaggccgaaatcagtgggtccagccccattctctctatcacgattagcgaggacggatccatgtcaatcaaaaatgaagaggaggaacaaacactgaccatactaatccgcactggcctgcttgtcattagtggtgtgttcccagtaagcatccccattacagctgcagcctggtacctctgggaggtgaagaagcagcgggcgggggtcctgtgggatgttccttctccaccccctgtgggaaaagctgaattggaggacggcgcctatagaatcaagcagaggggcatattagggtactcccagattggagcaggtgtgtataaagaaggcacctttcacactatgtggcatgtcacacgtggggccgtgctgatgcaccgcggaaagcggatcgagccgtcatgggctgatgttaaaaaggacctcatcagttacggcggtgggtggaagctggagggagaatggaaagagggcgaagaggtacaagtgcttgccctggaaccaggcaagaaccccagagcagtccagaccaaacctgggttgttcaagacgaatactggaaccattggtgctgtgagcctagatttttccccaggcacatctgggtcgcccatcgttgacaggaaaggaaaggtggtcggcctgtacggtaacggggtggtaacccgaagcggagcctatgtctcagcgatagcccagacagagaagtccattgaggataatcctgaaatcgaggacgatattttccggaaaaagcgcctcactatcatggacctgcatccgggcgcaggcaaaaccaagagataccttcccgctatagtgagggaagccattaaacgggggttacgaacgctgatcctcgctccaacaagagttgtggcagccgagatggaagaggccttgcgcggactgcctatcaggtatcagactcccgctattcgtgcggagcacaccggtcgggaaatcgtcgacctcatgtgtcatgcaacattcaccatgagactgcttagtccagtgagggttcctaactacaacctgattataatggatgaggcccactttactgaccccgcttctatcgccgcacgcggctatattagcacccgagtggaaatgggggaggccgctggaatcttcatgacagcgacgccaccgggctccagagatccttttccccaatcaaatgccccaatcatggacgaggaacgggagattcccgaaaggtcttggaacagcggtcacgagtgggtcactgatttcaaggggaagaccgtgtggtttgtacctagtataaaagcaggaaatgacatcgctgcctgcttgcgcaagaacggcaaaaaggtgattcagctatcccgtaaaacattcgatagcgaatacgttaagaccagagcaaatgactgggattttgtcgtgactacagacatctctgagatgggcgccaacttcaaggctgagcgggtgattgatccaaggcgctgtatgaaacccgtcatcctgaccgacggggaagagcgagtaatactcgccggacctatgccggtgacgcattcatccgcggcacagagacggggtaggatcggccgcaatccaaagaacgaaaatgaccaatatatttacatgggggagcccttagaaaacgatgaggactgcgcccactggaaagaggctaagatgctgcttgataatatcaacactcctgaaggaattatccccagtatgtttgagccagaaagagagaaagttgacgccatagatggcgaatacaggctgcggggtgaggctcgtaagacattcgtggacctcatgcgccgaggggatttgcctgtctggctggcatatagagtggccgctgagggcattaattacgccgacaggcggtggtgttttgatggaatcaaaaacaatcagattctcgaagagaacgttgaagtggagatctggaccaaggagggcgaacgcaagaaactgaagcccagatggcttgacgcaaggatatatagcgatccactagcgctgaaagagttcaaggaattcgccgctgggcggaaatcgttgaccttaaacctgatcactgagatgggacgactccctacatttatgacccagaaggccagagacgcactggataatcttgctgtcctgcatacagccgaagcaggtggccgcgcctacaaccacgctctctctgagttgccggagactctggaaacgctactgctccttaccctgttagcgacagtgactgggggaattttcttgtttctgatgtccggcaagggtatcgggaaaatgaccctcggcatgtgctgcattatcacagccagcatactgctttggtatgcacagattcaaccccactggatcgctgcctcaatcattctggagttctttctcatcgtattgctgataccagaacctgagaagcagaggaccccccaggacaatcagttaacttacgtggttattgccatcctaacggtcgtggcagctaccatggccaacgaaatgggattcctggagaaaacaaagaaagacctcggccttgggagtattgcgactcaagagtctgaatccaatatcctggatatagacttgcggccagctagcgcctggaccctgtatgcagtggccacaacctttgtcactcctatgctccgtcattcaatcgagaacagtagcgttaatgtgtccctgacagctattgcaaaccaggccacggtacttatgggactcggtaagggctggcccctgtctaagatggatatcggggtgccgttgctggcgattggatgttacagccaggtcaatccaatcaccttaactgctgccctactgctccttgtggcacactacgccattatcggccctggtctgcaggctaaagccacaagagaagcacaaaagagggctgccgcggggataatgaaaaaccccaccgttgacggcattaccgtgatcgatttggagccaatcccctatgaccctaagttcgaaaaacagctgggacaggtcatgctcctgattctttgcgtaacacaggtgttaatgatgcgcactacgtgggccctgtgtgaggcactcaccttggctacaggcccgatatccactctgtgggaggggaatcccggacggttttggaacaccacaatcgccgtttcaatggcaaatattttccgaggctcttacctagctggtgccgggctgctctttagtatcatgaagaacaccactaatacgagaaggggaacaggcaacattggtgaaacccttggcgagaagtggaaatcgcgcctgaatgccttggggaagagcgaattccaaatctataaaaagtccggaatacaggaggtggatcggactctggcgaaagagggcatcaagagaggggaaaccgaccatcacgctgtctctcgtggatcagcaaaactcaggtggtttgtggagcggaacatggtcacaccagaaggcaaggtggttgatctgggttgcgggcgcggaggctggagctactattgtggtggcttaaagaacgtgcgagaggtaaaagggcttactaagggaggccctgggcatgaagagcccattcctatgtccacctacggatggaatctggtgagactccagagtggcgtcgacgttttcttcacaccacccgagaaatgcgatacgctactgtgtgacatcggtgaatctagccctaacccaaccattgaggccgggaggactttgcgggtgctgaatctcgtcgaaaactggcttaataacaatacacaattttgcatcaaggtgctgaacccctatatgccgtcagtaatagagaaaatggaaaccttgcagcgcaagtacggaggcgctctggtgagaaatcctctctccaggaacagtactcacgagatgtactgggttagcaatgccacaggcaacattgtgtcttccgtcaatatgatctcacgaatgttaatcaaccggttcaccatgaagcacaaaaaggcaacgtatgagccagatgtggacctggggagcggaacccgtaatattgtcatagaatcggagatccccaaccttgacattatcggtaaaagaattgaaaagatcaaacaggagcatgaaacatcttggcactacgatcaggaccatccttataagacttgggcctaccacggcagttatgagaccaagcaaacagggtccgctagctcaatggtgaacggagttgtacgcctgctaactaaaccatgggatgtggtccccatggtgacccagatggcgatgacagacaccactccgtttggccagcagagggttttcaaggagaaagtggatacgcggacacaagaacctaaggagggtaccaaaaagctcatgaagataactgccgaatggctgtggaaagagttggggaagaaaaagacccccagaatgtgtacacgcgaggaatttacgaggaaagtccgatccaatgcagctctgggagccatcttcaccgacgagaacaagtggaaatctgcacgggaagccgtggaggatagcagattttgggaactcattgacagggagcgcaatcttcacctggagggcaagtgcgaaacttgtgtatacaacatgatgggcaagcgtgagaaaaagttaggggaattcggaaaagctaagggtagtcgggccatctggtatatgtggctgggcgcgagatttttggagttcgaagcactcgggtttctgaatgaggatcattggttctccaggggaaacagcctatctggcgtggagggtgaagggcttcaccgcctgggatacattctccgagacgtttcaaaaaaggagggcggcgccatgtacgctgatgacacagccgggtgggacacccggatcactctggaagatttgaagaatgaggaaatggtcacaaaccatatgaaaggagagcacaagaaactggcagaggctatttttaagctcacctatcagaataaagtggtgagagtccagaggccaacacctcgcggtactgttatggacataatcagtagacgggatcagaggggctccgggcaagtgggaacctacggccttaacacgttcaccaatatggaagcccagctgattcgtcagatggagggtgaagggatcttcaagagcatccaacatttaacagtaactgaggagattgctgtgcagaactggctggcccgagtcggacgcgaaagattgtctcggatggcaatatcgggcgacgattgcgtggttaagcccctcgacgataggtttgcgtcagccctgaccgctctaaatgacatgggcaaagtgcgcaaggatatccagcagtgggagccaagcagagggtggaacgactggacacaagtccccttctgctcccaccactttcatgaacttgtgatgaaagatggacgggtactggttgtgccttgtaggaatcaggacgagctcattggtcgagcccgtatcagtcagggcgcagggtggtctctgaaggaaactgcttgcttgggaaaaagctatgcccagatgtggaccttaatgtacttccacagacgcgatctgcggctcgcagccaacgcgatttgttccgctgtcccatcacattgggtgccgacgagtaggacaacctggtctatccacgccaagcacgagtggatgactacagaggacatgcttgcagtgtggaacagagtctggatacaagaaaatccctggatggaggacaagacccctgttgaaagctgggaggaagtgccatatctgggcaaacgcgaggatcagtggtgcggttccctaatcgggctgacttcacgggccacctgggctaagaacattcagacagccatcaatcaggtaaggagcctcattggaaacgaggaatacacggactatatgccctctatgaaacgatttagacgggaggaagaggaagcaggcgtgttgtggtga

SEQ ID NO: 14659 - RNA, 9876 nt, synthetic construct
  misc_feature 1..9876: note = derived and/or modified CDS sequence (opt3) from DENV-2__EU482589__SS-prME
  source 1..9876: mol_type = other RNA
accgccggcgtgatcattatgctgatacccacagctatggcattccacctcactacgagaaacggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggatggggctggatttcaacgaaatggtgttgctccagatggaggacaaagcatggctggtccaccggcaatggtttttagatctgcctctcccatggcttcccggcgctgacacccagggaagcaattggatacagaaggagactctggtgacattcaagaaccctcatgccaaaaagcaggacgttgtggtcttgggctctcaagaaggggcgatgcacacggccctaaccggagcaactgagattcagatgtcctcaggtaatctgctctttacaggccatctgaaatgccgtcttcgcatggataagctgcagttgaaagggatgagctacagtatgtgtaccggaaagttcaagatcgtgaaagaaatcgctgagacacaacacggcactattgtaatcagagttcagtatgagggtgacgggtctccatgcaagattcccttcgaaataatggatctcgagaaaaggcatgtgctgggccggttaatcaccgtcaacccgattgtgacggaaaaggactcccctgtcaacatcgaggccgaacccccatttggagatagctacatcattataggcgtggagcctgggcagctgaaactaaattggttcaagaagggatcgtctatcggtcagatgtttgagaccacaatgcgaggcgctaaacgcatggccattctcggggacactgcatgggatttcggatccctgggcggtgtttttacctcaatcgggaaggcccttcaccaagtgttcggcgctatttacggagcggcatttagtggcgtaagctggacaatgaaaatcttgataggggtcatcattacttggatcggaatgaactccagatctaccagcctgtcagtgagtctcgttctggtgggcgtcgtgacgctttatctgggtgccatggtacaggctgactccgggtgtgtggttagctggaagtctaaagaattgaagtgcggatcaggcattttcatcacagataatgtccacacctggactgagcagtacaagtttcagcccgaaagtccaagcaaactcgcctccgcaatacaaaaggcccatgaggaaggtatttgtggcatcaggtctgtgacacggctggagaacttaatgtggaaacagattacccccgagctgaatcacatcctatcggaaaacgaggtgaagctcactataatgaccggggacatcaaaggaattatgcaggctggcaagcgcagcctgagacctcagccaacagaacttaaatattcctggaagacgtgggggaaggccaaaatgttgtcaaccgagagtcataatcaaactttcctgatcgatggaccggaaacagcagagtgccccaacaccaatagggcgtggaactctctcgaggtcgaagactacggctttggtgttttcacaactaatatttggctgaagttacgtgagaaacaggacgtgttttgtgatagcaagctgatgtccgctgccatcaaagacaaccgggcagtgcacgccgatatggggtattggatagaatcagctcttaatgacacctggaagatggagaaggccagcttcattgaggtaaaatcttgccactggcctaagtcccatacgttgtggagtaacggagtcctcgaaagcgagatgatcatccccaagaatctggcaggccccgtgtctcagcacaactaccgacctggttatcatacacagaccgctggcccatggcacctagggaagctggaaatggatttcgacttttgtgagggaactaccgttgtggtcacagaagattgcggcaacagagggccctccctcaggactaccacagcctcaggaaaactggtgacggagtggtgctgtcgcagttgcacccttccgcctttgcggtacagaggcgaggacggttgttggtacgggatggaaattaggccactgaaggagaaggaagagaatttagttaacagcctcgtgactgcgggacatggccaaatcgataatttctcgctgggtgtacttggcatggccctgtttttggaagagatgctccgcacacgagtcgggaccaaacacgctattctgctagtggcagtgtccttcgtcactctgataacaggaaacatgtcttttcgggacctcggccgtgttatggtgatggtaggggccaccatgacggatgacatcggaatgggcgtgacttatctggctcttttggccgcattcaaggtcagacccacctttgcggccggtctgttactcaggaaactgacaagcaaggagcttatgatggctaccattgggatcgccctgctatcacagagtactattcctgaaacaatcctcgagctgaccgatgcattggctctgggaatgatggtgttaaaaatagttcgcaatatggaaaagtaccagctcgccgtgacaatcatggcaatttcctgcgtccccaacgccgtgatcctgcaaaatgcttggaaggtttcttgtactattcttgcggccgtgagcgtctccccactgttgctcacctcaagccagcagaaagcagactggatccctctggctctaacgataaagggcctgaaccccacagccattttccttaccactctcagtcggacctctaaaaagagatcctggccactgaatgaggccatcatggctgtaggcatggtgagcatcttggcatcgtcactgctcaaaaacgacattccgatgacagggcctctagttgccggaggtctgcttactgtgtgctatgtcctgaccggcaggtctgcggatttggaactcgagcgagctgccgacgtgaagtgggaggatcaggcagaaataagtgggtccagccccatcctgtctattacgatcagcgaggacggatccatgtcaattaaaaatgaagaggaggaacaaacactaaccatcctgatacgcactggccttctcgtaatcagtggtgtgtttccagtcagcattcccatcacagccgctgcatggtacctgtgggaggttaagaagcagcgggccggggtgttgtgggatgtgccttctccaccccctgtcggaaaagcggaattagaggacggcgcttatagaattaagcagaggggcatcctggggtactcccagataggagccggtgtgtataaagaaggcaccttccacactatgtggcatgttacacgtggggcagtactcatgcaccgcggaaagcggattgagccgtcatgggccgatgtgaaaaaggacctgatcagttacggcggtgggtggaaacttgagggagaatggaaagagggcgaagaggtccaagtgctggctttggaaccaggcaagaaccccagagccgttcagaccaaacctgggctatttaagacgaatactggaaccatcggtgcagtgagcctggatttctccccaggcacatctgggtcgcccattgtcgacaggaaaggaaaggtggtaggcctctacggtaacggggtcgtgacccgaagcggagcttatgtttcagccatcgcgcagacagagaagtccatagaggataatcctgaaattgaggacgatatctttcggaaaaagcgcctgactattatggaccttcatccgggcgccggcaaaaccaagagatacttacccgcaatcgtgagggaagctataaaacgggggctgcgaacgctcattttggccccaacaagagtcgtggctgcagagatggaagaggccctgcgcggactccctatcaggtatcagactcccgccatccgtgctgagcacaccggtcgggaaattgttgacctgatgtgtcatgcgacattcaccatgagacttctgagtccagtgagggtccctaactacaacttgatcattatggatgaggcacacttcactgaccccgcctctatagctgcccgcggctatatcagcacccgagtggaaatgggggaggcagccggaatttttatgacagctacgccaccgggctccagagatcctttcccccaatcaaatgcgccaatcatggacgaggaacgggagatccccgaaaggtcttggaacagcggtcacgagtgggtaactgattttaaggggaagaccgtgtggttcgttcctagtattaaagccggaaatgacatagcagcttgcctacgcaagaacggcaaaaaggtcatccagctgtcccgtaaaacatttgatagcgaatacgtgaagaccagagccaatgactgggatttcgtggtcactacagacatttctgagatgggcgcaaactttaaggccgagcgggtaatcgatccaaggcgctgtatgaaacccgtgattctcaccgacggggaggaacgagttatcttagctggacctatgccggtgacgcattcatccgccgcgcagagacggggtaggataggccgcaatccaaagaacgaaaatgaccaatatatctacatgggggagcccctggaaaacgatgaggactgcgcacactggaaagaggccaagatgcttctggataatattaacactcctgaaggaatcattcccagtatgttcgagccagaaagagagaaagtcgacgctatcgatggcgaatacaggctccggggtgaggcccgtaagacatttgtggacttgatgcgccgaggggatctgcctgtttggctcgcttatagagtggcagccgagggcataaattacgctgacaggcggtggtgtttcgatggaattaaaaacaatcagatcctggaagagaacgtcgaagtggagatttggaccaaggagggcgaacgcaagaaacttaagcccagatggctagacgccaggatctatagcgatccactggcattgaaagagtttaaggagttcgcggccgggcggaaatcgttaaccctgaacctcataactgagatgggacgactgcctacattcatgacccagaaggctagaaatgcccttgacaacctggcagtactccatacagctgaagccggtggccgcgcatacaatcacgccttgtctgagctgccggagactctagaaacgctgctccttctgaccttattggctacagtgactgggggaatctttctgttcctcatgtccggcaagggtattgggaaaatgaccctgggcatgtgctgcatcattacagcgagcatccttctgtggtatgcccagatacaaccccactggattgcagcttcaatcatcctcgagtttttcttgattgttctgttaatcccagaacctgagaagcagaggaccccacaggataaccagctaacttacgtcgtgatagccattctgacggtggtcgccgcaaccatggctaatgaaatgggatttctcgagaaaacaaagaaagaccttggcctggggagtatcactacccaagagtctgaatccaacattttggacatcgatctgcggccagccagcgcgtggacactctatgctgttgccaccactttcgtgacacctatgctgcgtcattcaatagagaatagtagcgtaaacgtgtcccttacggcaatcgccaatcaggctaccgtcctcatgggactgggtaagggctggcccttgtctaagatggacattggggtgccgctgttagcaatcggatgttacagccaggttaacccaattactctaacagccgcgctgctccttctggtggctcactacgccatcattggccctggtttgcaggcaaaagccaccagagaagctcaaaagagggccgcagctgggatcatgaaaaatcccaccgtcgatggcataacagtaattgacctggagccaatcccctatgatcctaagtttgaaaaacagctcggacaggtgatgctgcttatcttatgcgttactcaggtgctgatgatgcgcacgacctgggccctctgtgaggcgttgacactggccactggcccgatttccaccctatgggaggggaaccccggacggttctggaatacaaccatagcagtctcaatggctaacatctttcgaggctcttacctggccggtgcagggctccttttcagtattatgaagaatactacgaacacaagaaggggaaccggcaatatcggtgaaactctgggcgagaagtggaaatcgcgcttgaacgctctgggaaagagcgaatttcaaatttataaaaagtccggaatccaggaggtggaccggaccctcgccaaagagggcataaagagaggggaaacagatcatcacgccgtctctcgtggatcagcgaaactgaggtggttcgtggagcggaacatggttactccagaaggcaaggtggtagacttaggttgcgggcgcggaggctggagctactattgtggtggccttaagaatgtgcgagaggtcaaagggctgaccaagggaggccctgggcatgaggaacccatccctatgtccacatacggatggaacctcgttagactacagagtggcgtggatgtctttttcacgccacccgagaaatgcgacaccctgttgtgtgatattggtgaatctagccctaatccaactatcgaggctgggaggacactgcgggtgctcaaccttgtagaaaattggctgaacaataacacccaattctgcattaaggtgttgaatccctatatgccgtcagttatcgagaaaatggaaactctgcagcgcaagtacggaggcgcactcgtgagaaaccctttatccaggaatagtacacacgagatgtactgggtcagcaacgccaccggcaatatagtgtcttccgtcaacatgatttcacgaatgctgatcaatcggtttacgatgaagcacaaaaaggctacctatgagccagacgtggatcttgggagcggaacacgtaacatcggtattgaatcggagatacccaacctggacatcattggcaaaagaatcgaaaagattaaacaggagcatgaaacttcttggcactacgaccaggatcatccttataagacctgggcctaccacgggagttatgagacaaagcaaactggatccgcaagctcaatggttaatggcgtagtgcgcctactcaccaaaccatgggacgtcgtgcccatggttacacagatggccatgaccgatactacgccgttcggtcagcagagggtgtttaaggagaaagtcgacacacggacccaagaacctaaggaggggactaaaaagctgatgaagatcaccgctgaatggttgtggaaagagctgggaaaggagaaaacacccagaatgtgtacgcgcgaagagttcaccaggaaggtgcgatccaacgcggccctcggcgcaatatttactgatgaaaataaatggaagtctgctcgggaggccgtagaagacagcagattctgggagcttatcgatagggagcgcaacctgcacttagaaggcaaatgcgagacatgtgtgtacaatatgatggggaagcgtgaaaagaaactgggagagtttggtaaggcaaaaggcagtcgggccatttggtatatgtggttgggggctagattcctcgaatttgaggccctgggattcctaaacgaggaccattggttttccagggaaaatagcctttctggcgttgagggtgaagggctgcaccgcctcggatacatcctgcgagatgtctcaaagaaagagggcggcgcgatgtacgcagacgataccgccgggtgggacactcggattacattggaagacctgaagaacgaggagatggtgaccaatcatatgaagggagaacacaaaaagctcgctgaggccatcttcaaacttacatatcagaacaaggtggtcagagttcagaggccaactcctcgcggtaccgtgatggatattataagtagacgggaccagaggggctccgggcaagtaggaacgtacggcctgaatacctttacaaacatggaagcacagttaatccgtcagatggagggtgaggggattttcaaaagcatccaacatctgactgctaccgaagagatcgccgtgcagaattggttggctcgagtcggacgcgaaagactctctcggatggccatttcgggcgatgactgcgtggttaagcccctggatgacaggttcgcatcagcgctaacagcccttaacgatatgggcaaggtgcgcaaagacatacagcagtgggagccaagcagagggtggaatgattggactcaagtccccttttgctcccaccacttccatgaactggtgatgaaggacggacgggtactcgttgtgccttgtaggaaccaggatgagctgatcggtcgagctcgtattagtcagggcgccgggtggtctttgaaagagaccgcatgcttaggaaagagctatgctcagatgtggacgctgatgtactttcacagacgcgacctccggcttgccgcaaacgccatctgttccgcggtcccatcacattgggtgccgacaagtaggaccacttggtctattcacgctaaacacgaatggatgacaaccgaggatatgctggccgtgtggaatagagtctggatccaagaaaacccctggatggaggacaagactcctgttgaaagctgggaggaggtgccatatctaggcaagcgcgaagaccagtggtgcggttccctgatagggctcacctcacgggcaacatgggccaaaaatatccagacggctattaaccaggtaaggagcttgatcggaaatgaggaatacaccgattatatgccctctatgaagcgattcagacgggaggaagaggaggccggcgtgctgtggtga

SEQ ID NO: 14660 - RNA, 9876 nt, synthetic construct
  misc_feature 1..9876: note = derived and/or modified CDS sequence (opt3) from DENV-2__EU569706__SS-prME
  source 1..9876: mol_type = other RNA
accgccggcgtgatcattatgctgatacccaccgctatggctttccacctcactacgaggaacggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtcgcgctggtgccccatgtcggtatggggcttgagaccagaacagaaacttggatgagtagcgagggagcttggaaacacgtgcagaggatcgagacctggattctgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggattattcggcaagggcgggattgtaacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctgactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcgccgaaaaggactcccctgtgaacatcgaggctgaacccccatttggagatagctacattataatcggcgtcgagcctgggcagctgaaactaaattggttcaagaagggatcgtctattggtcagatgtttgagaccacaatgcgaggcgccaaacgcatggcaatcctcggggacactgcctgggatttcggatccctgggcggtgtgtttacctcaattgggaaggcacttcaccaagttttcggcgcgatctacggagcagcctttagtggcgtgagctggacaatgaaaatattgatcggggtaattatcacttggattggaatgaactccagatctaccagcctgtcagtcagtctcgtgctggttggcgtggtcacgctttatctgggtgtgatggtacaggctgactccgggtgtgtggttagctggaagaataaagaattgaagtgcggatctggcatcttcataacagataacgtccacacctggactgagcagtacaagtttcagcccgaatcaccaagtaaactcgccagcgcaattcaaaaggcccatgaggaaggtatctgtggcattaggtccgtgacacggctggagaatttaatgtggaaacagatcacccccgagctgaaccacatactatctgaaaatgaggtgaagctcactatcatgaccggggacattaaaggaatcatgcaggctggcaagcgctcgctgagacctcagccaacagaacttaaatatagctggaagacgtgggggaaggccaaaatgttgtccaccgagtcacataaccaaactttcctgattgatggaccggaaacagcagagtgccccaataccaacagggcgtggaatagtctcgaggtcgaagactacggctttggtgttttctctacaaacatctggctgaagttacgtgagaaacaggacgtgttttgtgatagcaagctgatgtccgctgccataaaagacaatcgggcagtgcacgccgatatggggtattggattgaatcagctcttaacgacacttggaagatggagaaggccagcttcatcgaggtaaaatcttgccactggcctaagtcccataccttgtggagtaatggagtcctcgaaagcgagatgatcattcccaaaaacttcgcaggccccgtgtctcagcacaactaccgacctggttatcatacgcagacagctggcccatggcacctggggaagctagaaatggattttgacttctgtgagggaaccactgttgtggtcaccgaagattgcggcaatagagggccctccctgaggacaactaccgcctcaggaaaactcatcacagagtggtgctgtcgcagttgcacgctgccgcctcttcggtacagaggcgaggacggttgttggtacgggatggaaattaggccattgaaggagaaggaagagaacctggtgaatagcttagttaccgcgggacatggccaaatagataacttttcgctcggtgtgctgggcatggcccttttcctggaagagatgttgcgcactcgagtagggacaaaacacgctatcctcctggtcgcagtgtcctttgtgaccctaattactggaaatatgtctttccgggacctgggccgtgtcatggttatggtgggggccacaatgaccgatgacatcggaatgggcgtaacgtatctcgctctgcttgccgcatttaaggtgagacccactttcgcggccggtttgctgttaaggaaactcaccagcaaggagctgatgatggctacaattgggatcgcccttctgtcacagagtaccatacctgaaactatcctagagctcacagatgcactggctttgggaatgatggtcctgaaaattgtgcgcaacttagaaaagtaccagctcgccgttaccatcatggcaatttcctgcgtgcccaatgccgtcatcctgcaaaacgcttggaaggtgtcttgtacaatacttgcggccgttagcgtgtccccactgttgctcacttcaagccagcagaaagcagactggattcctctggctctaaccatcaagggcctgaatcccacggccatctttcttacaaccctcagtcggacttctaaaaagagatcctggccactgaacgaggccgtcatggctgtaggcatggtgagcattttggcatcgtcactgctcaaaaatgacataccgatgaccgggcctctagttgccggaggtctgcttacagtgtgctatgtcctgactggcaggtctgcggatttggaactcgagcgagctgccgacgtgaagtgggaggatcaggcagaaatcagtgggtccagccccattctgtctatcaccattagcgaggacggatccatgtcaatcaaaaacgaagaggaggaacaaacgctaacaatactgatccgcaccggccttctcgtaattagtggtgtgttcccagtcagcatccccattactgccgctgcatggtacctgtgggaggttaagaagcagcgggccggggtgttgtgggatgtgccttctccaccccctgtcggaaaagcggaattagaggacggcgcttatagaatcaagcagaggggcatatttgggtactcccagattggagccggtgtgtataaagaaggcacattccacaccatgtggcatgttactcgtggggcagtactgatgcaccgcggaaagcggatcgagccgtcatgggccgatgtgaaaaaggacctcatcagttacggcggtgggtggaagctggagggagaatggaaagagggcgaagaggtccaagtgcttgctctggaaccaggcaagaatcccagagccgttcagacaaaacctgggttgtttaagaccaacacgggaactattggtgcagtgagcctagatttctccccaggcacctctgggtcgcccatcgtcgacaggaaaggaaaggtggtaggcctgtacggtaatggggtcgtgacacgaagcggagcttatgtttcagccatagcgcagaccgagaagtccattgaggataaccctgaaatcgaggacgatattttccggaaaaagcgcctcacaatcatggacctgcatccgggcgccggcaaaactaagagataccttcccgcaatagtgagggaagctattaaacgggggttacgaaccctgatcctcgccccaacgagagtcgtggctgcagagatggaagaggccttgcgcggactgcctatcaggtatcagacacccgccattcgtgctgagcacactggtcgggaaatcgttgacctcatgtgtcatgcgacctttacaatgagactgcttagtccagtgagggtccctaactacaatctgattataatggatgaggcacacttcaccgaccccgcctctatcgctgcccgcggctatattagcactcgagtggaaatgggggaggcagccggaatctttatgaccgctacaccaccgggctccagagatcctttcccccaatcaaacgcgccaatcatggacgaggaacgggagattcccgaaaggtcttggaatagcggtcacgagtgggtaacggattttaaggggaagactgtgtggttcgttcctagtataaaagccggaaacgacatcgcagcttgcttgcgcaagaatggcaaaaaggtcattcagctatcccgtaaaacctttgatagcgaatacgtgaagacaagagccaacgactgggatttcgtggtcaccactgacatctctgagatgggcgcaaattttcgggccgagagggtaattgatccacgccgatgtatgaagcccgtgatcctgacagacggggaagagagagttatactcgctggacctatgccggtgacccattcatccgccgcgcagcggaggggtcgcatcggcagaaaccccaaaaatgaaaacgaccaatatatttacatgggggagccattagaaaatgatgaggactgcgcacactggaaggaggccaaaatgctgcttgataacatcaatacgcctgaaggaattatccccagtatgttcgagccagaaagggagaaggtcgacgctatagatggcgaataccggctgcgtggtgaggcccgcaaaacttttgtggacctcatgcgaagaggggatttgcctgtttggctggcttatagggtggcagccgagggcattaactacgctgaccggcgctggtgtttcgatggaatcaagaataaccagattctcgaagagaacgtcgaagtggagatctggacaaaagagggcgaaagaaagaagctgaaacccaggtggcttgacgcccggatatatagcgatccactagcactgaaggagttcaaagaatttgcggccgggcgaaagtcgttgaccttaaatctgatcaccgagatgggaagactccctactttcatgacacagaaagctcgcgacgccctggataaccttgcagtactgcataccgctgaagtgggtggcagggcctacaatcacgcactctctgagttgccggagacactggaaactctactgctccttacgctgttagccaccgttacagggggaatatttttgttcctgatgtccggcaagggtatcgggaagatgactctcggcatgtgctgcattatcaccgctagcatactgctttggtatgcgcagattcaaccccactggatcgccgcatcaatcattctggagtttttcctcatcgtcttgctgataccagaacctgagaaacagcggacaccccaggacaaccagttaacctacgtggtgattgctatcctaactgtcgttgccgccacgatggcaaatgaaatgggatttctggagaagaccaaaaaggacctcggccttgggagtattacaactcaagagtctgaatccaacatcctggatatagacttgcgtccagctagcgcctggaccctgtatgcggtggctacaaccttcgtaactcctatgctcagacattcaatcgagaatagtagcgtgaacgtctccctgacagccattgcaaatcaggccacggtgcttatgggactcggtaggggctggcccctgtctaaaatggatatcggggttccgttgctggctattggatgttacagccaggtgaacccaatcaccttaactgcagccctactgctccttgtcgcgcactacgctattatcggccctggtctgcaggccaaggcaacacgcgaagcccaaaagcgggctgccgcagggataatgaaaaatcccaccgtagacggcattaccgtgatcgatttggagccaatcccctatgaccctaagtttgaaaaacagctgggacaggttatgctcctggtgctttgcgtcacacaggtgttaatgatgcgaactacgtgggctctgtgtgaggccctcaccttggcgacaggcccgatttccactctgtgggaggggaaccccggaagattctggaataccacaatagccgtctcaatggcaaacatctttaggggctcttacctagctggtgccgggctactcttcagtattatgaagaataccactaacacgcgccggggaacaggcaatatcggtgaaacccttggcgagaaatggaagtcgagactgaacgcattgggaaagagcgaatttcaaatttataaaaagtccggaatccaggaggtggatcgtactctggctaaagagggcataaagagaggggaaaccgaccatcacgccgtttctcggggatcagccaaactccgctggttcgtggagcgaaacatggtaacaccagaaggcaaggtggtcgatctgggttgcgggagaggaggctggagctactattgtggtggccttaaaaatgttagggaggtgaaggggctaactaagggaggccctgggcatgaggaaccaatccctatgtccacctacggatggaacctggtccggctccagagtggcgtggacgtattctttacaccacccgagaaatgcgatacgctactgtgtgacattggtgaatctagccctaatccaaccatcgaggcggggcgcactttgagagtgctgaacctcgttgaaaattggcttaacaataacacacaattctgcattaaggtgctgaatccctatatgccgtcagtcatcgagaaaatggaaaccttgcagaggaagtacggaggcgctctggtgcgaaaccctctctcccggaatagtactcacgagatgtactgggtcagcaacgcaacaggcaatatagtgtcttccgttaacatgatttcacgtatgttaatcaatagatttaccatgaaacacaagaaggccacgtatgagccagatgtagacctggggagcggaacccgcaacatcggtattgaaaacgagatacccaatcttgacatcattggcaaaaggatcgaaaagattaaacaggagcatgaaacatcgtggcactacgatcaggaccatccttataagacttgggcttaccacgggtcttatgagaccaaacaaacaggaagtgcctccagcatggtgaacggcgtcgtgcggctgctaactaagccatgggatgttgtgcccatggtcacccagatggcaatgacagacaccactccgttcggtcagcagagagtgtttaaggagaaagtagatacgcgcacacaagaacctaaggaggggaccaaaaagctcatgaggatcactgccgaatggctgtggaaagagttgggaaagaagaaaacaccccgaatgtgtacacgggaggagttcacgagaaaggtgaggtcaaatgctgcgctgggcgccatatttaccgacgagaacaaatggaagtccgcacgcgaagctgttgaggattctcgtttctgggaactcgtcgaccgggagagaaatcttcacctggagggcaaatgcgaaacttgtgtgtacaacatgatggggaagagggagaaaaagttaggagaatttggtaaggccaaaggcagccgcgcaatctggtatatgtggctgggggcccgattcttggagtttgaagctctcggattcctgaatgaggatcattggtttagtcggggcaactccctaagcggtgtggagggggaaggacttcacaagctgggctacattctcagagacgtctctaaaaaggagggcggggccatgtacgcggatgacacagcaggatgggacaccaggatcactctggaagatttgaaaaatgaggaaatggttacaaaccatatgaagggtgagcacaagaaactggccgaggctattttcaagctcacctatcagaataaagtggtacgcgtgcagagaccaacacctcggggcactgtcatggacatcatttcaaggaaggatcagcgtgggagtggacaagtgggcacctacggtcttaacacgttcaccaatatggaagcccagctgatacgacagatggagggggaaggaatctttaaatccattcaacatttaacagttactgaggagatcgcagtgcagaactggctggctcgcgtcggcagagaacggttgagcaggatggccatctctggcgacgattgcgtggtaaagcccctcgacgatcgcttcgcttcggccctgaccgcactaaatgacatggggaaggttagaaaagatattcagcagtgggagccatcacggggatggaacgactggacacaagtgcccttttgcagccaccacttccatgaacttgtcatgaaggatggtagggtgctggtggtcccttgtcgaaaccaggacgagctcataggccgtgcgagaatctcccagggggccggatggagtctgaaagaaactgcttgcttgggcaagtcttatgcccagatgtggaccttaatgtactttcaccgccgggatctgaggctcgcagctaatgccatttgtagcgcagttccatcccattgggtgccgacgtcaagaacaacctggagtatccacgccaaacacgagtggatgactacagaggacatgcttgcggtatggaaccgcgtgtggattcaagaaaatccctggatggaggacaagacccctgtcgaatcttgggaggaagtgccatatctgggtaagcgggaggatcagtggtgcgggagcctaatcggactgacttccagggctacctgggccaaaaacatacagacagcaatcaatcaggttcgatcactcattggcaacgaggaatacacggactatatgcccagcatgaagagattccggaaagaggaagaggaagccggcgtgttgtggtga

SEQ ID NO: 14661 - RNA, 9876 nt, synthetic construct
  misc_feature 1..9876: note = derived and/or modified CDS sequence (opt3) from DENV-2__EU569707__SS-prME
  source 1..9876: mol_type = other RNA
accgcaggcgtgatcattatgctgatacccaccgctatggcattccacctcactacgagaaacggggaacctcatatgatcgtcgggaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcgtggaagcaaagttgacaaacactaccacagagagtcgctgtccaactcaaggagagccctccctgaatgaagaacaggacaaacgatttgtctgcaagcattctatggtggatagaggctggggtaacgggtgtggactattcggcaagggcgggatcgtgacctgcgccatgtttacatgcaaaaagaatatggaaggaaaagtcgttctccctgagaacctggaatacaccatcgtgattactccacacagcggtgaggagcatgctgtaggcaatgacacggggaagcacggaaaagaaataaagatcacaccgcagtcctcaattaccgaggccgaacttactggctatggtaccgtgacaatggagtgtagtcccaggaccgggctggatttcaacgaaatggtcttgctccggatggaggacaaagcatggctggtgcaccgtcagtggtttttagatctgcctctcccatggcttcccggcgctgacactcaaggaagcaattggatccagaaggagacactggttacgttcaagaaccctcatgccaaaaagcaggacgtggtcgtgttgggctctcaggaaggggcgatgcacaccgccctaactggagcaacagagatacaaatgtcctcaggtaatctgctctttaccggccatctgaaatgccgccttagaatggataagctgcagttgaaagggatgagctacagtatgtgtacaggaaagttcaagattgtaaaagaaatcgctgagactcagcacggcaccatcgttattagggtgcaatatgagggtgacgggtctccatgcaagatccccttcgaaattatggatctcgagaaacggcatgtcctgggccgattaataacggtgaacccgatcgtcgccgaaaaggactcccctgtgaacattgaggctgaacccccatttggagatagctacatcatcattggcgttgagcctgggcagctgaaactaaattggttcaagaagggatcgtctataggtcagatgtttgagaccacaatgcgcggcgccaaaagaatggcaatcctcggggacactgcctgggatttcggatccctgggcggtgtgtttacctcaattgggaaggcacttcaccaggtattcggcgcgatctacggagcagcctttagtggcgtcagctggacaatgaaaattttgatcggggtgataatcacttggattggaatgaactccaggtctaccagcctgtcagttagtctcgtgctggtcggcgtggtaacgctttatctgggtgctatggtgcaagccgactccgggtgtgttgtcagctggaagtctaaagaattgaagtgcggatcaggcatcttcattacagataatgtgcacacctggactgagcagtacaagtttcagcccgaaagtccaagcaaactcgcatccgccatccagaaggctcatgaggaaggtatatgtggcattcggtctgtgacacgcctggagaacttaatgtggaaacaaatcacccccgagctgaatcacattctatcggaaaacgaggtcaagctcactatcatgaccggggacataaaaggaatcatgcaggccggcaagagaagcctgaggcctcagccaacagaacttaaatattcctggaagacgtgggggaaggcaaaaatgttgtcaaccgagagtcataatcagactttcctgattgatggaccggaaacagcggagtgccccaacaccaatcgtgcttggaactctctcgaggttgaagactacggctttggtgtgttcacaactaatatctggctgaagttacgggagaaacaagacgtgttttgtgatagcaagctgatgtccgccgcaattaaagacaaccgagccgtacacgctgatatggggtattggatcgaatcagcccttaatgacacctggaagatggagaaggcttcattcatagaggtcaaatcttgccactggcctaagtcccatacgttgtggagtaacggagtgctcgaaagcgagatgattatccccaaaaatttcgctggccccgtttctcagcacaactacagacctggttatcatacacagaccgccggcccatggcacctggggaagctagaaatggattttgacttctgtgagggaactaccgtggtcgtgacagaagattgcggcaacagggggccctccctgcgcactaccacagcgtcaggaaaactcatcacggagtggtgctgtcggagttgcaccctgccgcctcttagatacaggggcgaggacggttgttggtacgggatggaaattcgcccattgaaggagaaggaagagaatctggttaacagcttagtgactgccggacatggccagatcgataatttttcgctcggtgtactgggcatggctcttttcctggaagagatgttgcgaacacgggtcgggaccaaacacgcaatgctcctggtggccgtgtcctttgtcactctaattacaggaaacatgtctttccgtgacctgggcagagttatggtgatggtaggggctaccatgacggatgacataggaatgggcatcacttatctcgccctgcttgcagcgtttaaggtgaggcccaccttcgccgctggtttgctgttacgcaaactcacaagcaaggagctgatgatggccaccattgggatcgcacttctgtcacaaagtactattcctgaaacaatcctagagctcaccgatgctctggccttgggaatgatggtcctgaaaatagtgcggaatatggaaaagtaccagttagcagttacaatcatggccatttcctgcgtgcccaacgctgtcatcctccagaatgcgtggaaggtgtcttgtactattctggccgcagttagcgtgtccccacttctgttgacctcaagccaacagaaagctgactggatccctctcgccctgacgataaagggcctaaaccccacagccatttttctgaccactcttagtagaacctctaaaaagaggtcctggccactcaatgaggctatcatggcagtcggcatggtaagcatcctggcctcgtcattgctgaaaaacgacattccgatgacagggcctttagtggcgggaggtctcctgactgtttgctatgtgcttaccggccgatctgctgatctggaattggagcgcgccgcagacgtcaagtgggaggatcaggccgaaataagtgggtccagccccatcctctctattacgatcagcgaggacggatccatgtcaattaaaaatgaagaggaggaacagacactgaccatcctaatacggactggcctgcttgtgatcagtggtgtattcccagtgagcattcccatcacagctgcagcctggtacctctgggaggtcaagaagcaaagagcgggggttctgtgggatgtgccttctccaccccctgtgggaaaagctgaattggaggacggcgcctataggattaagcagcgtggcatcttagggtactcccagataggagccggtgtatataaagaaggcacctttcacactatgtggcatgtgacacgcggggcagttctgatgcaccggggaaagagaattgagccgtcatgggctgatgtcaaaaaggacctcatcagttacggcggtgggtggaagctggagggagaatggaaagagggcgaagaggtgcaggtccttgccctggaaccaggcaagaaccccagggcagtgcaaaccaaacctgggttgttcaagacgaatactggaaccatcggtgctgttagcctagatttttccccaggcacatctgggtcgcccattgtggaccgaaaaggaaaggtcgtgggcctgtacggtaacggggtagtcacccggagcggagcctatgtgtcagcgatcgcccagacagagaagtccatagaggataatcctgaaattgaggacgatatcttccgcaaaaagagactcactattatggacctgcatccgggcgcaggcaaaaccaagaggtaccttcccgctatcgttcgggaagccataaaacgagggttaagaacgctgattctcgctccaacacgcgtggtcgcagccgagatggaagaggccttgaggggactgcctatccgttatcagactcccgctatccgggcggagcacaccggtagagaaattgtggacctcatgtgtcatgcaacattcaccatgaggctgcttagtccagttcgcgtgcctaactacaacctgatcattatggatgaggcccactttactgaccccgcttctatagccgcacgaggctatatcagcaccagagtcgaaatgggggaggccgctggaattttcatgacagcgacgccaccgggctcccgggatccttttccccagtcaaatgccccaatcatggacgaggaaagggagatccccgaacgctcttggaacagcggtcacgagtgggtgactgatttcaaggggaagaccgtatggtttgtgcctagtattaaagcaggaaatgacatagctgcctgcttgcgtaagaacggcaaaaaggttatccaactatccagaaaaacattcgatagcgaatacgtcaagacccgggcaaatgactgggattttgtggtgactacagacatttctgagatgggcgccaacttcaaggctgagagggtcatcgatccacgccgatgtatgaaacccgtaattctgaccgacggggaagagagagtgatcctcgccggacctatgccggttacgcattcatccgcggcacagcggaggggtcgcataggcagaaatccaaagaacgaaaatgaccagtatatctacatgggggagcccttagaaaacgatgaggactgcgcccactggaaagaggctaagatgctgcttgataatattaacactcctgaaggaatcattcccagtatgtttgagccagaaagggagaaagtggacgccatcgatggcgaataccggctgcgtggtgaggctcgcaagacattcgtcgacctcatgcgaagaggggatttgcctgtgtggctggcatatagggttgccgctgagggcataaattacgccgaccggcgctggtgttttgatggaattaaaaacaatcaaatcctcgaagagaacgtggaagtcgagatttggaccaaggagggcgaaagaaagaaactgaagcccaggtggcttgacgcacggatctatagcgatccactagcgctgaaagagttcaaggagttcgccgctgggcgaaaatcgttgaccttaaacctgataactgagatgggaagactccctacatttatgacccagaaggcccgcgacgcactggataatcttgctgtgctgcatacagccgaagccggtggcagggcctacaaccacgctctctctgagttgccggagactctggaaacgctactgctccttaccctgttagcgacagtaactgggggaatcttcttgtttctgatgtccggcaagggtattgggaaaatgaccctcggcatgtgctgcatcattacagccagcatcctgctttggtatgcacagatacagccccactggattgctgcctcaatcatcctggagttctttctcattgtgttgctgatcccagaacctgagaagcaacggaccccacaggacaatcagttaacttacgttgtcatagccattctaacggtggtggcagctaccatggccaacgaaatgggattcctggagaaaacaaagaaagacctcggccttgggagtatcgcgactcaggagtctgaatccaatattctggatatcgacttgcgtccagctagcgcctggaccctgtatgcagtcgccacaacctttgttactcctatgctcagacattcaatagagaacagtagcgtgaatgtatccctgacagctatcgcaaaccaagccacggtgcttatgggactcggtaagggctggcccctgtctaagatggatattggggtcccgttgctggcgatcggatgttacagccaggtgaatccaattaccttaactgctgccctactgctccttgttgcacactacgccatcattggccctggtctgcaggctaaagccacaagggaagcacagaagcgcgctgccgcggggatcatgaaaaaccccaccgtggacggcataaccgtcattgatttggagccaatcccctatgaccctaagttcgaaaaacaactgggacaggtaatgctcctgatcctttgcgtgacacaggttttaatgatgcggactacgtgggccctgtgtgaggcactcaccttggctacaggcccgatttccactctgtgggaggggaatcccggacgattttggaacaccacaatagccgtgtcaatggcaaatatcttcagaggctcttacctagctggtgccgggctgctctttagtattatgaagaacaccactaatacgaggcgcggaacaggcaacatcggtgaaacccttggcgagaagtggaaatcgcggctgaatgccttgggaaagagcgagttccagatttataaaaagtccggaatccaagaggtcgatagaactctggcgaaagagggcataaagcgtggggaaaccgaccatcacgctgtgtctaggggatcagcaaaactccggtggtttgtcgagcgcaacatggtgacaccagaaggcaaggttgtggatctgggttgcgggcgaggaggctggagctactattgtggtggcttaaagaacgtaagagaggtgaaagggcttactaagggaggccctgggcatgaagaacccatccctatgtccacctacggatggaatctggtcaggctccagagtggcgttgacgtgttcttcacaccacccgagaaatgcgatacgctactgtgtgacattggtgaatctagccctaacccaaccatcgaggccgggcggactttgcgcgtcctgaatctcgtggaaaactggcttaataacaatacacagttttgcattaaggtactgaacccctatatgccgtcagtgatcgagaaaatggaaaccttgcaaagaaagtacggaggcgctctggttaggaatcctctctcccgaaacagtactcacgagatgtactgggtgagcaatgccacaggcaacatagtctcttccgtgaatatgatttcacggatgttaatcaaccgtttcaccatgaagcacaaaaaggcaacgtatgagccagatgtcgacctggggagcggaaccagaaatatcggtattgaatcggagatacccaaccttgacatcattggcaaacgcatcgaaaagattaaacaggagcatgaaacatcttggcactacgatcaggaccatccttataagacttgggcctaccacgggagttatgagaccaagcagacaggatccgctagctcaatggtgaacggcgttgtaaggctgctaactaaaccatgggatgtggtccccatggtgacccaaatggcgatgacagacaccactccgtttggtcagcagcgggttttcaaggagaaagtggatacgagaacacaggaacctaaggaggggaccaaaaagctcatgaagatcactgccgaatggctgtggaaagagttgggaaagaaaaagacaccccgcatgtgtacaagggaggaatttacgcgaaaagtccggtccaatgcagctctgggcgccatattcaccgacgagaacaagtggaaatctgcaagagaagccgtggaggatagcaggttttgggaactcatcgaccgcgagcgtaatcttcacctggagggcaagtgcgaaacttgtgtatacaacatgatggggaagcgggagaaaaagttaggagagttcggtaaagctaagggcagtagagccatttggtatatgtggctgggggcgaggtttttggagttcgaagcactcggatttctgaatgaggatcattggttctcccgcggcaacagcctatctggtgtggagggggaaggacttcaccgactgggctacatcctccgggacgttagcaaaaaggagggcggggccatgtacgctgatgacacagccggatgggacaccagaattactctggaagatttgaagaatgaggaaatggtcacaaaccatatgaaaggtgagcacaagaaactggcagaggctatctttaagctcacctatcaaaataaagtggtgagggtccagcgcccaacacctagaggcactgttatggacattataagtcggagggatcagcgtgggtccggacaggtgggcacctacggtcttaacacgttcaccaatatggaagcccaactgatccgacagatggagggggaaggaattttcaagagcatccagcatttaacagtaactgaggagatcgctgtgcaaaactggctggcccgcgtcggcagagaacggttgtctaggatggcaatttcgggcgacgattgcgtggttaagcccctcgacgatcgctttgcgtcagccctgaccgctctaaatgacatggggaaagtgagaaaggatatacagcagtgggagccaagccggggatggaacgactggacacaggtccccttctgctcccaccactttcatgaacttgtgatgaaagatggtagggtactggttgtgccttgtcgaaatcaagacgagctcatcggccgtgccagaattagtcagggggcaggatggtctctgaaggaaactgcttgcttgggcaaaagctatgcccagatgtggaccttaatgtacttccaccgccgggatctgaggctcgcagccaacgcgatctgttccgctgtcccatcacattgggtgccgacgagtagaacaacctggtctattcacgccaagcacgagtggatgactacagaggacatgcttgcagtgtggaaccgcgtctggatccaggaaaatccctggatggaggacaagacccctgttgaaagctgggaggaagtgccatatctgggtaaacgggaggatcaatggtgcgggtccctaataggactgacttcaagggccacctgggctaagaacatccagacagccattaatcaggtacgaagcctcatcggcaacgaggaatacacggactatatgccctctatgaaaagatttcggagggaggaagaggaagcaggcgtgttgtggtga

SEQ ID NO: 14662 - RNA, 9876 nt, synthetic construct
  misc_feature 1..9876: note = derived and/or modified CDS sequence (opt3) from DENV-2__EU660399__SS-prME
  source 1..9876: mol_type = other RNA
accgcaggcgtgatcattatgctgatacccaccgctatggcattccacctcactacgcggaacggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtggccgaaaaggactcccctgtcaacatcgaggctgaacccccatttggagatagctacatcattataggcgtggagcctgggcagctgaaactaaattggttcaagaagggatcgtctatcggtcagatgtttgagaccacaatgcgaggcgccaaacgcatggcaattctcggggacactgcctgggatttcggatccctgggcggtgtttttacctcaatcgggaaggcacttcaccaagtgttcggcgcgatttacggagcagcctttagtggcgtaagctggacaatgaaaatcttgataggggtcatcattacttggatcggaatgaactccagatctaccagcctgtcagtgagtctcgttctggtgggcgtcgtgacgctttatctgggtgctatggtacaggccgactccgggtgtgtggttagctggaagtctaaagaattgaagtgcggatcaggcattttcatcacagataatgtccacacctggactgagcagtacaagtttcagcccgaaagtccaagcaaactcgcatccgccatacaaaaggctcatgaggaaggtatttgtggcatcaggtctgtgacacggctggagaacttaatgtggaaacagattacccccgagctgaatcacatcctatcggaaaacgaggtgaagctcactataatgaccggggacatcaaaggaattatgcaggccggcaagcgcagcctgagacctcagccaacagaacttaaatattcctggaagacgtgggggaaggcaaaaatgttgtcaaccgagagtcataatcaaactttcctgatcgatggaccggaaacagcggagtgccccaacaccaatagggcttggaactctctcgaggtcgaagactacggctttggtgttttcacaactaatatttggctgaagttacgtgagaaacaggacgtgttttgtgatagcaagctgatgtccgccgcaatcaaagacaaccgggccgtgcacgctgatatggggtattggatagaatcagcccttaatgacacctggaagatggagaaggcttcattcattgaggtaaaatcttgccactggcctaagtcccatacgttgtggagtaacggagtcctcgaaagcgagatgatcatccccaaaaatttcgctggccccgtgtctcagcacaactaccgacctggttatcatacacagaccgccggcccatggcacctggggaagctagaaatggattttgacttctgtgagggaactaccgttgtggtcacagaagattgcggcaacagagggccctccctgaggactaccacagcgtcaggaaaactcattacggagtggtgctgtcgcagttgcaccctgccgcctcttcggtacagaggcgaggacggttgttggtacgggatggaaatcaggccattgaaggagaaggaagagaatctggtgaacagcttagttactgccggacatggccaaattgataatttttcgctcggtgtgctgggcatggctcttttcctggaagagatgttgcgcacacgagtagggaccaaacacgcaatgctcctggtcgccgtgtcctttgtgactctaataacaggaaacatgtctttccgggacctgggccgtgtcatggttatggtgggggctaccatgacggatgacatcggaatgggcattacttatctcgccctgcttgcagcgtttaaggtaagacccaccttcgccgctggtttgctgttaaggaaactcacaagcaaggagctgatgatggccaccatcgggattgcacttctgtcacagagtactatccctgaaacaatactagagctcaccgatgctctggccttgggaatgatggtgctgaaaatcgtccgcaatatggaaaagtaccagttagcagtgacaattatggccatctcctgcgttcccaacgctgtgattctccaaaatgcgtggaaggtctcttgtactatcctggccgcagtgagcgtttccccacttctgttgacctcaagccagcagaaagctgactggatacctctcgccctgacgattaagggcctaaaccccacagccatctttctgaccactcttagtcggacctctaaaaagagatcctggccactcaatgaggctgtgatggcagtcggcatggtaagcatcctggcctcgtcattgctgaaaaacgacattccgatgacagggcctttagtggcgggaggtctcctgactgtttgctatgtgcttaccggcaggtctgctgatctggaattggagcgagccgcagacgtcaagtgggaggatcaggccgaaataagtgggtccagccccatcctctctattacgatcagcgaggacggatccatgtcaattaaaaatgaagaggaggaacaaacactgaccatcctaatacgcactggcctgcttgtgatcagtggtgtattcccagtgagcattcccatcacagctgcagcctggtacctctgggaggtcaagaagcagcgggcgggggttctgtgggatgtgccttctccaccccctgtgggaaaagctgaattggaggacggcgcctatagaattaagcagaggggcatcttagggtactcccagataggagccggtgtatataaagaaggcacctttcacactatgtggcatgtgacacgtggggcagttctgatgcaccgcggaaagcggattgagccgtcatgggctgatgtcaaaaaggacctcatcagttacggcggtgggtggaagctggagggagaatggaaagagggcgaagaggtgcaagtccttgccctggaaccaggcaagaaccccagagcagtgcagaccaaacctgggttgttcaagacgaatactggaaccatcggtgctgttagcctagatttttccccaggcacatctgggtcgcccattgtggacaggcagggaaaagtcgtgggcctgtacggtaacggggtagtcacccgaagcggagcctatgtgtcagcgatcgcccagacagagaagtccatagaggataatcctgaaattgaggacgatatcttccggaagaaacgcctcactattatggacctgcatccgggcgcaggcaagaccaaaaagtaccttcccgctatcgttagagaagccataaaaagggggttacggacgctgattctcgctccaacacgagtggtcgcagccgagatggaagaggccttgagaggactgcctatccgctatcaaactcccgctatcagggcggagcacaccggtcgtgaaattgtggacctcatgtgtcatgcaacattcaccatgcggctgcttagtccagttagagtgcctaactacaacctgatcattatggatgaggcccactttactgaccccgcttctatagccgcaaggggctatatcagcacccgcgtcgaaatgggggaggccgctggaattttcatgacagcgacgccaccgggctcccgagatccttttccccagtcaaatgccccaatcatggacgaggaaagagagatccccgaacggtcttggaacagcggtcacgagtgggtgactgatttcaaggggaagaccgtatggtttgtgcctagtattaaagcaggaaatgacatagctgcctgcttgaggaagaacggcaaaaaggttatccagctatcccgcaaaacattcgatagcgaatacgtcaagacccgtgcaaatgactgggattttgtggtgactacagacatttctgagatgggcgccaacttcaaggctgagagagtcatcgatccacggaggtgtatgaaacccgtaattctgaccgacggggaagaacgcgtgatcctcgccggacctatgccggttacgcattcatccgcggcacaacgaagaggtcggataggcaggaatccaaagaacgaaaatgaccagtatatctacatgggggagcccttagaaaacgatgaggactgcgcccactggaaagaggctaagatgctgcttgataatattaacactcctgaaggaatcattcccagtatgtttgagccagaacgcgagaaagtggacgccatcgatggcgaatacagactgaggggtgaggctcggaagacattcgtcgacctcatgcgtcgcggggatttgcctgtgtggctggcatatcgagttgccgctgagggcataaattacgccgacagaaggtggtgttttgatggaattaaaaacaatcagatcctcgaagagaacgtggaagtcgagatttggaccaaggagggcgaacggaagaaactgaagccccgctggcttgacgcaagaatctatagcgatccactagcgctgaaagagttcaaggagttcgccgctgggaggaaatcgttgaccttaaacctgataactgagatgggacggctccctacatttatgacccagaaggcccgagacgcactggataatcttgctgtgctgcatacagccgaagccggtggcagagcctacaaccacgctctctctgagttgccggagactctggaaacgctactgctccttaccctgttagcgacagtaactgggggaatcttcttgtttctgatgtccggcaagggtattgggaaaatgaccctcggcatgtgctgcatcattacagccagcatcctgctttggtatgcacaaatacagccccactggattgctgcctcaatcatcctggagttctttctcattgtgttgctgatcccagaacctgagaagcagcgcaccccacaggacaatcaattaacttacgttgtcatagccattctaacggtggtggcagctaccatggccaacgaaatgggattcctggagaaaacaaagaaagacctcggccttgggagtatcgcgactcaggagtctgaatccaatattctggatatcgacttgaggccagctagcgcctggaccctgtatgcagtcgccacaacctttgttactcctatgctccggcattcaatagagaacagtagcgtgaatgtatccctgacagctatcgcaaaccaggccacggtgcttatgggactcggtaagggctggcccctgtctaagatggatattggggtcccgttgctggcgatcggatgttacagccaggtgaatccaattaccttaactgctgccctactgctccttgttgcacactacgccatcattggccctggtctgcaagctaaagccacacgtgaagcacagaagagagctgccgcggggatcatgaaaaaccccaccgtggacggcataaccgtcattgatttggagccaatcccctatgaccctaagttcgaaaaacagctgggacaggtaatgctcctgatcctttgcgtgacacaagttttaatgatgaggactacgtgggccctgtgtgaggcactcaccttggctacaggcccgatttccactctgtgggaggggaatcccggacgcttttggaacaccacaatagccgtgtcaatggcaaatatcttccggggctcttacctagctggtgccgggctgctctttagtattatgaagaacaccactaatacgcgaagaggaacaggcaacatcggtgaaacccttggcgagaagtggaaatcgaggctgaatgccttgggaaagagcgagttccagatttataaaaagtccggaatccaggaggtcgatcgcactctggcgaaagagggcataaagagaggggaaaccgaccatcacgctgtgtctagaggatcagcaaaactccgttggtttgtcgagaggaacatggtgacaccagaaggcaaggttgtggatctgggttgcgggcggggaggctggagctactattgtggtggcttaaagaacgtacgcgaggtgaaagggcttactaagggaggccctgggcatgaagaacccatccctatgtccacctacggatggaatctggtccgactccaaagtggcgttgacgtgttcttcacaccacccgagaaatgcgatacgctactgtgtgacattggtgaatctagccctaacccaaccatcgaggccgggagaactttgagggtcctgaatctcgtggaaaactggcttaataacaatacacagttttgcattaaggtactgaacccctatatgccgtcagtgatcgagaaaatggaaaccttgcagcggaagtacggaggcgctctggttcgcaatcctctctccagaaacagtactcacgagatgtactgggtgagcaatgccacaggcaacatagtctcttccgtgaatatgatttcaaggatgttaatcaaccgattcaccatgaagcacaaaaaggcaacgtatgagccagatgtcgacctggggagcggaacccggaatatcggtattgaatcggagatacccaaccttgacatcattggcaaacgtatcgaaaagattaaacaggagcatgaaacatcttggcactacgatcaagaccatccttataagacttgggcctaccacgggagttatgagaccaagcagacaggatccgctagctcaatggtgaacggcgttgtaagactgctaactaaaccatgggatgtggtccccatggtgacccagatggcgatgacagacaccactccgtttggtcagcaacgcgttttcaaggagaaagtggatacgaggacacaggaacctaaggaggggaccaaaaagctcatgaagatcactgccgaatggctgtggaaagagttgggaaagaaaaagacaccccggatgtgtacaagagaggaatttacgcgcaaagtcaggtccaatgcagctctgggcgccatattcaccgacgagaacaagtggaaatctgcacgagaagccgtggaggatagccggttttgggaactcatcgacagagagaggaatcttcacctggagggcaagtgcgaaacttgtgtatacaacatgatggggaagcgcgagaaaaagttaggagagttcggtaaagctaagggcagtcgtgccatttggtatatgtggctgggggcgcggtttttggagttcgaagcactcggatttctgaatgaggatcattggttctccagaggcaacagcctatctggtgtggagggggaaggacttcacaggctgggctacatcctccgcgacgttagcaaaaaggagggcggggccatgtacgctgatgacacagccggatgggacacccgaattactctggaagatttgaagaatgaggaaatggtcacaaaccatatgaaaggtgagcacaagaaactggcagaggctatctttaagctcacctatcagaataaagtggtgcgggtccagagaccaacacctaggggcactgttatggacattataagtcgcagagatcaacgggggtccggacaggtgggcacctacggtcttaacacgttcaccaatatggaagcccagctgatcaggcaaatggagggggaaggaattttcaagagcatccagcatttaacagtaactgaggagatcgctgtgcagaactggctggcccgtgtcggccgagaacgcttgtctagaatggcaatttcgggcgacgattgcgtggttaagcccctcgacgatcggtttgcgtcagccctgaccgctctaaatgacatggggaaagtgaggaaggatatacagcaatgggagccaagccgcggatggaacgactggacacaggtccccttctgctcccaccactttcatgaacttgtgatgaaagatggtagagtactggttgtgccttgtcggaatcaggacgagctcatcggcagggcccgaattagtcagggggcaggatggtctctgaaggaaactgcttgcttgggcaaaagctatgcccaaatgtggaccttaatgtacttccaccgtagagatctgcgcctcgcagccaacgcgatctgttccgctgtcccatcacattgggtgccgacgagtcggacaacctggtctattcacgccaagcacgagtggatgactacagaggacatgcttgcagtgtggaacagggtctggatccaggaaaatccctggatggaggacaagacccctgttgaaagctgggaggaagtgccatatctgggtaaaagagaggatcagtggtgcgggtccctaataggactgacttcacgcgccacctgggctaagaacatccagacagccattaatcaagtacggagcctcatcggcaacgaggaatacacggactatatgccctctatgaaaaggtttcgaagagaggaagaggaagcaggcgtgttgtggtga

SEQ ID NO: 14663 - RNA, 9876 nt, synthetic construct
  misc_feature 1..9876: note = derived and/or modified CDS sequence (opt3) from DENV-2__EU569708__SS-prME
  source 1..9876: mol_type = other RNA
accgccggcgtgatcattatgctgataccaacggctatggctttccacctcactacgagaaacggggaacctcatatgatcgtcggaaggcaggaaaagggtaaaagccttctgtttaagaccgaagacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcgccatcatggcagccattttggcttacacaatcggcaccacgcactttcagcgcgcactcattttcatcctgctgactgccgttgctccatccatgacaatgagatgcatagggatttctaacagggattttgtggaaggagtctcgggtggctcatgggtggacatcgtactcgagcacgggagctgtgttaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaagaacaggacaaacgatttatctgcaagcattctatggtggatagaggctggggtaacgggtgtggacttttcggcaagggcgggattgtcacttgcgctatgtttacctgcaaaaagaatatggaaggaaaagtggtgctccctgagaacctggaatacacaatagtcatcaccccacacagcggtgaggagcatgccgttggcaatgacactgggaagcacggaaaagaaattaagatcacgccgcagtcctcaataacagaggcagaacttaccggctatggtactgtgaccatggagtgtagtcccaggacagggctggatttcaacgaaatggtattgctccagatggaggagaaggcttggctggtgcaccggcaatggtttttagacctgcctctcccatggcttcccggcgccgatacccagggaagcaattggattcagaaggaaactctggtcacattcaagaaccctcatgcgaaaaagcaggacgtggttgtgttgggctctcaagagggggccatgcacacggcactaaccggagctactgaaatccagatgtcctcaggtaatctgctctttacaggccatctgaaatgccgtcttcgcatggacaagctgcagttgaaagggatgagctacagtatgtgtaccggaaagttcaagatcgtcaaagagattgccgagacacaacacggcactatcgtgattagagtacagtatgaaggtgatgggtctccatgcaagatacccttcgagatcatggacctcgagaagaggcatgttctgggccggttaattaccgtgaacccgatcgtcacggagaaggattcccctgtgaacatcgaagctgagcccccatttggagacagctacattataatcggcgtcgagcctgggcagctgaaactaaattggttcaagaagggatcgtctattggtcagatgtttgaaaccacaatgcgaggcgccaaacgcatggcaatcctcggggatactgcctgggacttcggatccctgggcggtgtgtttacctcaattgggaaggcacttcaccaagttttcggcgcgatctacggagcagcctttagtggcgtgagctggacaatgaaaatattgatcggggtaattatcacttggattggaatgaactccagatctaccagcctgtcagtcagtctcgtgctggttggcgtggtcacgctttatctgggtgctatggtgcaggccgattccgggtgtgtagtgagctggaagaataaagagttgaagtgcggatctggcatcttcataacagacaacgttcacacctggactgaacagtacaagtttcagcccgagtcaccaagtaaactcgcaagcgccattcaaaaggctcatgaagagggtatctgtggcattaggtccgtcacacggctggagaatttaatgtggaaacagatcacccccgaactgaaccacatactatctgagaatgaagtgaagctcactatcattaccggggatatcaaaggaattatgcaggccggcaagcgctcgctgagacctcagccaacagagcttaaatatagctggaagacgtgggggaaggcaaaaatgttgtccaccgaatcacataaccaaactttcctgatcgacggaccggagacagcggagtgccccaataccaacagggcttggaatagtctcgaagtggaggattacggctttggtgtcttcacaactaacatatggctgaagttacgtgaaaaacaggacgtattttgtgactctaagctgatgagcgccgcaattaaagataatcgggccgtgcacgctgacatggggtattggatcgagtccgcccttaacgatacctggaagatggagaaggcatcattcatcgaagtgaaaagctgccactggcctaagtctcatacgttgtggtccaatggagtactcgagagtgaaatgattatccccaaaaatttcgctggccccgtcagccagcacaactaccgacctggttatcatacacagaccgccggcccatggcacctggggaagctagagatggactttgatttctgtgaaggaactaccgtggttgtgacagaggactgcggcaatagagggccctctctgaggactaccacagcgtccggaaaactcattacggagtggtgctgtcgctcatgcaccctgccgcctcttcggtacagaggcgaagatggttgttggtacgggatggagataaggccattgaaggaaaaggaggaaaacctggtcaatagtttagtgactgccggacatggccaaatcgacaactttagcctcggtgttctgggcatggctcttttcctggaggagatgttgcgcacacgagtggggaccaaacacgcaattctcctggtagccgtctcgtttgtgactctaatcacaggaaatatgtccttccgggatctgggccgtgtgatggtcatggttggggctaccatgacggacgatattggaatgggcgtgacttatctcgccctgcttgcagcgtttaaggtaagacccaccttcgccgctggtttgctgttaaggaaactcacatctaaggaactgatgatggccaccatcgggatagcacttctgagccagtcaactatccctgagacaattctagaactcaccgacgctctggccttgggaatgatggtgctgaaaatcgtccgcaacatggagaagtaccagttagcagtgacaattatggccatcagttgcgttcccaatgctgtgatactcctgaacgcgtggaaggtctcctgtactattcttgccgcagtgtctgttagcccactgttgctcacctcctcacaacagaaaacggattggatccctctggctctaacaatcaagggcctgaatcccaccgccatttttcttactaccctcagccggacaagtaaaaagagatcttggccactgaacgaagccgtgatggctgtcggcatggtatccatattggcaagctcgctgctcaaaaatgacatcccgatgactgggcctctagtggccggaggtctgcttaccgtttgctatgtgctgacgggcaggtcagcggacttggagctcgagcgagctgccgatgtcaagtgggaagaccaggcagagatttctgggagttcccccatcctgagcgtgacaatttctgaagatggaagcatgtccatcaaaaacgaggaggaagaacagaccctaactatactgatccgcacaggccttctcgtaatttcaggtgtgttcccagtcagtatccccattaccgccgctgcatggtacctgtgggaagttaagaagcaacgggccggggtgttgtgggacgtgcctagcccaccccctgtcggaaaagcggagttagaagatggcgcttatagaatcaagcagaggggcatactggggtactctcagattggagccggtgtgtataaagagggcacttttcacacaatgtggcatgttacccgtggggcagtactcatgcaccgcggaaagcggatcgagccgtcctgggccgacgtgaaaaaggatctgatctcatacggcggtgggtggaaacttgaaggagagtggaaagaaggcgaggaagtccaggtgctggctttggagccaggcaagaatcccagagccgttcaaacgaaacctgggctattcaagactaacaccggaacaattggtgcagtgagtctggactttagcccaggcacctccgggtctcccatcgtcgataggaaaggaaaggtggtaggcctctacggtaatggggtcgtgacacgatcgggagcttatgttagcgccatagcgcagactgagaagtcaattgaagacaaccctgagatcgaagatgacattttccggaaaaagcgcctgaccatcatggatcttcatccgggcgccggcaaaacgaagagatacttacccgcaatagtgagggaggctattaaacgggggctgcgaacactcatcttggccccaactagagtcgtggctgcagaaatggaggaggccctgcgcggactccctatcaggtatcagacccccgccattcgtgctgaacacacaggtcgggagatcgttgacctgatgtgtcatgcgaccttcactatgagacttctgtccccagtgagggtccctaactacaatttgattataatggacgaagcacactttaccgatcccgccagtatcgctgcccgcggctatatttctacacgagtggagatgggggaggcagccggaatcttcatgacggctactccaccgggcagcagagacccttttccccagtccaacgcgccaatcatggatgaagaacgggaaattcccgagaggtcatggaactctggtcacgaatgggtaaccgacttcaaggggaagacagtgtggtttgttcctagcataaaagccggaaacgatatcgcagcttgcctacgcaagaatggcaaaaaggtcattcaactgagtcgtaaaaccttcgactccgagtacgtgaagactagagccaacgattgggactttgtggtcacaaccgatatcagcgagatgggcgcaaatttccgggccgaaagggtaattgacccacgccgatgtatgaagcccgtgatcctcacggatggggaggaaagagttatattagctggacctatgccggtgactcattcttcagccgcgcagcggaggggtcgcatcggcagaaaccccaaaaatgagaacgaccagtatatttacatgggggaaccactggagaatgacgaggattgcgcacactggaaggaagccaaaatgcttctggacaacatcaatacacctgagggaattatcccctccatgtttgaaccagagagggaaaaggtcgatgctatagacggcgagtaccggctccgtggtgaggcccgcaaaaccttcgtggatttgatgcgaagaggggacctgcctgtttggctcgcttatagggtggcagccgaaggcattaactacgctgatcggcgctggtgttttgacggaatcaagaataaccaaattctggaggaaaacgtcgaggtggagatctggaccaaagaaggcgagagaaagaaacttaaacccaggtggctagatgcccggatatatagtgacccactggcattgaaggagttcaaagagttcgcggccgggcgaaagagcttaactctgaatctcatcacagaaatgggaagactgcctacctttatgacacagaaagctcgcgatgcccttgacaacctggcagtactccatactgctgaggccggtggcagggcatacaatcacgccttgtcggagctgccggaaacgctagagaccctgctccttctgacattattggctactgtgaccgggggaattttcctgtttctcatgtctggcaagggtatcgggaagatgacactgggcatgtgctgcattatcaccgcgtccatacttctgtggtatgcccagattcagccccactggatcgcagctagcatcattctcgagttctttttgatcgttctgttaataccagagcctgaaaaacaacggactccccaggataaccagctaacgtacgtcgtgattgccatcctgaccgtggtcgccgcaacaatggctaatgagatgggattcctcgagaagactaaaaaggaccttggcctggggtcaattaccacacaggaaagtgagtctaacatcttggacatagatctgcgtccagcctccgcgtggaccctctatgctgttgccactacatttgtgacgcctatgctgagacatagcatcgaaaattcaagtgtaaacgtgagccttaccgcaattgccaatcaagctactgtcctcatgggactgggtaaaggctggcccttgtccaagatggacatcggggtgccgctgttagcaattggatgttactctcaggttaacccaatcacactaaccgccgcgctgctccttctggtggctcactacgccattatcggccctggtttgcaggcaaaggccaccagggaggctcagaaacgcgccgcagctgggataatgaagaatcccacagtcgatggcattactgtaatcgacctggaaccaatcccctatgatcctaaattcgagaagcaactcggacaggtgatgctgcttattttatgcgttacacaggtgctgatgatgcggaccacatgggccctctgtgaggcgttgactctggccaccggcccgataagcacactatgggaagggaaccccggacgattttggaataccactatcgcagtctccatggctaacattttcagaggctcatacctggccggtgcagggctcctattttctatcatgaaaaatacgacaaacaccaggcgcggaactggcaatattggtgagaccctgggcgaaaagtggaagagtcggttgaacgctctggggaaatcggagttccagatctataagaaaagcggaatacaagaggtggacagaacactcgccaaggaaggcatcaaacgtggggagactgatcatcacgccgtctccaggggatctgcgaagctgcggtggtttgtggaacgcaacatggttaccccagagggcaaagtggtagacttaggttgcgggcgaggaggctggtcatactattgtggtggccttaagaatgtgagagaagtcaaggggctgacaaaaggaggccctgggcatgaggagcccattcctatgagcacgtacggatggaacctcgttaggctacagtccggcgtggatgtcttcttcaccccacccgaaaagtgcgacactctgttgtgtgatatcggtgagagttctcctaatccaacaattgaagctgggcggaccctgcgcgtgctcaaccttgtagagaattggctgaacaataacactcagttttgcatcaaagtgttgaatccctatatgccgagcgttatagaaaagatggagacactgcaaagaaaatacggaggcgcactcgtgaggaaccctttatcacgaaattccacccacgagatgtactgggtcagtaacgccacgggcaatattgtgagctctgtcaacatgatctcccggatgctgatcaatcgtttcaccatgaagcacaagaaagctacatatgaaccagacgtggatcttgggtcaggaactagaaacattggtatagagagcgaaatccccaacctggacattatcggcaagcgcattgagaggatcaaacaggaacatgagacctcgtggcactacgaccaggatcatccttataagacatgggcctaccacgggtcttatgagactaaacagaccggaagtgcatccagcatggttaatggcgtagtgcggctactcacaaagccatgggacgtcgtgcccatggttacccaaatggccatgactgatacgacaccgtttggtcagcagagagtgttcaaggaaaaagtcgacacccgcactcaggagcctaaggaagggaccaaaaagctgatgaggataacagctgagtggttgtggaaagagctgggaaagaagaaaacgccccgaatgtgtacccgggaagagtttactagaaaggtgaggtcaaacgcggccctcggcgcagtattcacagatgaaaataaatggaagtccgctcgcgaggccgtggaagactctcgtttttgggagcttgttgatcgggagagaaacctgcacttagaaggcaaatgcgagacctgtgtctacaatatgatggggaagagggagaaaaagctgggagagttcggtaaggcaaaaggcagccgcgccatctggtatatgtggttgggggctcgatttctcgagttcgaggccctgggatttctaaacgaggaccattggttcagtcggagaaattcccttagcggcgtggaaggtgaggggctgcacaggctcggatacattctgcgcgatgtgtctaagaaagaaggcggcgcgatgtacgcagacgatactgccgggtgggacacaagaatcaccttggaggacctgaagaacgaagagatggtcacaaatcatatgaaaggagagcacaagaagctcgctgaagccatttttaaacttacttatcaaaacaaggttgtgcgggtacagaggccaacccctcgtggtacggtgatggatatcatttcacgacgcgaccagagaggcagtgggcaggtcggaacctacggcctgaatacattcactaacatggaggcacaattaatacggcagatggaaggtgaggggatcttcaaatccattcagcatctgaccgtgacagaggaaatcgctgttcaaaattggttggccagggtgggacgcgagagactcagccggatggctatctctggcgatgactgcgtcgtgaagcccctggatgacaggtttgcctcggcactaactgcgcttaacgatatgggcaaagtacgaaaggacattcagcagtgggaaccatcacgtgggtggaatgattggacccaggttcccttctgcagccaccactttcatgagctggtgatgaaggacggaagagtcctcgtggtgccttgtcgcaaccaagatgaactgataggtcgggccaggatctcccagggcgctgggtggagtttgaaagagacggcctgcttaggaaagtcttatgcacagatgtggacactgatgtacttccacagacgcgacctccggcttgctgccaacgcaatttgtagcgccgtcccatcccattgggttccgacctcaaggactacatggagtatccacgcgaaacacgagtggatgaccactgaagatatgctggctgtgtggaatcgagtatggattcaggagaacccctggatggaagacaagacccctgtggagtcttgggaagaggtcccatatctaggcaaaagagaggaccaatggtgcggtagcctgatcgggctcacatcccgggccacgtgggcaaagaatatacagaccgccatcaaccaggtgaggtcattgattggaaatgaagagtacactgattatatgcccagcatgaagcgctttcgtagagaagaggaagaggctggcgttctgtggtga

SEQ ID NO: 14664 - RNA, 9876 nt, synthetic construct
  misc_feature 1..9876: note = derived and/or modified CDS sequence (opt3) from DENV-2__EU569709__SS-prME
  source 1..9876: mol_type = other RNA
accgccggcgtgatcattatgctgatacccaccgctatggcattccacctcactacgaggaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgtgcagaggatcgagacctggattctgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttatctgcaagcattctatggtggatagaggctggggtaacgggtgtggattattcggcaagggcgggattgtcacatgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctgactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggtacgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcatcaagttttcggcgctatctatggagcggcatttagtggcgtgagctggactatgaaaatattgatcggggtaattatcacctggattggaatgaactccagatctacgagcctgtcagtcagtctcgtgctggttggcgtggtcacactttacctgggtgtgatggtacaggccgactccgggtgtgtggttagctggaagaataaagaattgaagtgcggatctggcatcttcataaccgataacgtccacacttggacagagcagtataagtttcagcccgaatcaccaagtaaactcgctagcgccattcaaaaggcacacgaggaaggtatctgtggcattaggtccgtgacccggctggagaatttaatgtggaaacagatcactcccgagctgaaccatatactatctgaaaatgaggtgaagctcaccatcatgacaggggacattaaaggaatcatgcaggccggcaagcgctcgctgagacctcagccaacggaacttaaatacagctggaagacctgggggaaggctaaaatgttgtccactgagtcacacaaccaaacattcctgattgatggaccggaaaccgccgagtgccccaatacaaacagggcatggaatagtctcgaggtcgaagactatggctttggtgttttctctactaacatctggctgaagttacgtgagaaacaggacgtgttttgtgatagcaagctgatgtccgcggctataaaagacaatcgggccgtgcatgcagatatggggtactggattgaatcagcccttaacgacacctggaagatggagaaggctagcttcatcgaggtaaaatcttgccactggcctaagtcccacacgttgtggagtaatggagtcctcgaaagcgagatgatcattcccaaaaatttcgccggccccgtgtctcagcataactatcgacctggttaccacacacagaccgcaggcccatggcatctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtatgggatggaaattaggccattgaaggagaaggaagagaacctggtgaatagcttagttactgccggacacggccaaatagataacttttcgctcggtgtgctgggcatggcgcttttcctggaagagatgttgcgcacacgagtagggaccaaacatgccatcctcctggtcgctgtgtcctttgtgactctaattacaggaaatatgtctttccgggacctgggccgtgtcatggttatggtgggggcaaccatgacggatgacatcggaatgggcgtaacttacctcgccctgcttgctgcctttaaggtgagacccaccttcgcagcgggtttgctgttaaggaaactcacaagcaaggagctgatgatggccaccattgggatcgcacttctgtcacagagtactatacctgaaacaatcctagagctcaccgatgccctggcattgggaatgatggtcctgaaaattgtgcgcaacatggaaaagtatcagttagctgttacaatcatggccattctctgcgtgcccaatgcagtcatcctgcaaaacgcctggaaggtgtcctgtactatacttgctgcggtttctgtgagcccactgttgctcacctcctcacagcagaaagccgactggattcctctggcactaacgatcaagggcctgaatcccacagctatctttcttaccactctcagccggaccagtaaaaagagatcttggccactgaacgaggccgtcatggccgtaggcatggtgtccattttggctagctcgctgctcaaaaatgacataccgatgacagggcctctagttgcaggaggtctgcttactgtgtgctacgtcctgaccggcaggtcagccgatttggaactcgagcgagcggctgacgtgaagtgggaggatcaggccgaaatctctgggagttcccccattctgagcatcacgatttctgaggacggaagcatgtccatcaaaaacgaagaggaggaacaaacactaaccatactgatccgcactggccttctcgtaatttcaggtgtgttcccagtcagtatccccattacagcagccgcttggtatctgtgggaggttaagaagcagcgggcaggggtgttgtgggatgtgcctagcccaccccctgtcggaaaagccgaattagaggacggcgcgtacagaatcaagcagaggggcatatttgggtattctcagattggagctggtgtgtacaaagaaggcaccttccacactatgtggcacgttacacgtggggccgtactgatgcatcgcggaaagcggatcgagccgtcctgggcagatgtgaaaaaggacctcatctcatacggcggtgggtggaagctggagggagaatggaaagagggcgaagaggtccaagtgcttgccctggaaccaggcaagaatcccagagctgttcagaccaaacctgggttgtttaagacgaacactggaaccattggtgccgtgagtctagatttcagcccaggcacatccgggtctcccatcgtcgacaggaaaggaaaggtggtaggcctgtatggtaatggggtcgtgacccgatcgggagcatacgttagcgctatagcccagacagagaagtcaattgaggataaccctgaaatcgaggacgatattttccggaaaaagcgcctcactatcatggacctgcacccgggcgcgggcaaaaccaagagatatcttcccgccatagtgagggaagcaattaaacgggggttacgaacgctgatcctcgctccaacaagagtcgtggccgctgagatggaagaggcattgcgcggactgcctatcaggtaccagactcccgccattcgtgccgagcataccggtcgggaaatcgttgacctcatgtgtcacgctacatttaccatgagactgctttccccagtgagggtccctaactataatctgattataatggatgaggcgcatttcactgaccccgcaagtatcgccgctcgcggctacatttctacccgagtggaaatgggggaggccgcaggaatctttatgacagccacgccaccgggcagcagagatcctttcccccaatccaacgctccaatcatggacgaggaacgggagattcccgaaaggtcatggaactctggtcacgagtgggtaactgattttaaggggaagaccgtgtggttcgttcctagcataaaagcgggaaacgacatcgccgcatgcttgcgcaagaatggcaaaaaggtcattcagctaagtcgtaaaacatttgattccgaatatgtgaagaccagagctaacgactgggatttcgtggtcactacagacatcagcgagatgggcgccaattttcgggcagagagggtaattgatccacgccgatgtatgaagcccgtgatcctgaccgacggggaagagagagttatactcgccggacctatgccggtgacgcactcttcagctgcccagcggaggggtcgcatcggcagaaaccccaaaaatgaaaacgaccaatacatttacatgggggagcccttagaaaatgatgaggactgcgcgcattggaaggaggcaaaaatgctgcttgataacatcaatactcctgaaggaattatcccctccatgttcgagccagaaagggagaaggtcgacgccatagatggcgaatatcggctgcgtggtgaggctcgcaaaacatttgtggacctcatgcgaagaggggatttgcctgtttggctggcctacagggtggctgcagagggcattaactatgccgaccggcgctggtgtttcgatggaatcaagaataaccagattctcgaagagaacgtcgaagtggagatctggaccaaagagggcgaaagaaagaagctgaaacccaggtggcttgacgctcggatatacagtgatccactagccctgaaggagttcaaagaatttgcagcggggcgaaagagcttgaccttaaatctgatcactgagatgggaagactccctacattcatgacccagaaagcccgcgacgctctggataaccttgccgtactgcacacagcagaagtgggtggcagggcttataatcatgccctctcggagttgccggagactctggaaacgctactgctccttaccctgttagcaacagttactgggggaatatttttgttcctgatgtctggcaagggtatcgggaagatgaccctcggcatgtgctgcattatcacagcctccatactgctttggtacgctcagattcaaccccactggatcgcggccagcatcattctggagtttttcctcatcgtcttgctgataccagaacctgagaaacagcggaccccacaggacaaccagttaacttatgtggtgattgcaatcctaacggtcgttgctgccaccatggccaatgaaatgggatttctggagaagaccaaaaaggacctcggccttgggtcaattatcactcaagagagtgaatctaacatactggatatcgacttgcgtccagcatccgcttggaccctgtacgccgtggcgacaaccttcgtaactcctatgctcagacacagcattgaaaattcaagtgtgaacgtcagcctgacagctatcgccaatcaggcaacggtgcttatgggactcggtaggggctggcccctgtccaaaatggatattggggttccgttgctggccatcggatgttactctcaggtgaacccaattaccttaactgctgcactactgctccttgtcgcccattatgcgatcataggccctggtctgcaggctaaggccacacgcgaagcacaaaagcgggccgctgccgggattatgaaaaatcccaccgtagacggcatcaccgtgatcgatttggagccaattccctacgaccctaagtttgaaaaacagctgggacaggttatgctcctggtgctttgcgtcacacaggtgttaatgatgcgaactacgtgggcactgtgtgaggctctcaccttggccacaggcccgataagcactctgtgggaggggaaccccggaagattctggaataccacaatcgcggtctccatggccaacatttttaggggctcatatctagctggtgctgggctactcttctctatcatgaagaataccactaacacgcgccggggaacaggcaatattggtgaaacccttggcgagaaatggaagagtagactgaacgccttggggaagtcggaatttcaaatctacaaaaagagcggaatacaggaggtggatcgtactctggcaaaagagggcatcaagagaggggaaaccgaccaccatgctgtttcccggggatctgccaaactccgctggttcgtggagcgaaacatggtaacaccagaaggcaaggtggtcgatctgggttgcgggagaggaggctggtcatattactgtggtggccttaaaaatgttagggaggtgaaggggctaactaagggaggccctgggcacgaggaaccaattcctatgagcacctatggatggaacctggtccggctccagtccggcgtggacgtattctttacaccacccgagaaatgcgatacgctactgtgtgacatcggtgaaagttctcctaatccaaccattgaggccgggcgcactttgagagtgctgaacctcgttgaaaattggcttaacaataacacacaattctgcatcaaggtgctgaatccctacatgccgagcgtcatagagaaaatggaaaccttgcagaggaagtacggaggcgcgctggtgcgaaaccctctctcaagaaattccactcatgagatgtattgggtcagtaacgctacaggcaatattgtgagctctgttaacatgatctcccgtatgttaatcaatagatttaccatgaaacacaagaaggcaacgtacgagccagatgtagacctggggtcaggaacccgcaacattggtatagaaaacgagatccccaatcttgacattatcggcaaaaggattgaaaagatcaaacaggagcacgaaacaagctggcattatgatcaggaccacccttacaagacttgggcctatcatgggtcgtacgagaccaaacaaacaggatctgctagttccatggtgaacggcgtcgtgcggctgctaactaagccatgggatgttgtgcccatggtcacccagatggccatgacagacaccactccgttcggtcagcagagagtgtttaaggagaaagtagatacgcgcacacaagaacctaaggaggggaccaaaaagctcatgaggataactgcagaatggctgtggaaagagttgggaaagaagaaaacaccccgaatgtgtacacgggaggagttcacgagaaaggtgaggagcaatgccgctctgggcgcgatctttaccgacgagaacaaatggaagtcagcccgcgaagcagttgaggattcccgtttctgggaactcgtcgaccgggagagaaatcttcacctggagggcaaatgcgaaacttgtgtgtataacatgatggggaagagggagaaaaagttaggagaatttggtaaggctaaaggctctcgcgccatttggtacatgtggctgggggcacgattcttggagtttgaagccctcggattcctgaatgaggatcactggtttagccggggcaacagtctatccggtgtggagggggaaggacttcataagctgggctacatcctcagagacgtcagcaaaaaggagggcggggctatgtatgccgatgacacagcgggatgggacaccaggattactctggaagatttgaaaaatgaggaaatggttacaaaccacatgaagggtgagcataagaaactggcagaggccatcttcaagctcacctaccagaataaagtggtacgcgtgcagagaccaacacctcggggcactgtcatggacattatatctaggaaggatcagcgtgggtcaggacaagtgggcacctatggtcttaacacgttcaccaatatggaagctcagctgatccgacagatggagggggaaggaatttttaaaagtatccaacacttaacagttactgaggagatcgccgtgcagaactggctggcacgcgtcggcagagaacggttgtccaggatggctattagcggcgacgattgcgtggtaaagcccctcgacgatcgcttcgcctctgctctgaccgccctaaatgacatggggaaggttagaaaagatatacagcagtgggagccatcgcggggatggaacgactggacacaagtgcccttttgctcacatcacttccacgaacttgtcatgaaggatggtagggtgctggtggtcccttgtcgaaaccaggacgagctcatcggccgtgcaagaattagccagggggcgggatggtccctgaaagaaactgcctgcttgggcaagagttacgctcagatgtggaccttaatgtattttcatcgccgggatctgaggctcgccgcaaatgctatctgttctgccgttccaagccactgggtgccgacgtccagaacaacctggtcaattcatgcaaaacacgagtggatgactacagaggacatgcttgccgtatggaaccgcgtgtggatccaagaaaatccctggatggaggacaagacccctgtcgaaagttgggaggaagtgccatacctgggtaagcgggaggatcagtggtgcgggtctctaataggactgactagcagggcgacctgggctaaaaacatccagacagccattaatcaggttcgatccctcatcggcaacgaggaatatacggactacatgccctcaatgaagagattccggaaagaggaagaggaagcaggcgtgttgtggtga

SEQ ID NO: 14665 - RNA, 9876 nt, synthetic construct
  misc_feature 1..9876: note = derived and/or modified CDS sequence (opt3) from DENV-2__EU596485__SS-prME
  source 1..9876: mol_type = other RNA
accgcaggcgtgatcattatgctgataccaacagctatggctttccacctcactacgagaaacggggaacctcatatgatcgtcgggaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtcgcgctggtgccacatgtcggtatggggcttgagaccagaacagaaacttggatgagtagcgagggagcttggaaacacgtgcagaggatcgagacctggattctgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggactattcggcaagggcgggattgtaacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgattcacataaccaaacattcctgattgacggaccggagaccgccgaatgccccaatacaaacagggcatggaatagtctcgaggtcgaggactacggctttggtgttttctctactaacatctggctgaagttacgtgaaaaacaggatgtgttttgtgacagcaagctgatgtccgcggctataaaagataatcgggccgtgcacgcagacatggggtattggattgagtcagcccttaacgatacctggaagatggaaaaggctagcttcatcgaggtaaaatcttgccactggcctaagtcccatacgttgtggagtaatggagtcctcgagagcgaaatgatcattcccaagaacttcgccggccccgtgtctcagcacaactaccgacctggttatcatacacagaccgcaggcccatggcacctggggaagctagagatggactttgatttctgtgaaggaactaccgttgtggtcacagaggactgcggcaatagagggccctccctgaggactaccacagcttcaggaaaactcatcacggaatggtgctgtcgcagttgcaccctgccgcctcttcggtacagaggcgaggatggttgttggtacgggatggagattaggccattgaaggaaaaggaggaaaacctggtgaatagcttagttactgccggacatggccaaatagacaacttttcgctcggtgtgctgggcatggcgcttttcctggaggaaatgttgcgcacacgagtagggaccaaacacgccatcctcctggtcgctgtgtcctttgtgactctaattacaggaaatatgtctttccgggatctgggccgtgtcatggttatggtgggggcaaccatgacggacgatatcggaatgggcgtaacttatctcgccctgcttgctgcctttaaggtgagacccaccttcgcagcgggtttgctgttaaggaaactcacaagcaaggagctgatgatggccaccattgggatcgcacttctgtcacagagtactatacctgagacaatcctagaactcaccgacgccctggcattgggaatgatggtcctgaaaattgtgcgcaacatggagaagtaccagttagctgttacaatcatggccatttcctgcgtgcccaatgcagtcatcctccaaaacgcctggaaggtgtcttgtactatactggctgcggttagcgtgtccccacttctgttgacctcaagccagcagaaagccgactggattcctctcgcactgacgatcaagggcctaaatcccacagctatctttctgaccactcttagtcggacctctaaaaagagatcctggccactcaacgaagccgtcatggccgtaggcatggtgagcattctggcttcgtcattgctgaaaaatgatataccgatgacagggcctttagttgcaggaggtctcctgactgtgtgctatgtccttaccggcaggtctgccgacctggagttggaacgagcggctgatgtgaagtgggaggaccaggccgagatcagtgggtccagccccattctctctatcacgattagcgaagatggatccatgtcaatcaaaaacgaggaagaggagcaaacactgaccatactaatccgcactggcctgcttgtaattagtggtgtgttcccagtcagcatccccattacagcagccgcttggtacctctgggaagttaagaagcagcgggcaggggtgctgtgggacgtgccttctccaccccctgtcggaaaagccgagttggaagatggcgcgtatagaatcaagcagaggggcatatttgggtactcccagattggagctggtgtgtataaagagggcaccttccacactatgtggcatgttacacgtggggccgtattaatgcaccgcggaaagcggatcgaaccgtcatgggcagacgtgaaaaaggatctgatcagttacggcggtgggtggaagctcgagggagagtggaaagaaggcgaggaagtccaagtgctggcccttgagccaggcaagaatcccagagctgttcagaccaaacctgggctgtttaagacgaacactggaaccattggtgccgtgagcttggacttctccccaggcacatctgggtcgcccatcgtcgataggaaaggaaaggtggtaggcctatacggtaatggggtcgtgacccgaagcggagcatatgtttcagctatagcccagacagaaaagtccattgaggacaaccctgagatcgaagatgacattttccggaaaaagcgcctgactatcatggacctccatccgggcgcgggcaaaaccaagagatacctgcccgccatagtgagggaggcaattaaacgggggcttcgaacgttaatcctggctccaacaagagtcgtggccgctgaaatggaggaagcactccgcggattgcctatcaggtatcagactcccgccattcgtgccgagcacaccggtcgggagatcgttgatctgatgtgtcatgctacatttaccatgagactcctgagtccagtgagggtccctaactacaatcttattataatggacgaagcgcacttcactgatcccgcatctatcgccgctcgcggctatattagcacccgagtggagatgggggaagccgcaggaatctttatgacagccacgccaccgggctccagagaccctttcccccaatcaaacgctccaatcatggatgaggagcgggaaattcccgagaggtcttggaatagcggtcacgaatgggtaactgactttaaggggaagaccgtgtggttcgttcctagtataaaagcgggaaacgatatcgccgcatgcctgcgcaagaatggcaaaaaggtcattcagttgtcccgtaaaacatttgacagcgagtacgtgaagaccagagctaacgattgggacttcgtggtcactacagatatctctgaaatgggcgccaattttcgggcagagagggtaattgacccacgccgatgtatgaagcccgtgatcctaaccgacggggaggaaagagttatactggccggacctatgccggtgacgcattcatccgctgcccagcggaggggtcgcatcggcagaaaccccaaaaatgagaacgatcaatatatttacatgggggaacccctcgagaatgacgaagattgcgcgcactggaaggaggcaaaaatgttactggacaacatcaatactcctgagggaattatccccagtatgttcgaaccagagagggaaaaggtcgatgccatagacggcgagtaccggcttcgtggtgaagctcgcaaaacatttgtggatctgatgcgaagaggggacctccctgtttggttggcctatagggtggctgcagagggcattaactacgccgatcggcgctggtgtttcgacggaatcaagaataaccagattctggaggaaaacgtcgaggtggaaatctggaccaaagagggcgagagaaagaagctcaaacccaggtggctggatgctcggatatatagcgacccacttgccctaaaggagttcaaagagtttgcagcggggcgaaagtcgctgaccttgaatttaatcactgaaatgggaagactgcctacattcatgacccagaaagcccgcgatgctctcgacaacctggccgtacttcatacagcagaggtgggtggcagggcttacaatcacgccctgtctgaactcccggagactttggagacgctgctactgctcacccttctggcagccgttacagggggaatatttttattcttgatgtccggcaagggtatcgggaagatgactctgggcatgtgctgcattatcaccgctagcatactcctgtggtatgcgcagattcaaccccactggatcgccgcatcaatcattcttgaatttttcctgatcgtcctcttgataccagagcctgaaaaacagcggacaccccaggacaaccagctgacctacgtggtgattgctatcttaactgtcgttgccgccacgatggcaaatgagatgggatttctagaaaagaccaaaaaggatctgggcctcgggagtattatcacacaagagtctgagtccaacatacttgacatcgatctgcgtccagctagcgcctggactttgtatgcggtggctaccacattcgtaacccctatgctgagacattcaattgaaaatagtagcgtgaacgtctccctcactgccatcgcaaatcaggccacagtgctgatgggacttggtaggggctggcccctctctaaaatggacattggggttccgctgttggctatcggatgttacagccaggtgaacccaattacgctgaccgcagccttactactgctcgtcgcgcactacgctatcataggccctggtcttcaggccaaggcaactcgcgaggcccaaaagcgggctgccgcagggattatgaaaaatcccacagtagatggcatcaccgtgatcgacctggaaccaattccctatgatcctaagtttgagaaacagttgggacaggttatgctgctcgtgctgtgcgtcacccaggtgcttatgatgcgaacaacttgggctttatgtgaagccctgacgctcgcgaccggcccgatatccacattgtgggaggggaaccccggaagattctggaatactaccatcgccgtctcaatggcaaacatttttaggggctcttacctggctggtgccgggctactgttcagtatcatgaagaatacaaccaacactcgccggggaacgggcaatattggtgagacactcggcgaaaaatggaagtcgagacttaacgcactgggaaagagcgagtttcaaatctataaaaagtccggaatacaggaagtggaccgtaccttggctaaagagggcatcaagaggggagaaactgatcatcacgccgtttctcgggggtcagccaaactgcgctggttcgtggaacgaaacatggtaaccccagagggcaaggtggtcgacctcggttgcgggagaggaggctggagctactattgtggtggcctgaaaaatgttagggaagtgaaggggttaacaaagggaggccctgggcatgaggaacccattcctatgtccacttacggatggaaccttgtccggctgcagagtggcgtggatgtattctttaccccacccgagaaatgcgacacactcctatgtgatatcggtgagtctagccctaatccaacgattgaagcggggcgcaccctgagagtgttgaacctggttgagaattggctcaacaataacactcaattctgcatcaaggtgcttaatccctatatgccgtcagtcatagagaaaatggagacactgcagaggaagtacggaggcgctttggtgcgaaaccctctgtcccggaatagtacccacgaaatgtactgggtcagcaacgcaactggcaatattgtgtcttccgttaacatgatctcacgtatgctcatcaatagatttacaatgaaacacaagaaggccacctatgagccagacgtagacttagggagcggaacgcgcaacattggtatagagaacgaaatccccaatctggatattatcggcaaaaggattgagaagatcaaacaggaacatgagacctcgtggcactacgaccaggatcatccttataagacatgggcttaccacgggtcttatgaaactaaacaaaccggaagtgcctccagcatggtgaacggcgtcgtgcggcttctgacaaagccatgggacgttgtgcccatggtcactcagatggcaatgaccgatacaaccccgttcggtcagcagagagtgtttaaggagaaagtagacactcgcacgcaagagcctaaggaagggaccaaaaagctaatgaggataacagccgagtggctctggaaagaactgggaaagaagaaaactccccgaatgtgtacccgggaggagttcgctagaaaggtgaggtcaaatgcggccttgggcgcaatctttacagatgaaaacaaatggaagtccgctcgcgaggccgttgaagactctcgtttctgggagctggtcgatcgggaaagaaatctccaccttgagggcaaatgcgagacgtgtgtgtacaacatgatggggaagagggagaaaaagctgggagagtttggtaaggcaaaaggcagccgcgccatttggtatatgtggttaggggctcgattcctggaatttgaggccttgggattcctcaatgaagaccattggtttagtcggggcaactccctgagcggtgtggagggggagggactacacaaacttggctacatcctgagagatgtctctaaaaaggaaggcggggcgatgtacgcagacgacaccgccggatgggatactaggattacactcgaggacctgaaaaatgaagagatggttaccaaccatatgaagggtgaacacaagaaattggctgaggccatcttcaagctgacttatcagaataaagtggtacgcgtgcagagaccaacacctcggggcaccgtcatggatattatatcaaggaaggaccagcgtgggagtggacaagtgggcacatacggtctcaacactttcaccaatatggaggcacagcttatccgacagatggaaggggagggaatttttaaatccatccaacatctgacggttaccgaagagatcgctgtgcagaactggttagcccgcgtcggcagagagcggctgagcaggatggctatttctggcgatgactgcgtggtaaagcccttggatgaccgcttcgcctcggcactcacagcgctgaatgatatggggaaggttagaaaagacatacagcagtgggaaccatcacggggatggaacgattggactcaagtgcccttttgcagccaccacttccatgagctagtcatgaaggacggtagggtgcttgtggtcccttgtcgaaaccaggatgaactgatcggccgtgccagaatttcccagggggctggatggagtctcaaagagaccgcctgcctgggcaagtcttatgcacagatgtggacattgatgtactttcaccgccgggacttaaggctggctgccaatgcaatctgtagcgccgttccatcccattgggtgccgacttcaagaaccacgtggagtattcacgcgaaacacgaatggatgacaaccgaggacatgctcgctgtatggaaccgcgtgtggatccaagagaatccctggatggaagataagactcctgtcgagtcttgggaagaggtgccatatcttggtaagcgggaagaccagtggtgcgggagcctgataggactaacatccagggccacctgggccaaaaacatccagactgccattaatcaggttcgatcactgatcggcaacgaggagtacaccgattatatgcccagcatgaagagattccggaaagaagaggaagaggctggcgtgctctggtga

SEQ ID NO: 14666 - RNA, 9876 nt, synthetic construct
  misc_feature 1..9876: note = derived and/or modified CDS sequence (opt3) from DENV-2__EU569710__SS-prME
  source 1..9876: mol_type = other RNA
accgccggcgtgatcattatgctgatacccaccgctatggcattccacctcactacgaggaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgtgcagaggatcgagacctggattctgcggcatcctggcttcacaatcatggccgcaattttggcctacaccatcggcacgactcactttcagcgcgctctcacattcattctgctgaccgcagttgccccatccatgactatgagatgcatcgggatatctaacagggattttgtggaaggagtctcgggtggctcatgggtggacattgtactcgagcacgggagctgtgttacaaccatggctaagaataagcccacgttagatttcgaactgatcaaaaccgaggccaagcagcctgcgattcttcggaaatattgcatcgaagcaaagttgacaaacactaccacagagagtcgctgtccaactcaaggagagccctccctgaatgaggaacaggacaaacgatttatctgcaagcattctatggtggatagaggctggggtaacgggtgtggattattcggcaagggcgggattgtcacatgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctgactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggtacgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcatcaagttttcggcgctatctatggagcggcatttagtggcgtgagctggactatgaaaatattgatcggggtaattatcacctggattggaatgaactccagatctacgagcctgtcagtcagtctcgtgctggttggcgtggtcacactttacctgggtgtgatggtacaggccgactccgggtgtgtggttagctggaagaataaagaattgaagtgcggatctggcatcttcataaccgataacgtccacacttggacagagcagtataagtttcagcccgaatcaccaagtaaactcgctagcgccattcaaaaggcacacgaggaaggtatctgtggcattaggtccgtgacccggctggagaatttaatgtggaaacagatcactcccgagctgaaccatatactatctgaaaatgaggtgaagctcaccatcatgacaggggacattaaaggaatcatgcaggccggcaagcgctcgctgagacctcagccaacggaacttaaatacagctggaagacctgggggaaggctaaaatgttgtccactgagtcacacaaccaaacattcctgattgatggaccggaaaccgccgagtgccccaatacaaacagggcatggaatagtctcgaggtcgaagactatggctttggtgttttctctactaacatctggctgaagttacgtgagaaacaggacgtgttttgtgatagcaagctgatgtccgcggctataaaagacaatcgggccgtgcatgcagatatggggtactggattgaatcagcccttaacgacacctggaagatggagaaggctagcttcatcgaggtaaaatcttgccactggcctaagtcccacacgttgtggagtaatggagtcctcgaaagcgagatgatcattcccaaaaatttcgccggccccgtgtctcagcataactatcgacctggttaccacacacagaccgcaggcccatggcatctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtatgggatggaaattaggccattgaaggagaaggaagagaacctggtgaatagcttagttactgccggacacggccaaatagataacttttcgctcggtgtgctgggcatggcgcttttcctggaagagatgttgcgcacacgagtagggaccaaacatgccatcctcctggtcgctgtgtcctttgtgactctaattacaggaaatatgtctttccgggacctgggccgtgtcatggttatggtgggggcaaccatgacggatgacatcggaatgggcgtaacttacctcgccctgcttgctgcctttaaggtgagacccaccttcgcagcgggtttgctgttaaggaaactcacaagcaaggagctgatgatggccaccattgggatcgcacttctgtcacagagtactatacctgaaacaatcctagagctcaccgatgccctggcattgggaatgatggtcctgaaaattgtgcgcaacatggaaaagtatcagttagctgttacaatcatggccattctctgcgtgcccaatgcagtcatcctgcaaaacgcctggaaggtgtcctgtactatacttgctgcggtttctgtgagcccactgttgctcacctcctcacagcagaaagccgactggattcctctggcactaacgatcaagggcctgaatcccacagctatctttcttaccactctcagccggaccagtaaaaagagatcttggccactgaacgaggccgtcatggccgtaggcatggtgtccattttggctagctcgctgctcaaaaatgacataccgatgacagggcctctagttgcaggaggtctgcttactgtgtgctacgtcctgaccggcaggtcagccgatttggaactcgagcgagcggctgacgtgaagtgggaggatcaggccgaaatctctgggagttcccccattctgagcatcacgatttctgaggacggaagcatgtccatcaaaaacgaagaggaggaacaaacactaaccatactgatccgcactggccttctcgtaatttcaggtgtgttcccagtcagtatccccattacagcagccgcttggtatctgtgggaggttaagaagcagcgggcaggggtgttgtgggatgtgcctagcccaccccctgtcggaaaagccgaattagaggacggcgcgtacagaatcaagcagaggggcatatttgggtattctcagattggagctggtgtgtacaaagaaggcaccttccacactatgtggcacgttacacgtggggccgtactgatgcatcgcggaaagcggatcgagccgtcctgggcagatgtgaaaaaggacctcatctcatacggcggtgggtggaagctggagggagaatggaaagagggcgaagaggtccaagtgcttgccctggaaccaggcaagaatcccagagctgttcagaccaaacctgggttgtttaagacgaacactggaaccattggtgccgtgagtctagatttcagcccaggcacatccgggtctcccatcgtcgacaggaaaggaaaggtggtaggcctgtatggtaatggggtcgtgacccgatcgggagcatacgttagcgctatagcccagacagagaagtcaattgaggataaccctgaaatcgaggacgatattttccggaaaaagcgcctcactatcatggacctgcacccgggcgcgggcaaaaccaagagatatcttcccgccatagtgagggaagcaattaaacgggggttacgaacgctgatcctcgctccaacaagagtcgtggccgctgagatggaagaggcattgcgcggactgcctatcaggtaccagactcccgccattcgtgccgagcataccggtcgggaaatcgttgacctcatgtgtcacgctacatttaccatgagactgctttccccagtgagggtccctaactataatctgattataatggatgaggcgcatttcactgaccccgcaagtatcgccgctcgcggctacatttctacccgagtggaaatgggggaggccgcaggaatctttatgacagccacgccaccgggcagcagagatcctttcccccaatccaacgctccaatcatggacgaggaacgggagattcccgaaaggtcatggaactctggtcacgagtgggtaactgattttaaggggaagaccgtgtggttcgttcctagcataaaagcgggaaacgacatcgccgcatgcttgcgcaagaatggcaaaaaggtcattcagctaagtcgtaaaacatttgattccgaatatgtgaagaccagagctaacgactgggatttcgtggtcactacagacatcagcgagatgggcgccaattttcgggcagagagggtaattgatccacgccgatgtatgaagcccgtgatcctgaccgacggggaagagagagttatactcgccggacctatgccggtgacgcactcttcagctgcccagcggaggggtcgcatcggcagaaaccccaaaaatgaaaacgaccaatacatttacatgggggagcccttagaaaatgatgaggactgcgcgcattggaaggaggcaaaaatgctgcttgataacatcaatactcctgaaggaattatcccctccatgttcgagccagaaagggagaaggtcgacgccatagatggcgaatatcggctgcgtggtgaggctcgcaaaacatttgtggacctcatgcgaagaggggatttgcctgtttggctggcctacagggtggctgcagagggcattaactatgccgaccggcgctggtgtttcgatggaatcaagaataaccagattctcgaagagaacgtcgaagtggagatctggaccaaagagggcgaaagaaagaagctgaaacccaggtggcttgacgctcggatatacagtgatccactagccctgaaggagttcaaagaatttgcagcggggcgaaagagcttgaccttaaatctgatcactgagatgggaagactccctacattcatgacccagaaagcccgcgacgctctggataaccttgccgtactgcacacagcagaagtgggtggcagggcttataatcatgccctctcggagttgccggagactctggaaacgctactgctccttaccctgttagcaacagttactgggggaatatttttgttcctgatgtctggcaagggtatcgggaagatgaccctcggcatgtgctgcattatcacagcctccatactgctttggtacgctcagattcaaccccactggatcgcggccagcatcattctggagtttttcctcatcgtcttgctgataccagaacctgagaaacagcggaccccacaggacaaccagttaacttatgtggtgattgcaatcctaacggtcgttgctgccaccatggccaatgaaatgggatttctggagaagaccaaaaaggacctcggccttgggtcaattatcactcaagagagtgaatctaacatactggatatcgacttgcgtccagcatccgcttggaccctgtacgccgtggcgacaaccttcgtaactcctatgctcagacacagcattgaaaattcaagtgtgaacgtcagcctgacagctatcgccaatcaggcaacggtgcttatgggactcggtaggggctggcccctgtccaaaatggatattggggttccgttgctggccatcggatgttactctcaggtgaacccaattaccttaactgctgcactactgctccttgtcgcccattatgcgatcataggccctggtctgcaggctaaggccacacgcgaagcacaaaagcgggccgctgccgggattatgaaaaatcccaccgtagacggcatcaccgtgatcgatttggagccaattccctacgaccctaagtttgaaaaacagctgggacaggttatgctcctggtgctttgcgtcacacaggtgttaatgatgcgaactacgtgggcactgtgtgaggctctcaccttggccacaggcccgataagcactctgtgggaggggaaccccggaagattctggaataccacaatcgcggtctccatggccaacatttttaggggctcatatctagctggtgctgggctactcttctctatcatgaagaataccactaacacgcgccggggaacaggcaatattggtgaaacccttggcgagaaatggaagagtagactgaacgccttggggaagtcggaatttcaaatctacaaaaagagcggaatacaggaggtggatcgtactctggcaaaagagggcatcaagagaggggaaaccgaccaccatgctgtttcccggggatctgccaaactccgctggttcgtggagcgaaacatggtaacaccagaaggcaaggtggtcgatctgggttgcgggagaggaggctggtcatattactgtggtggccttaaaaatgttagggaggtgaaggggctaactaagggaggccctgggcacgaggaaccaattcctatgagcacctatggatggaacctggtccggctccagtccggcgtggacgtattctttacaccacccgagaaatgcgatacgctactgtgtgacatcggtgaaagttctcctaatccaaccattgaggccgggcgcactttgagagtgctgaacctcgttgaaaattggcttaacaataacacacaattctgcatcaaggtgctgaatccctacatgccgagcgtcatagagaaaatggaaaccttgcagaggaagtacggaggcgcgctggtgcgaaaccctctctcaagaaattccactcatgagatgtattgggtcagtaacgctacaggcaatattgtgagctctgttaacatgatctcccgtatgttaatcaatagatttaccatgaaacacaagaaggcaacgtacgagccagatgtagacctggggtcaggaacccgcaacattggtatagaaaacgagatccccaatcttgacattatcggcaaaaggattgaaaagatcaaacaggagcacgaaacaagctggcattatgatcaggaccacccttacaagacttgggcctatcatgggtcgtacgagaccaaacaaacaggatctgctagttccatggtgaacggcgtcgtgcggctgctaactaagccatgggatgttgtgcccatggtcacccagatggccatgacagacaccactccgttcggtcagcagagagtgtttaaggagaaagtagatacgcgcacacaagaacctaaggaggggaccaaaaagctcatgaggataactgcagaatggctgtggaaagagttgggaaagaagaaaacaccccgaatgtgtacacgggaggagttcacgagaaaggtgaggagcaatgccgctctgggcgcgatctttaccgacgagaacaaatggaagtcagcccgcgaagcagttgaggattcccgtttctgggaactcgtcgaccgggagagaaatcttcacctggagggcaaatgcgaaacttgtgtgtataacatgatggggaagagggagaaaaagttaggagaatttggtaaggctaaaggctctcgcgccatttggtacatgtggctgggggcacgattcttggagtttgaagccctcggattcctgaatgaggatcactggtttagccggggcaacagtctatccggtgtggagggggaaggacttcataagctgggctacatcctcagagacgtcagcaaaaaggagggcggggctatgtatgccgatgacacagcgggatgggacaccaggattactctggaagatttgaaaaatgaggaaatggttacaaaccacatgaagggtgagcataagaaactggcagaggccatcttcaagctcacctaccagaataaagtggtacgcgtgcagagaccaacacctcggggcactgtcatggacattatatctaggaaggatcagcgtgggtcaggacaagtgggcacctatggtcttaacacgttcaccaatatggaagctcagctgatccgacagatggagggggaaggaatttttaaaagtatccaacacttaacagttactgaggagatcgccgtgcagaactggctggcacgcgtcggcagagaacggttgtccaggatggctattagcggcgacgattgcgtggtaaagcccctcgacgatcgcttcgcctctgctctgaccgccctaaatgacatggggaaggttagaaaagatatacagcagtgggagccatcgcggggatggaacgactggacacaagtgcccttttgctcacatcacttccacgaacttgtcatgaaggatggtagggtgctggtggtcccttgtcgaaaccaggacgagctcatcggccgtgcaagaattagccagggggcgggatggtccctgaaagaaactgcctgcttgggcaagagttacgctcagatgtggaccttaatgtattttcatcgccgggatctgaggctcgccgcaaatgctatctgttctgccgttccaagccactgggtgccgacgtccagaacaacctggtcaattcatgcaaaacacgagtggatgactacagaggacatgcttgccgtatggaaccgcgtgtggatccaagaaaatccctggatggaggacaagacccctgtcgaaagttgggaggaagtgccatacctgggtaagcgggaggatcagtggtgcgggtctctaataggactgactagcagggcgacctgggctaaaaacatccagacagccattaatcaggttcgatccctcatcggcaacgaggaatatacggactacatgccctcaatgaagagattccggaaagaggaagaggaagcaggcgtgttgtggtga

SEQ ID NO: 14667 - RNA, 9876 nt, synthetic construct
  misc_feature 1..9876: note = derived and/or modified CDS sequence (opt3) from DENV-2__EU596486__SS-prME
  source 1..9876: mol_type = other RNA
accgccggcgtgatcattatgctgatacccaccgctatggcattccacctcactacgaggaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgtgcagaggatcgagacctggattctgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttatctgcaagcattctatggtggatagaggctggggtaacgggtgtggattattcggcaagggcgggattgtcacatgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctgactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggtacgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcatcaagttttcggcgctatctatggagcggcatttagtggcgtgagctggactatgaaaatattgatcggggtaattatcacctggattggaatgaactccagatctacgagcctgtcagtcagtctcgtgctggttggcgtggtcacactttacctgggtgtgatggtacaggccgactccgggtgtgtggttagctggaagaataaagaattgaagtgcggatctggcatcttcataaccgataacgtccacacttggacagagcagtataagtttcagcccgaatcaccaagtaaactcgctagcgccattcaaaaggcacacgaggaaggtatctgtggcattaggtccgtgacccggctggagaatttaatgtggaaacagatcactcccgagctgaaccatatactatctgaaaatgaggtgaagctcaccatcatgacaggggacattaaaggaatcatgcaggccggcaagcgctcgctgagacctcagccaacggaacttaaatacagctggaagacctgggggaaggctaaaatgttgtccactgagtcacacaaccaaacattcctgattgatggaccggaaaccgccgagtgccccaatacaaacagggcatggaatagtctcgaggtcgaagactatggctttggtgttttctctactaacatctggctgaagttacgtgagaaacaggacgtgttttgtgatagcaagctgatgtccgcggctataaaagacaatcgggccgtgcatgcagatatggggtactggattgaatcagcccttaacgacacctggaagatggagaaggctagcttcatcgaggtaaaatcttgccactggcctaagtcccacacgttgtggagtaatggagtcctcgaaagcgagatgatcattcccaaaaatttcgccggccccgtgtctcagcataactatcgacctggttaccacacacagaccgcaggcccatggcatctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtatgggatggaaattaggccattgaaggagaaggaagagaacctggtgaatagcttagttactgccggacacggccaaatagataacttttcgctcggtgtgctgggcatggcgcttttcctggaagagatgttgcgcacacgagtagggaccaaacatgccatcctcctggtcgctgtgtcctttgtgactctaattacaggaaatatgtctttccgggacctgggccgtgtcatggttatggtgggggcaaccatgacggatgacatcggaatgggcgtaacttacctcgccctgcttgctgcctttaaggtgagacccaccttcgcagcgggtttgctgttaaggaaactcacaagcaaggagctgatgatggccaccattgggatcgcacttctgtcacagagtactatacctgaaacaatcctagagctcaccgatgccctggcattgggaatgatggtcctgaaaattgtgcgcaacatggaaaagtatcagttagctgttacaatcatggccattctctgcgtgcccaatgcagtcatcctgcaaaacgcctggaaggtgtcctgtactatacttgctgcggtttctgtgagcccactgttgctcacctcctcacagcagaaagccgactggattcctctggcactaacgatcaagggcctgaatcccacagctatctttcttaccactctcagccggaccagtaaaaagagatcttggccactgaacgaggccgtcatggccgtaggcatggtgtccattttggctagctcgctgctcaaaaatgacataccgatgacagggcctctagttgcaggaggtctgcttactgtgtgctacgtcctgaccggcaggtcagccgatttggaactcgagcgagcggctgacgtgaagtgggaggatcaggccgaaatctctgggagttcccccattctgagcatcacgatttctgaggacggaagcatgtccatcaaaaacgaagaggaggaacaaacactaaccatactgatccgcactggccttctcgtaatttcaggtgtgttcccagtcagtatccccattacagcagccgcttggtatctgtgggaggttaagaagcagcgggcaggggtgttgtgggatgtgcctagcccaccccctgtcggaaaagccgaattagaggacggcgcgtacagaatcaagcagaggggcatatttgggtattctcagattggagctggtgtgtacaaagaaggcaccttccacactatgtggcacgttacacgtggggccgtactgatgcatcgcggaaagcggatcgagccgtcctgggcagatgtgaaaaaggacctcatctcatacggcggtgggtggaagctggagggagaatggaaagagggcgaagaggtccaagtgcttgccctggaaccaggcaagaatcccagagctgttcagaccaaacctgggttgtttaagacgaacactggaaccattggtgccgtgagtctagatttcagcccaggcacatccgggtctcccatcgtcgacaggaaaggaaaggtggtaggcctgtatggtaatggggtcgtgacccgatcgggagcatacgttagcgctatagcccagacagagaagtcaattgaggataaccctgaaatcgaggacgatattttccggaaaaagcgcctcactatcatggacctgcacccgggcgcgggcaaaaccaagagatatcttcccgccatagtgagggaagcaattaaacgggggttacgaacgctgatcctcgctccaacaagagtcgtggccgctgagatggaagaggcattgcgcggactgcctatcaggtaccagactcccgccattcgtgccgagcataccggtcgggaaatcgttgacctcatgtgtcacgctacatttaccatgagactgctttccccagtgagggtccctaactataatctgattataatggatgaggcgcatttcactgaccccgcaagtatcgccgctcgcggctacatttctacccgagtggaaatgggggaggccgcaggaatctttatgacagccacgccaccgggcagcagagatcctttcccccaatccaacgctccaatcatggacgaggaacgggagattcccgaaaggtcatggaactctggtcacgagtgggtaactgattttaaggggaagaccgtgtggttcgttcctagcataaaagcgggaaacgacatcgccgcatgcttgcgcaagaatggcaaaaaggtcattcagctaagtcgtaaaacatttgattccgaatatgtgaagaccagagctaacgactgggatttcgtggtcactacagacatcagcgagatgggcgccaattttcgggcagagagggtaattgatccacgccgatgtatgaagcccgtgatcctgaccgacggggaagagagagttatactcgccggacctatgccggtgacgcactcttcagctgcccagcggaggggtcgcatcggcagaaaccccaaaaatgaaaacgaccaatacatttacatgggggagcccttagaaaatgatgaggactgcgcgcattggaaggaggcaaaaatgctgcttgataacatcaatactcctgaaggaattatcccctccatgttcgagccagaaagggagaaggtcgacgccatagatggcgaatatcggctgcgtggtgaggctcgcaaaacatttgtggacctcatgcgaagaggggatttgcctgtttggctggcctacagggtggctgcagagggcattaactatgccgaccggcgctggtgtttcgatggaatcaagaataaccagattctcgaagagaacgtcgaagtggagatctggaccaaagagggcgaaagaaagaagctgaaacccaggtggcttgacgctcggatatacagtgatccactagccctgaaggagttcaaagaatttgcagcggggcgaaagagcttgaccttaaatctgatcactgagatgggaagactccctacattcatgacccagaaagcccgcgacgctctggataaccttgccgtactgcacacagcagaagtgggtggcagggcttataatcatgccctctcggagttgccggagactctggaaacgctactgctccttaccctgttagcaacagttactgggggaatatttttgttcctgatgtctggcaagggtatcgggaagatgaccctcggcatgtgctgcattatcacagcctccatactgctttggtacgctcagattcaaccccactggatcgcggccagcatcattctggagtttttcctcatcgtcttgctgataccagaacctgagaaacagcggaccccacaggacaaccagttaacttatgtggtgattgcaatcctaacggtcgttgctgccaccatggccaatgaaatgggatttctggagaagaccaaaaaggacctcggccttgggtcaattatcactcaagagagtgaatctaacatactggatatcgacttgcgtccagcatccgcttggaccctgtacgccgtggcgacaaccttcgtaactcctatgctcagacacagcattgaaaattcaagtgtgaacgtcagcctgacagctatcgccaatcaggcaacggtgcttatgggactcggtaggggctggcccctgtccaaaatggatattggggttccgttgctggccatcggatgttactctcaggtgaacccaattaccttaactgctgcactactgctccttgtcgcccattatgcgatcataggccctggtctgcaggctaaggccacacgcgaagcacaaaagcgggccgctgccgggattatgaaaaatcccaccgtagacggcatcaccgtgatcgatttggagccaattccctacgaccctaagtttgaaaaacagctgggacaggttatgctcctggtgctttgcgtcacacaggtgttaatgatgcgaactacgtgggcactgtgtgaggctctcaccttggccacaggcccgataagcactctgtgggaggggaaccccggaagattctggaataccacaatcgcggtctccatggccaacatttttaggggctcatatctagctggtgctgggctactcttctctatcatgaagaataccactaacacgcgccggggaacaggcaatattggtgaaacccttggcgagaaatggaagagtagactgaacgccttggggaagtcggaatttcaaatctacaaaaagagcggaatacaggaggtggatcgtactctggcaaaagagggcatcaagagaggggaaaccgaccaccatgctgtttcccggggatctgccaaactccgctggttcgtggagcgaaacatggtaacaccagaaggcaaggtggtcgatctgggttgcgggagaggaggctggtcatattactgtggtggccttaaaaatgttagggaggtgaaggggctaactaagggaggccctgggcacgaggaaccaattcctatgagcacctatggatggaacctggtccggctccagtccggcgtggacgtattctttacaccacccgagaaatgcgatacgctactgtgtgacatcggtgaaagttctcctaatccaaccattgaggccgggcgcactttgagagtgctgaacctcgttgaaaattggcttaacaataacacacaattctgcatcaaggtgctgaatccctacatgccgagcgtcatagagaaaatggaaaccttgcagaggaagtacggaggcgcgctggtgcgaaaccctctctcaagaaattccactcatgagatgtattgggtcagtaacgctacaggcaatattgtgagctctgttaacatgatctcccgtatgttaatcaatagatttaccatgaaacacaagaaggcaacgtacgagccagatgtagacctggggtcaggaacccgcaacattggtatagaaaacgagatccccaatcttgacattatcggcaaaaggattgaaaagatcaaacaggagcacgaaacaagctggcattatgatcaggaccacccttacaagacttgggcctatcatgggtcgtacgagaccaaacaaacaggatctgctagttccatggtgaacggcgtcgtgcggctgctaactaagccatgggatgttatacccatggtgacccagatggccatgacagacaccactccgttcggtcagcagagagtctttaaggagaaagtggatacgcgcacacaagaacctaaggaggggaccaaaaagctcatgaggatcactgcagaatggctgtggaaagagttgggaaagaagaaaacaccccgaatgtgtacacgggaggagttcacgagaaaggtaaggagcaatgccgctctgggcgcgatttttaccgacgagaacaaatggaagtcagcccgcgaagcagtggaggattcccgtttctgggaactcgttgaccgggagagaaatcttcacctggagggcaaatgcgaaacttgtgtctataacatgatggggaagagggagaaaaagttaggagaatttggtaaggctaaaggctctcgcgccatctggtacatgtggctgggggcacgattcttggagtttgaagccctcggattcctgaatgaggatcactggtttagccggggcaacagtctatccggtgtggagggggaaggacttcataagctgggctacattctcagagacgtgagcaaaaaggagggcggggctatgtatgccgatgacacagcgggatgggacaccaggatcactctggaagatttgaaaaatgaggaaatggtcacaaaccacatgaagggtgagcataagaaactggcagaggccattttcaagctcacctaccagaataaagttgtgcgcgtacagagaccaacacctcggggcactgtgatggacataatctctaggaaggatcagcgtgggtcaggacaagtcggcacctatggtcttaacacgttcaccaatatggaagctcagctgattcgacagatggagggggaaggaatctttaaaagtatccaacacttaacagtgactgaggagattgccgttcagaactggctggcacgcgtgggcagagaacggttgtccaggatggctataagcggcgacgattgcgtcgtgaagcccctcgacgatcgcttcgcctctgctctgaccgccctaaatgacatggggaaggtaagaaaagatatccagcagtgggagccatcgcggggatggaacgactggacacaagttcccttttgctcacatcacttccacgaacttgtgatgaaggatggtagggtcctggtggtgccttgtcgaagccaggacgagctcattggccgtgcaagaatctcccagggggcgggatggagtctgaaagaaactgcctgcttgggcaagtcttacgctcagatgtggaccttaatgtattttcatcgccgggatctgaggctcgccgcaaacgctatttgtagcgccgtcccatcccactgggttccgacgtcaagaacaacctggagtatccatgcaaaacacgagtggatgactacagaggacatgcttgccgtgtggaatcgcgtatggatacaagaaaacccctggatggaggacaagacccctgtggaatcttgggaggaagtcccatacctgggtaagcgggaggatcagtggtgcgggagcctaatcggactgacttccagggcgacctgggctaaaaatattcagacagccatcaaccaggtgcgatcactcattggcaatgaggaatatatcgactacatgcccagcatgaagagattccggaaagaggaagaggaagcaggcgttttgtggtga

SEQ ID NO: 14668 - RNA, 9876 nt, synthetic construct
  misc_feature 1..9876: note = derived and/or modified CDS sequence (opt3) from DENV-2__EU687212__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataagcttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattatcacagaaaaggactcccctgtgaacatcgaggccgaacccccatttggagatagctacattataatcggcgtcgagcctgggcagttaaaactgaattggttcaagaagggatcgtctattggtcaaatgtttgagactaccatgcgaggcgctaaacgcatggccatcctaggggacacagcatgggatttcggatccctcggcggtgtgtttacttcaattgggaaggccctgcaccaggttttcggcgctatctacggagcggcatttagtggcgtgagctggaccatgaaaatacttatcggggtaattatcacgtggattggaatgaactccagatctacaagcttgtcagtcagtctggtgctcgttggcgtggtcaccctgtatcttggtgccatggtgcaggctgactccgggtgtgtagtgagctggaagaataaagaactgaagtgcggatctggcatcttcataactgataacgttcacacatggaccgagcagtacaagtttcaacccgaatcaccaagtaaattggccagcgcaattcagaaggcccatgaggaaggtatctgtggcattaggtccgtcactcggctcgagaatctgatgtggaaacagatcacccccgagttaaaccacatactgtctgaaaatgaggtgaagctaacaatcatgacgggggacattaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggtggaagactacggctttggtgtcttcaccacgaacatctggctcaagctgcgtgagaaacaggacgttttttgtgattctaagttaatgagcgctgccataaaagacaatcgggcagtgcacgccgatatggggtattggattgaatccgctctgaacgacacatggaagatggagaaggcctcattcatcgaggtgaaaagctgccactggcctaagtctcataccctttggtccaatggagtattggaaagtgagatgatcattccaaaaagcttcgcaggccccgtctctcagcacaactaccgacctggttatcatactcaaaccgctggcccatggcacctcgggaagctggaaatggattttgacttctgtgagggaacaactgtggttgtgaccgaagattgcggcaacagagggccctccctaaggacaacgaccgcctcaggaaaactgatcactgagtggtgctgtcgcagttgcacactcccgcctctgcggtacagaggcgaggacggttgttggtacgggatggaaattaggccacttaaggagaaggaagagaatttggtcaacagcctggtgaccgcgggacatggccagatagataatttttcgttaggtgttctcggcatggccctgttccttgaagagatgctgcgcactcgagtggggacaaaacacgctatcttgctcgtagcagtctcctttgtgaccctgattacgggaaacatgtctttccgggacctaggccgtgtgatggtcatggttggggccactatgaccgatgacatcggaatgggcgtgacatatctggctctcctggccgcatttaaggtaagacccaccttcgcggccggtcttttgctgaggaaattaactagcaaggagctcatgatggctacaattgggatcgccctgctttcacagagtaccatgcctgaaacaatactggagctaactgatgcactcgctctgggaatgatggtgttgaaaatcgtccgcaatatggaaaagtaccaactggccgtgaccattatggcaatctcctgcgttcccaacgccgtgattttacagaatgcttggaaggtctcttgtacgatcctcgcgacagtgagcgtttccccactgcttctgacctcaagccagcagaaagccgactggatacctttggcactcactattaagggcctgaaccccaccgctatctttctaacaactctgagtcggacctctaaaaagagatcctggccacttaatgaggccatcatggccgtgggcatggtcagcattctcgcttcgtcactgttgaaaaacgacataccgatgacggggcctctggtagcaggaggtttactcacagtgtgctatgttctgaccggcaggtctgccgatcttgaactggagcgagcggctgacgtgaagtgggaggatcaagccgaaatcagtgggtccagccccattttgtctatcactattagcgaggacggatccatgtcaatcaaaaatgaagaggaggaacagacactcaccatactgatccgcactggcctactggtcattagtggtgtgttcccagtaagcatccccattacagcagccgcttggtacctttgggaggtgaagaagcagcgggcaggggtcctctgggatgttccttctccaccccctgtggaaaaagccgagctggaagacggagcgtatagaatcaagcagaggggcatattgggctactcccaaattggggctggagtgtataaagagggtacctttcacacgatgtggcatgtcactcgtggcgccgtgttaatgcaccgcgggaagcggatcgagccgtcatgggcagatgttaaaaaggacctgatcagttacggaggcggttggaagctcgaaggggagtggaaagaaggagaggaagtacaggtgctggcccttgagccaggcaagaaccccagagctgtccagaccaaacctggcattttcaagacaaataccgggacaatcggagccgtgagcctggatttttccccaggtacttctggctcgcccatagttgacaggaaagggaaggtggtcggattgtacggcaacggtgtggtaacccgaagcggggcatatgtctcagctattgcccagacggagaagtccatcgaagataatcctgagattgaagacgatatcttccggaaaaagcgcctaacaataatggacctgcatccgggagcgggcaaaactaagagatacctccccgccattgtgagggaggcaatcaaacggggcctgcgaacccttatcttagctccaacaagagttgtggccgctgaaatggaggaggcactgcgcgggctccctattaggtatcaaacccccgccatccgtgccgaacacactggacgggagattgtcgacttgatgtgtcatgctaccttcacaatgagactgctcagtccagtgagggttcctaactacaacctgataatcatggatgaagcgcactttacggaccccgcatctattgccgctcgcggttatatcagcactcgagtggagatgggcgaggccgcagggatcttcatgaccgccacaccaccgggatccagagatccttttccccagtcaaatgctccaattatggacgaagagcgggaaatacccgagaggtcttggaacagcggccacgaatgggtcaccgatttcaagggtaagactgtgtggtttgtacctagtatcaaagcggggaatgacattgccgcatgccttcgcaagaacggaaaaaaggtgatccagctgtcccgtaaaacattcgatagcgagtacgttaagaccagagctaatgactgggattttgtcgtgacgactgacatttctgagatgggcgccaacttcaaggcagaacgggtgatcgatccaaggcgctgtatgaaacccgtcatattgacagacggcgaggaacgagtaatcctagccgggcctatgccggtgacccattcatccgctgcccaaagacggggaaggattggtcgcaatccaaagaacgagaatgaccagtatatctacatgggcgaacccctggagaacgatgaggactgcgcgcactggaaagaagcaaagatgctcttagataatattaacacccctgaggggatcatacccagtatgtttgaaccagagagagaaaaagttgacgccattgatggagagtacaggctgcggggcgaggctcgtaagactttcgtggaccttatgcgccgaggtgatctgcctgtctggctcgcctataaagtggctgcagaagggatcaattacgccgacagaaagtggtgttttgatggcattaagaacaatcagatcttggaggaaaacgttgaggtggagatatggacaaaagaaggagagaggaagaaactgaagccccggtggctcgacgctcgcatctatagcgatccactggcccttaaagaattcaaggagttcgcagcgggcagaaagtcgctaaccctgaacttgattacagaaatggggaggttacctacttttatgacgcagaaagcccggaatgctctggacaacctcgccgtcctgcataccgcagaggctggaggtcgagcctacaatcacgcactttctgagctgccggaaacactcgagactttgctgctactgaccctccttgccacagtgaccggcgggatcttcctgtttttaatgtccggaaagggcattggtaaaatgactttggggatgtgctgcatcataacggctagcattctgctctggtatgcgcaaatccagccccactggatcgccgcatcaattatcctggaattctttcttatagtactgctcattccagagcctgaaaagcagagaaccccccaggataaccaattgacatacgtggttatcgctattctgactgtcgtggccgccaccatggcaaatgagatgggcttcttagagaaaacaaagaaggacctaggactgggcagtatcaccactcaggaatctgagtccaacatactcgacatcgatcttcgcccagctagcgcctggacactgtatgcggtggctacgacctttgtcactcctatgttgaggcattcaattgaaaatagtagcgttaacgtgtccctgacagccatcgcaaatcaggccaccgtactcatggggctgggaaaaggttggcccctttctaagatggacattggcgtgccgctcctggctatcgggtgttacagccaggtcaacccaattaccttgacagcagccctgttactactggtggcgcactacgctatcataggacctggcctccaagccaaagcaactcgggaggcccagaagcgtgctgccgcaggtattatgaaaaatcccacggttgatgggatcaccgtgatcgaccttgaaccaattccctatgatcctaagttcgagaagcagctgggccaggtcatgttgctgatactctgcgtaacacaagtgctgatgatgagaactacctgggctctttgtgaggccttaacactggcgaccggaccgatctccactctctgggaaggcaaccccgggaggttttggaatacgacaattgccgtttcaatggcaaacatcttccgcggatcttacttggctggcgccggtctgctatttagtattatgaaaaataccactaacacccggcgagggacaggaaatatcggcgagactctgggtgaaaagtggaaatcgagactcaacgcacttggcaagagcgagttccagatatataaaaagtccgggatccaggaggtggacaggaccctggctaaagaaggaattaagcgcggcgagacagatcatcacgccgtctctcgggggtcagccaagttgagatggtttgtggaacgtaacatggtcacgccagagggaaaagtggttgacctgggctgcggtagggggggatggagctactattgtggcggtctcaagaatgtgcgggaagtaaaaggcctgaccaaggggggacctggccatgaggagcccgtgcctatgtccacttacgggtggaacttagtccgccttcaaagtggagttgatgtgttcttcacaccacccgaaaaatgcgacaccctgctctgtgatatcggcgagtctagccctaatccaactattgaagcgggtcgaacactaagagtcctgaacttggtggagaattggctgaacaataacacccagttttgcatcaaggtactcaatccctatatgccgtcagtgatagaaaagatggagacgcttcagaggaaatacgggggagctctggttcggaaccctttgtcccgcaatagtacccacgagatgtactgggtgagcaacgcaacaggcaatattgtctcttccgtgaacatgatctcaagaatgctgatcaataggttcactatgaagcacaaaaaggccacctatgaaccagacgtcgatctcggcagcgggacacgaaacattggaatagagtcggaaatccccaacttagacattatcggtaaacggattgagaagatcaagcaggaacatgagacttcttggcactacgaccaagatcatccttataaaacctgggcttaccacggcagttatgagacaaagcagaccgggtccgccagctcaatggtgaatggagttgtacgtctgcttactaaaccatgggacgtggtccccatggtgacgcagatggcaatgacagataccactccgtttggccagcaaagagttttcaaggaaaaagtggacacccgcacacaggagcctaaggaaggtacgaagaaactgatgaagataaccgccgagtggctatggaaagagctcgggaagaaaaagactcccaggatgtgtacacgggaagagtttaccaaaaaggtcagatccaacgctgcgctgggagccatcttcactgatgaaaataagtggaaatctgcacgcgaggctgtggaagacggcaggttttgggagttggtagatcgagagcggaacctgcacctcgaaggcaagtgcgagacatgtgtgtacaatatgatggggaaaagagaaaagaaacttggagagttcggtaaggccaagggcagcagggcaatttggtatatgtggctgggggcccgctttttagaattcgaggctctgggatttttgaacgaggaccattggttcagtcgtggcaattccctcagcggtgttgaaggggagggactgcaccggctaggctacatccttagagaagtcggcaaaaaggaggggggagccatgtacgcggatgacaccgcaggttgggatacaaggattactctggaagacctcaaaaacgaggagatggtgaccaatcatatgaagggcgaacacaaaaagctggccgaggctatctttaagttgacgtatcagaacaaagtggtccgcgttcagcgaccaacccctcgggggacagtgatggacattatatctagaagggatcaacgcggatcaggccaggtaggtacttacgggctgaataccttcacaaacatggaagcccagctcatcagacaaatggagggagagggcattttcaagagtatccagcatcttactgcaaccgaagagatcgctgtgcagaattggctggcccgggtcggcagggaacgtttatcccgaatggctattagcggggacgattgcgtggttaaacccatagacgatcgctttgcctctgcactgacggcgttgaacgacatgggaaaggtgagaaaagatatccagcaatgggagccatcgcggggttggaatgactggacacaggtccccttctgctcacaccactttcatgaactcgtgatgaaggatggcagggtactggttgtgccttgtcgcaaccaggacgagctaattgggagagcccggatcagccagggagctggctggtcccttaaggagaccgcctgcctgggtaaaagttatgcacaaatgtggactctcatgtacttccacaggcgagatctgcgtttggctgccaacgcaatttgttctgccgtcccaagccattgggtgccgacatccagaaccacttggtcaatccacgcgaagcacgaatggatgaccacagaggacatgttagctgtgtggaatcgcgtctggatacaggaaaacccctggatggaggataaaacgcctgttgaaagttgggaggaggtgccatatctggggaagcgggaagaccagtggtgcggatctctcatcggccttaccagcagggccacttgggcaaaaaatattcagacagccatcaaccaagtaagatccctgattggcaatgaggaatacaccgactatatgccctcaatgaagcgctttcggagggaggaagaggaggctggggtgctatggtga

SEQ ID NO: 14669 - RNA, 9876 nt, synthetic construct
  misc_feature 1..9876: note = derived and/or modified CDS sequence (opt3) from DENV-2__EU660400__SS-prME
  source 1..9876: mol_type = other RNA
accgccggcgtgatcattatgctgataccaacggctatggcattccacctcactacgaggaacggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagacccggacagaaacttggatgagtagcgagggagcttggaaacacgtgcagaggatcgagacctggattctgcggcatcctggcttcacaatcatggccgcaattttggcctacaccatcggcacgactcactttcagcgcgctctcattttcatcctgctgacaaccgttgcaccatccatgactatgagatgcatagggatttctaacagggattttgtggaaggagtctcgggtggctcatgggtggacatcgtactcgagcacgggagctgtgttacaaccatggccaagaataagcccacgttagatttcgaactgattaaaaccgaggctaagcagcctgccacacttcggaaatattgcatcgaagcgaagttgactaacaccacaactgagagtcgctgtccaacccaaggagagccctccctgaatgaagaacaggacaaacgatttatctgcaagcattctatggtggatagaggctggggtaacgggtgtggactattcggcaagggcgggattgtcacatgcgcaatgtttacctgcaaaaagaatatggaaggaaaagtggtgctccctgagaacctggaatacactatagtcatcacgccacacagcggtgaggagcatgccgttggcaatgacacagggaagcacggaaaagaaattaagatcaccccgcagtcctcaataactgaggctgaacttaccggctatggtacagtgaccatggagtgtagtcccaggactgggctggatttcaacgaaatggtattgctccagatggaggacaaagcctggctggtgcaccggcaatggtttttagatctgcctctcccatggcttcccggcgcagacacacagggaagcaattggattcagaaggagacgctggtcaccttcaagaaccctcatgctaaaaagcaggacgtggttgtgttgggctctcaagaaggggccatgcacactgcgctaacaggagccaccgagatccagatgtcctcaggtaatctgctctttacaggccatctgaaatgccgtcttcgcatggataagctgcagttgaaagggatgagctacagtatgtgtactggaaagttcaagatcgtcaaagaaattgcagagacccaacacggcacgatcgtgattagagtacagtatgagggtgacgggtctccatgcaagatacccttcgaaatcatggatctcgagaaaaggcatgttctgggccggttaattaccgtgaacccgatcgtcacagaaaaggactcccctgtgaacatcgaggctgaacccccatttggagatagctacattataatcggcgtcgagcctgggcagctgaaactaaattggttcaagaagggatcgtctattggtcagatgtttgagactaccatgcgaggcgccaaacgcatggctatcctcggggacacagcctgggatttcggatccctgggcggtgtgtttacttcaattgggaaggcacttcaccaagttttcggcgccatctacggagctgcgtttagtggcgtgagctggaccatgaaaatattgatcggggtaattatcacgtggattggaatgaactccagatctacaagcctgtcagtcagtctcgtgctggttggcgtggtcaccctttatctgggtgtgatggtacaggcagactccgggtgtgtggttagctggaagaataaagaattgaagtgcggatctggcatcttcataactgataacgtccacacatggaccgagcagtacaagtttcagcccgaatcaccaagtaaactcgccagcgctattcaaaaggcccatgaggaaggtatctgtggcattaggtccgtgactcggctggagaatttaatgtggaaacagatcacccccgagctgaaccacatactatctgaaaatgaggtgaagctcacaatcatgacgggggacattaaaggaatcatgcaggcaggcaagcgctcgctgagacctcagccaaccgaacttaaatatagctggaagacttgggggaaggccaaaatgttgtccacagagtcacataaccaaaccttcctgattgatggaccggaaacagctgagtgccccaatactaacagggcctggaatagtctcgaggtcgaagactacggctttggtgttttctctaccaacatctggctgaagttacgtgagaaacaggacgtgttttgtgatagcaagctgatgtccgcagcgataaaagacaatcgggctgtgcacgccgatatggggtattggattgaatcagcacttaacgacacgtggaagatggagaaggccagcttcatcgaggtaaaatcttgccactggcctaagtcccatacattgtggagtaatggagtcctcgaaagcgagatgatcattcccaagaacttcgctggccccgtgtctcagcacaactaccgacctggttatcatacccagactgccggcccatggcacctggggaagctagaaatggattttgacttctgtgagggaaccacagttgtggtcactgaagattgcggcaatagagggccctccctgaggaccacaacggcatcaggaaaactcatcaccgagtggtgctgtcgcagttgcactctgccgcctcttcggtacagaggcgaggacggttgttggtacgggatggaaattaggccattgaaggagaaggaagagaacctggtgaatagcttagttacagctggacatggccaaatagataacttttcgctcggtgtgctgggcatggcccttttcctggaagagatgttgcgcacccgagtagggactaaacacgcgatcctcctggtcgccgtgtcctttgtgacactaattaccggaaatatgtctttccgggacctgggccgtgtcatggttatggtgggggctacgatgactgatgacatcggaatgggcgtaacctatctcgcactgcttgccgcttttaaggtgagacccacattcgccgcaggtttgctgttaaggaaactcaccagcaaggagctgatgatggcgactattgggatcgcccttctgtcacagagtacaatacctgaaaccatcctagagctcacagatgctctggccttgggaatgatggtcctgaaaattgtgcgcaacatggaaaagtaccagttagcagttactatcatggctatttcctgcgtgcccaatgccgtcatcctccaaaacgcatggaaggtgtcttgtaccatactggccgctgttagcgtgtccccacttctgttgacgtcaagccggcagaaagcggactggattcctctcgccctgacaatcaagggcctaaatcccaccgcaatctttctgactacccttagtagaacatctaaaaagaggtcctggccactcaacgaggctgtcatggccgtaggcatggtgagcattctggcctcgtcattgctgaaaaatgacataccgatgactgggcctttagttgctggaggtctcctgaccgtgtgctatgtccttacgggccgatctgcagatctggaattggagcgcgccgcggacgtgaagtgggaggatcaggctgaaatcagtgggtccagccccattctctctatcacaattagcgaggacggatccatgtcaatcaaaaacgaagaggaggaacacaccctgactatactaatccggacaggcctgcttgtaattagtggtgtgttcccagtcagcatccccattaccgccgcagcctggtacctctgggaggttaagaagcagagagctggggtgctgtgggatgtgccttctccaccccctgtcggaaaagcagaattggaggacggcgcctataggatcaagcaacgtggcatatttgggtactcccagattggagcgggtgtgtataaagaaggcactttccatacaatgtggcacgttacccgcggggctgtattaatgcatcggggaaagagaatcgagccgtcatgggccgatgtgaaaaaggacctgatcagttacggcggtgggtggaagctcgagggagaatggaaagagggcgaagaggtccaggtgctggcacttgaaccaggcaagaatcccagggccgttcagacgaaacctgggctgtttaagactaacaccggaacaattggtgctgtgagcttggatttctccccaggcacctctgggtcgcccatcgtcgaccgaaaaggaaaggtggtaggcctatacggtaatggggtcgtgacacggagcggagcctatgtttcagcaatagctcaaactgagaagtccattgaggataaccctgaaatcgaggacgatattttccgcaaaaagagactgaccatcatggacctccacccgggcgccggcaaaacgaagaggtacctgcccgcgatagtgcgggaagccattaaacgagggcttagaacattaatcctggcaccaactcgcgtcgtggctgccgagatggaagaggctctcaggggattgcctatccgttatcagacccccgcaattcgggccgagcatacaggtagagaaatcgttgacctgatgtgtcacgccacctttactatgaggctcctgagtccagtgcgcgtccctaactacaatcttattataatggatgaggctcacttcaccgaccccgcgtctatcgcagcccgaggctatattagcacaagagtggaaatgggggaggctgccggaatctttatgacggcaactccaccgggctcccgggatcctttcccccagtcaaacgccccaatcatggacgaggaaagggagattcccgaacgctcttggaatagcggtcatgagtgggtaaccgattttaaggggaagacagtgtggttcgttcctagtataaaagctggaaacgacatcgcggcctgcctgcgtaagaatggcaaaaaggtcattcagttgtccagaaaaacctttgatagcgaatacgtgaagactcgggcaaacgactgggatttcgtggtcacaaccgacatctctgagatgggcgctaattttagggccgagcgcgtaattgatccacgaagatgtatgaagcccgtgatcctaacggacggggaagaacgggttatactggcaggacctatgccggtgactcactcatccgccgctcaaaggcgcggtagaatcggcaggaaccccaaaaatgaaaacgaccagtatatttacatgggggagcccctcgaaaatgatgaggactgcgcccattggaaggaggcgaaaatgttactggataacatcaatacacctgaaggaattatccccagtatgttcgagccagaacgggagaaggtcgacgcaatagatggcgaataccgtcttcgcggtgaggcccgaaaaacctttgtggacctgatgagaagaggggatctccctgtttggttggcttatcgggtggccgctgagggcattaactacgcagaccgcagatggtgtttcgatggaatcaagaataaccagattctggaagagaacgtcgaagtggagatctggaccaaagagggcgaaaggaagaagctcaaaccccggtggctggacgcccgaatatatagcgatccacttgctctaaaggagttcaaagaatttgccgcagggagaaagtcgctgactttgaatttaatcacagagatgggacgcctgcctaccttcatgacacaaaaagcgagggacgccctcgataacctggctgtacttcacactgccgaagtgggtggccgggcatacaatcacgctctgtctgagctcccggagacgttggaaaccctgctactgctcacacttctggccactgttaccgggggaatatttttattcttgatgtccggcaagggtatcgggaagatgacactgggcatgtgctgcattatcaccgcaagcatactcctgtggtatgcccagattcagccccattggatcgctgcgtcaatcattcttgagtttttcctgatcgtcctcttgataccagaacctgagaaacagcgtactccccaagacaaccagctgacgtacgtggtgattgccatcttaaccgtcgttgcagctacaatggccaatgaaatgggatttctagagaagactaaaaaggacctgggcctcgggagtattaccacacaggagtctgaatccaacatccttgatatagacctgagaccagccagcgcatggaccttgtatgctgtggccactacattcgtaacgcctatgctgaggcactcaatcgagaatagtagcgtgaacgtctccctcaccgcgattgctaatcaggccactgtgctgatgggacttggtcgcggctggcccctctctaaaatggatatcggggttccgctgttggcaattggatgttacagccaagtgaacccaatcacactgaccgccgctttactactgctcgtcgcacattacgccattatcggccctggtcttcaggcgaaggctacccgggaagcccagaagcgagcagccgctgggataatgaaaaatcccacagtagacggcattactgtgatcgatctggagccaatcccctatgaccctaagtttgaaaaacagttgggacaagttatgctgctcgtgctgtgcgtcacacaggtgcttatgatgagaaccacatgggccttatgtgaggcactgactctcgctaccggcccgatttccacattgtgggaggggaaccccggaaggttctggaataccactatagccgtctcaatggcgaacatctttcgcggctcttacctggccggtgcagggctactgttcagtattatgaagaatacgacaaacacccggagaggaactggcaatatcggtgaaaccctcggcgagaaatggaagtcgcgtcttaacgctctgggaaagagcgaatttcagatttataaaaagtccggaatccaggaggtggataggacattggccaaagagggcataaagagaggggaaactgaccaccatgcagtttctcgcggatcagctaaactgcgatggttcgtggagagaaacatggtaaccccagaaggcaaggtggtcgatctcggttgcgggaggggaggctggagctactattgtggtggcctgaaaaatgttcgggaggtgaaggggttaacaaagggaggccctgggcacgaggaaccaatccctatgtccacgtacggatggaaccttgtccgcctgcaaagtggcgtggacgtattctttaccccacccgagaaatgcgatactctcctatgtgacattggtgaatctagccctaatccaacaatcgaggccgggagaaccctgagggtgttgaacctggttgaaaattggctcaacaataacactcagttctgcattaaggtgcttaatccctatatgccgtcagtcatcgagaaaatggaaacactgcagcgaaagtacggaggcgccttggtgcggaaccctctgtcccgtaatagtacccacgagatgtactgggtcagcaacgcgacgggcaatatagtgtcttccgttaacatgatttcaagaatgctcatcaatcgctttaccatgaaacataagaaggctacatatgagccagatgtagacttagggagcggaactaggaacatcggtattgaaaacgagatacccaatctggacatcattggcaaacggatcgaaaagattaaacaagagcacgaaacctcgtggcattacgatcaggaccacccttataagacatgggcataccacgggtcttatgagactaaacagaccggaagtgcctccagcatggtgaacggcgtcgtgaaacttctgacaaagccatgggatgttgtgcccatggtcacccagatggctatgactgacacgacaccgttcggtcaacagagagtgtttaaagagaaggtagatacccgcactcaggaacctaaagaggggaccaagaaactaatgaggatcacagccgaatggctctggaaggagctgggaaagaaaaagacgccccgaatgtgtacccgggaggagttcactagaaaagtgaggtcaaatgcagccttgggcgctatatttacagacgagaacaagtggaaatccgcgcgcgaagccgttgaggattctcgtttctgggaactggtcgaccgggagagaaatctccatcttgagggcaagtgcgaaacctgtgtgtacaacatgatggggaaaagggagaagaagctgggagaatttggtaaagcaaagggcagccgcgctatctggtatatgtggttaggggcccgattcctggagtttgaagcattgggattcctcaatgaggatcactggtttagtcggggcaactccctgagcggtgtggagggggaaggactacataaacttggctacattctgagagacgtctctaagaaagagggcggggccatgtacgctgatgacactgccggatgggacacaaggatcaccctcgaagatctgaagaatgaggaaatggttacaaaccacatgaagggtgagcataaaaagttggcggaggcaattttcaaactgacttatcagaataaggtggtacgcgtgcaaagaccaacccctcggggcacggtcatggacatcatttcaaggaaagatcagcgtgggagtggacaggtgggcacctacggtctcaacacattcactaatatggaagcccagcttatacgacaaatggagggggaaggaatctttaagtccattcagcgcctgaccgttacagaggagatcgctgtgcagaactggttagccagagtcggccgggaaaggctgagccgcatggcaatctctggcgacgattgcgtggtaaagcccttggacgatagattcgcttcggccctcactgctctgaatgacatggggaaagttcggaaggatattcaacagtgggagccatcaaggggatggaacgactggacccaggtgcccttttgcagccaccacttccatgagctagtcatgaaagatggtcgagtgcttgtggtcccttgtcgtaaccaggacgagctgataggcagagcccgcatctcccaaggggcaggatggagtctcaaggaaacggcgtgcctgggcaaatcttatgcccagatgtggacattgatgtactttcaccggagggatttaagactggctgccaatgcaatttgtagcgctgttccatcccattgggtgccgacctcacgcactacatggagtatccacgccaagcacgagtggatgaccactgaggacatgctcgcagtatggaaccgggtgtggattcaggaaaatccctggatggaggacaagacccctgtcgaatcttgggaggaagtgccatatcttggtaaaagggaggatcagtggtgcgggagcctgatcggactaacatcccgagccacgtgggcgaagaacatacaaaccgctatcaatcaggttagatcactgattggcaacgaggaatacactgactatatgcccagcatgaaacggttcaggaaggaggaagaggaagccggcgtgctctggtga

SEQ ID NO: 14670 - RNA, 9876 nt, synthetic construct
  misc_feature 1..9876: note = derived and/or modified CDS sequence (opt3) from DENV-2__EU569711__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatattctgggccggttaatcacggttaacccgatcgtgaccgaaaaggactcccctgtcaacattgaggccgaacccccatttggagatagctacataatcattggcgtggagcctgggcagctgaaactaaattggttcaagaagggatcgtctatcggtcagatgtttgagacaactatgcgaggcgctaaacgcatggccattctcggggacaccgcatgggatttcggatccctgggcggtgtctttacatcaatcgggaaggcccttcaccaagtgttcggcgctatatacggagcggcatttagtggcgttagctggactatgaaaatcttgattggggtgatcattacctggatcggaatgaactccagatctacgagcctgtcagtaagtctcgtcctggtgggcgttgtgacactttatctgggtgtcatggtgcaggccgactccgggtgtgtagtgagctggaagaataaagaattgaagtgcggatctggcatattcattaccgataacgttcacacttggacagagcagtacaagtttcagcccgaatcaccaagtaaactcgctagcgccatccaaaaggcacatgaggaaggtatttgtggcatcaggtccgtcacccggctggagaatttaatgtggaaacagataactcccgagctgaaccacatcctatctgaaaatgaggtgaagctcaccattatgacaggggacatcaaaggaattatgcaggccggcaagcgctcgctgagacctcagccaacggaacttaaatatagctggaagacctgggggaaggctaaaatgttgtccactgagtcacataaccaaacattcctgatcgatggaccggaaaccgccgagtgccccaatacaaacagggcatggaatagtctcgaggtggaagactacggctttggtgtcttctctactaacatatggctgaagttacgtgagaaacaggacgttttttgtgatagcaagctgatgtccgcggctattaaagacaatcgggccgtgcacgcagatatggggtattggatcgaatcagcccttaacgacacctggaagatggagaaggctagcttcatcgaggtgaaatcttgccactggcctaagtcccatacgttgtggagtaatggagtactcgaaagcgagatgattatcccaaaaaacttcgccggccccgtctctcagcacaactaccgacctggttatcatacacagaccgcaggcccatggcacctggggaagctagaaatggattttgacttctgtgagggaactaccgtggttgtgacagaagattgcggcaatagagggccctccctgaggactaccacagcttcaggaaaactcattacggagtggtgctgtcgcagttgcaccctgccgcctcttcggtacagaggcgaggacggttgttggtacgggatggaaataaggccattgaaggagaaggaagagaacctggtcaatagcttagtgactgccggacatggccaaatcgataacttttcgctcggtgttctgggcatggcgcttttcctggaagagatgttgcgcacacgagtggggaccaaacacgccattctcctggtagctgtctcctttgtgactctaatcacaggaaatatgtctttccgggacctgggccgtgtgatggtcatggttggggcaaccatgacggatgacattggaatgggcgtgacttatctcgccctgcttgctgcctttaaggtaagacccaccttcgcagcgggtttgctgttaaggaaactcacaagcaaggagctgatgatggccaccatcgggatagctcttctgtcacagagtactatccctgaaacaattctagagctcaccgatgccctggcattgggaatgatggtgctgaaaatcgtccgcaacatggaaaagtaccagttagctgtgacaattatggccatctcctgcgttcccaatgcagtgatactccaaaacgcctggaaggtctcttgtactattctggctgcggtgagcgtttccccacttctgttgacctcaagccagcagaaagccgactggatccctctcgcactgacgatcaagggcctaaatcccacagctatttttctgaccactcttagtcggacctctaaaaagagatcctggccactcaacgaggccgtgatggccgtcggcatggtaagcatactggcttcgtcattgctgaaaaatgacatcccgatgacagggcctttagtggcaggaggtctcctgactgtttgctatgtgcttaccggcaggtctgccgatctggaattggagcgagcggctgacgtcaagtgggaggatcaggccgaaattagtgggtccagccccatcctctctattacgatcagcgaggacggatccatgtcaataaaaaacgaagaggaggaacacacactgaccatcctaattcgcactggcctgcttgtgatcagtggtgtattcccagtgagcattcccatcacagcagccgcttggtacctctgggaggtcaagaagcaacgggcaggggttctgtgggatgtgccttctccaccccctgtgggaaaagccgaattggaggacggcgcgtatagaataaagcagaggggcatttttgggtactcccagatcggagctggtgtctataaagaaggcaccttccatactatgtggcacgtgacacgtggggccgttttaatgcatcgcggaaagcggatcgagccgtcatgggcagatgtaaaaaaggacctgattagttacggcggtgggtggaagctcgagggagaatggaaagagggcgaagaggtgcaggtcctggcccttgaaccaggcaagaatcccagagctgtgcaaaccaaacctgggctgtttaagacgaacactggaaccatcggtgccgttagcttggatttctccccaggcacatctgggtcgcccatagtggacaggaaaggaaaggtcgtgggcctatacggtaatggggtagtcacccgaagcggagcatatgtgtcagctattgcccagacagagaagtccatcgaggataaccctgaaattgaggacgatatcttccggaaaaagcgcctgactataatggacctccacccgggcgcgggcaaaaccaagagatacctgcccgccattgttagggaagcaatcaaacgggggcttcgaacgttaatcctggctccaacaagagtggtcgccgctgagatggaagaggcactccgcggattgcctattaggtatcagactcccgccatccgtgccgagcataccggtcgggaaattgtggacctgatgtgtcacgctacatttaccatgagactcctgagtccagttagggtgcctaactacaatcttataatcatggatgaggcgcacttcactgaccccgcatctattgccgctcgcggctatatcagcacccgagtcgaaatgggggaggccgcaggaatctttatgacagccacgccaccgggctccagagatcctttcccccagtcaaacgctccaattatggacgaggaacgggagatacccgaaaggtcttggaatagcggtcatgagtgggtgactgattttaaggggaagaccgtatggttcgtgcctagtatcaaagcgggaaacgacattgccgcatgcctgcgcaagaatggcaaaaaggttatccaattgtcccgtaaaacatttgatagcgaatacgtcaagaccagagctaacgactgggatttcgtggtgactacagacatttctgagatgggcgccaattttcgggcagagagggtcatcgatccacgccgatgtatgaagcccgtaatactaaccgacggggaagagagagtgatcctggccggacctatgccggttacgcactcatccgctgcccagcggaggggtcgcattggcagaaacccaaaaaatgaaaacgaccagtatatctacatgggggagcccctcgaaaatgatgaggactgcgcgcattggaaggaggcaaaaatgttactggataacattaatactcctgaaggaatcatacccagtatgttcgagccagaaagggagaaggtggacgccattgatggcgaataccggcttcgtggtgaggctcgcaaaacatttgtcgacctgatgcgaagaggggatctccctgtgtggttggcctatagggttgctgcagagggcatcaactacgccgaccggcgctggtgtttcgatggaattaagaataaccaaatcctggaagagaacgtggaagtcgagatatggaccaaagagggcgaaagaaagaagctcaaacccaggtggctggacgctcggatctatagcgatccacttgccctaaaggagttcaaagaatttgcagcggggcgaaagtcgctgaccttgaatttaattactgagatgggaagactgcctacattcatgacccagaaagcccgcgacgctctcgataacctggccgtgcttcacacagcagaagtaggtggcagggcttacaatcacgccctgtctgagctcccggagactttggaaacgctgctactgctcacccttctggcaacagtgactgggggaatctttttattcttgatgtccggcaagggtattgggaagatgaccctgggcatgtgctgcatcataacagccagcattctcctgtggtatgctcagatccagccccattggatcgcggcctcaattatccttgagtttttcctgatagttctcttgattccagaacctgagaaacaacggaccccccaggacaaccagctgacttacgtcgtgatcgcaattttaacggtggtcgctgccaccatggccaatgaaatgggatttctagagaagacaaaaaaggacctgggcctcgggagtatcactacccaggagtctgaatccaacatacttgatatcgacctgcgtccagcaagcgcttggacattgtatgccgttgcgaccactttcgtgacacctatgctgagacactcaattgagaatagtagcgtaaacgtgtccctcacggctatcgccaatcaagcaaccgtcctgatgggacttggtaggggctggcccctctctaaaatggatattggggtgccgctgttggccatcggatgttacagccaggttaacccaattactctgacagctgcattactactgctcgtggcccattacgcgatcataggccctggtcttcaggctaaggccacccgcgaagcacagaagcgggccgctgccgggattatgaaaaatcccaccgtcgacggcatcacagtaatcgatctggagccaattccctatgaccctaagtttgaaaaacaattgggacaggtgatgctgctcgttctgtgcgtgactcaggtccttatgatgcgaacgacctgggcattatgtgaggctctgacactcgccactggcccgatatccaccttgtgggaggggaaccccggaagattctggaatacaaccatcgcggtgtcaatggccaacatttttaggggctcttacctggcaggtgctgggctactgttcagtatcatgaagaatactacgaacacacgccggggaaccggcaatattggtgaaactctcggcgagaaatggaagtcgagacttaacgccctggggaagagcgaatttcagatctataaaaagtccggaatacaagaggtcgatcgtaccttggcaaaagagggcatcaagaggggggaaacagaccaccatgctgtgtctcggggatcagccaaactgcgctggttcgttgagcgaaacatggtgactccagaaggcaaggtagtggatctcggttgcgggagaggaggctggagctactattgtggtggcctgaaaaatgtcagggaggttaaggggttaaccaagggaggccctgggcacgaagagcccattcctatgtccacatacggatggaaccttgtgcggctgcagagtggcgtcgacgtgttctttacgccacccgagaaatgcgataccctcctatgtgacatcggtgaatctagccctaatccaactattgaggccgggcgcacactgagagtattgaacctggtggaaaattggctcaacaataacacccagttctgcatcaaggttcttaatccctatatgccgtcagtgatagagaaaatggaaactctgcaaaggaagtacggaggcgcgttggtccgaaaccctctgtcccggaatagtacacacgagatgtactgggtgagcaacgctaccggcaatattgtctcttccgtgaacatgatctcacgtatgctcatcaatagatttacgatgaaacataagaaggcaacctatgagccagatgttgacttagggagcggaacacgcaacattggtatagaaaacgagatccccaatctggacattatcggcaaaaggattgaaaagatcaaacaggagcacgaaacttcgtggcattacgatcaggaccacccttataagacctgggcctaccacgggtcttatgagacaaaacagactggaagtgcttccagcatggtaaacggcgtggtccggcttctgaccaagccatgggatgtggttcccatggtgacacaaatggccatgaccgacactacgccgttcggtcagcagagagtctttaaggagaaagtggatacacgcacccaggaacctaaggaggggactaaaaagctaatgaggataaccgcagaatggctctggaaagagctgggaaagaagaaaacaccccgaatgtgtacgcgggaggaattcaccagaaaggtaaggtcaaatgccgctttgggcgcgatctttactgacgagaacaaatggaagtccgcccgcgaagcagtggaggattctcgtttctgggaactggttgaccgggagagaaatctccatcttgagggcaaatgcgaaacatgtgtctacaacatgatggggaagagggagaaaaagctgggagaatttggtaaggctaaaggcagccgcgccatttggtatatgtggttaggggcacgattcctggagtttgaagccttgggattcctcaatgaggatcactggtttagtcggggcaactccctgagcggtgtggagggggaaggactacataagcttggctacatcctgagagacgtgtctaaaaaggagggcggggctatgtacgccgatgacaccgcgggatgggacactaggattacactcgaagatctgaaaaatgaggaaatggtcaccaaccacatgaagggtgagcataagaaattggcagaggccatcttcaagctgacatatcaaaataaagttgtgcgcgtacagagaccaactcctcggggcaccgtgatggacattatatcaaggaaggatcagcgtgggagtggacaggtcggcacgtacggtctcaacaccttcacaaatatggaagctcaacttatccgacagatggagggggaaggaatttttaaatccatccagcgcctgactgtgaccgaggagatcgccgttcaaaactggttagcaagagtgggccgggaaaggctgagccgcatggctatttctggcgacgattgcgtcgtgaagcccttggacgatagattcgcctcggctctcacagccctgaatgacatggggaaggtacggaaagatatacagcagtgggagccatcaaggggatggaacgactggactcaggttcccttttgcagccaccacttccatgaactagtgatgaaggatggtcgagtccttgtggtgccttgtcgtaaccaagacgagctgatcggcagagcacgcatttcccagggggcgggatggagtctcaaagaaaccgcctgcctgggcaagtcttatgctcagatgtggacgttgatgtactttcaccggagggatttaagactggccgcaaatgctatctgtagcgccgtcccatcccattgggttccgacatcacgcaccacttggagtattcacgcaaaacacgagtggatgacaaccgaggacatgctcgccgtgtggaaccgggtatggatccaggaaaatccctggatggaggacaagactcctgtggaatcttgggaggaagtcccatatcttggtaagagggaggatcaatggtgcgggagcctgataggactaacctcccgagcgacatgggctaaaaacatccagacggccattaatcaggtgagatcactgatcggcaacgaggaatacaccgactatatgcccagcatgaagcggttcaggaaagaggaagaggaagcaggcgttctctggtga

SEQ ID NO: 14671 - RNA, 9876 nt, synthetic construct
  misc_feature 1..9876: note = derived and/or modified CDS sequence (opt3) from DENV-2__EU569712__SS-prME
  source 1..9876: mol_type = other RNA
accgccggaatgatcattatgctgatacccacagctatggctttccacctcactacgcggaacggggaacctcatatgatcgtgggaaggcaggaaaagggtaaaagccttctgtttaagaccgaggacggcgtaaatatgtgcacattgatggccattgatttaggggaactgtgtgaggacactatcacctacaaatgcccattactccggcaaaacgaaccggaggatattgactgttggtgcaattccacatctacctgggttacttatggaacatgtaccacgactggcgagcaccgccgagaaaagcgttcagtggcgctggttccccatgtgggtatggggcttgagaccagaacagaaacttggatgagtagcgagggagcttggaaacacgtccagaggatcgagacctggattctgcggcatcctggcttcacaatcatggccgcaattttggcctacaccatcggcacgactcactttcagcgcgctctcattttcatcctgctgacagcagtggccccatccatgaccatgagatgcatagggatttctaacagggattttgttgaaggagtgtcgggtggctcatgggtcgacatcgtgctcgagcacgggagctgtgtaactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggttgatagaggctggggtaacgggtgtggattattcggcaagggcgggattgtgacctgcgccatgtttacatgcaaaaagaatatggaaggaaaagtcgtgctccctgagaacctggaatacaccatagtgatcactccacacagcggtgaggagcatgctgtcggcaatgacacggggaagcacggaaaagaaattaagatcacaccgcagtcctcaataaccgaggccgaacttactggctatggtaccgttacaatggagtgtagtcccaggaccgggctggatttcaacgaaatggtgttgctccagatggaggacaaagcatggctggtacaccggcaatggtttttagatctgcctctcccatggcttcccggcgctgacactcagggaagcaattggattcagaaggagacactggtgacgttcaagaaccctcatgccaaaaagcaggacgtcgtggttttgggctctcaagaaggggcgatgcacaccgccctgactggagcaacagagatccagatgtcctcaggtaatctgctctttaccggccatctgaaatgccgtcttcgcatggataagctgcagttgaaagggatgagctacagtatgtgtacaggaaagttcaagatcgtgaaagaaattgctgagactcaacacggcaccatcgtcattagagtgcagtatgagggtgacgggtctccatgcaagatacccttcgaaatcatggatctcgagaaaaggtacgtactgggccggttaattacggttaacccgatcgtgaccgaaaaggactcccctgtcaacatcgaggccgaacccccatttggagatagctacattataatcggcgtggagcctgggcagctgaaactaaattggttcaagaagggatcgtctattggtcagatgtttgagacaactatgcgaggcgctaaacgcatggccatcctcggggacaccgcatgggatttcggatccctgggcggtgtctttacatcaattgggaaggcccttcatcaagtgttcggcgctatctatggagcggcatttagtggcgttagctggactatgaaaatattgatcggggtgattatcacctggattggaatgaactccagatctacgagcctgtcagtaagtctcgtcctggtgggcgttgtgacactttacctgggtgtcatggtgcaggccgactccgggtgtgtagtgagctggaagaataaagaattgaagtgcggatctggcatcttcataaccgataacgttcacacttggacagagcagtataagtttcagcccgaatcaccaagtaaactcgctagcgccattcaaaaggcacacgaggaaggtatctgtggcattaggtccgtcacccggctggagaatttaatgtggaaacagatcactcccgagctgaaccatatactatctgaaaatgaggtgaagctcaccatcatgacaggggacattaaaggaatcatgcaggccggcaagcgctcgctgagacctcagccaacggaacttaaatacagctggaagacctgggggaaggctaaaatgttgtccactgagtcacacaaccaaacattcctgattgatggaccggaaaccgccgagtgccccaatacaaacagggcatggaatagtctcgaggtggaagactatggctttggtgtcttctctactaacatctggctgaagttacgtgagaaacaggacgtattttgtgatagcaagctgatgtccgcggctataaaagacaatcgggccgtgcatgcagatatggggtactggattgaatcagcccttaacgacacctggaagatggagaaggctagcttcatcgaggtgaaatcttgccactggcctaagtcccacacgttgtggagtaatggagtactcgaaagcgagatgatcattcccaagaatttcgccggccccgtctctcagcataactatcgacctggttaccacacacagaccgcaggcccatggcatctggggaagctagaaatggattttgacttctgtgagggaactaccgtggttgtgacagaagattgcggcaatagagggccctccctgaggactaccacagcttcaggaaaactcatcacggagtggtgctgtcgcagttgcaccctgccgcctcttcggtacagaggcgaggacggttgttggtatgggatggaaattaggccattgaaggagaaggaagagaacctggtcaatagcttagtgactgccggacacggccaaatagataacttttcgctcggtgttctgggcatggcgcttttcctggaagagatgttgcgcacacgagtggggaccaaacatgccatcctcctggtagctgtctcctttgtgactctaattacaggaaatatgtctttccgggacctgggccgtgtgatggtcatggttggggcaaccatgacggatgacatcggaatgggcgtgacttacctcgccctgcttgctgcctttaaggtaagacccaccttcgcagcgggtttgctgttaaggaaactcacaagcaaggagctgatgatggccaccattgggatcgcacttctgtcacagagtactatacctgaaacaatcctagagctcaccgatgccctggcattgggaatgatggtgctgaaaattgtccgcaacatggaaaagtatcagttagctgtgacaatcatggccattctctgcgttcccaatgcagtgatcctgcaaaacgcctggaaggtctcctgtactatacttgctgcggtgtctgttagcccactgttgctcacctcctcacagcagaaagccgactggattcctctggcactaacgatcaagggcctgaatcccacagctatctttcttaccactctcagccggaccagtaaaaagagatcttggccactgaacgaggccgtgatggccgtcggcatggtatccattttggctagctcgctgctcaaaaatgacataccgatgacagggcctctagtggcaggaggtctgcttactgtttgctacgtgctgaccggcaggtcagccgatttggaactcgagcgagcggctgacgtcaagtgggaggatcaggccgaaatctctgggagttcccccattctgagcatcacgatttctgaggacggaagcatgtccatcaaaaacgaagaggaggaacaaacactaaccatactgatccgcactggccttctcgtgatttcaggtgtattcccagtgagtatccccattacagcagccgcttggtatctgtgggaggtcaagaagcagcgggcaggggttttgtgggatgtgcctagcccaccccctgtggaaaaagccgagttagaagacggagcgtacagaatcaagcagaggggcatatttggctattctcagattggggctggagtctacaaagagggtaccttccacactatgtggcacgtgacacgtggcgccgttctgatgcatcgcgggaagcggatcgagccgtcctgggcagatgtcaaaaaggacctcatctcatacggaggcggttggaagctggaaggggagtggaaagaaggagaggaagtgcaagtccttgccctggagccaggcaagaatcccagagctgtgcagaccaaacctggcttgtttaagacgaacactgggaccattggagccgttagtctagatttcagcccaggtacatccggctctcccatcgtggacaggaaagggaaggtcgtgggactgtatggcaatggtgtagtcacccgatcgggggcatacgtgagcgctatagcccagacagagaagtcaattgaagataaccctgagatcgaagacgatattttccggaaaaagcgcctcactatcatggacctgcacccgggagcgggcaaaaccaagagatatcttcccgccatagttagggaggcaattaaacggggcttacgaacgctgatcctcgctccaacaagagtggtcgccgctgaaatggaggaggcattgcgcgggctgcctatcaggtaccagactcccgccattcgtgccgaacataccggacgggagatcgtggacctcatgtgtcacgctacatttaccatgagactgctttccccagttagggtgcctaactataatctgattataatggatgaagcgcatttcactgaccccgcaagtatcgccgctcgcggttacatttctacccgagtcgagatgggcgaggccgcagggatctttatgacagccacgccaccgggaagcagagatcctttcccccaatccaacgctccaatcatggacgaagaacgggaaattcccgagaggtcatggaactctggccacgaatgggtgactgattttaagggtaagaccgtatggttcgtgcctagcataaaagcggggaacgacatcgccgcatgcttgcgcaagaatggcaaaaaggttattcagctaagtcgtaaaacatttgattccgagtatgtcaagaccagagctaacgactgggatttcgtggtgactacagacatcagcgagatgggcgccaattttcgggcagaaagggtcattgatccacgccgatgtatgaagcccgtaatcctgaccgacggcgaggaaagagtgatactcgccgggcctatgccggttacgcactcttcagctgcccagcggaggggacgcatcggtagaaaccccaaaaatgagaacgaccaatacatttacatgggcgaacccttagagaatgatgaggactgcgcgcattggaaggaagcaaaaatgctgcttgataacatcaatactcctgaggggattatcccctccatgttcgaaccagagagggaaaaggtggacgccatagatggagagtatcggctgcgtggcgaggctcgcaaaacatttgtcgacctcatgcgaagaggtgatttgcctgtgtggctggcctacagggttgctgcagaagggattaactatgccgaccggcgctggtgtttcgatggcatcaagaataaccagattctcgaggaaaacgtggaggtcgagatctggaccaaagaaggagagagaaagaagctgaaacccaggtggcttgacgctcggatatacagtgatccactagccctgaaggagttcaaagagtttgcagcgggccgaaagagcttgaccttaaatctgatcactgaaatggggagactccctacattcatgacccagaaagcccgcgacgctctggataaccttgccgtgctgcacacagcagaggtaggaggtagggcttataatcatgccctctcggagttgccggaaactctggagacgctactgctccttaccctgttagcaacagtgactggcgggatatttttgttcctgatgtctggaaagggcatcggtaagatgaccctcgggatgtgctgcattatcacagcctccatactgctttggtacgctcagattcaaccccactggatcgcggccagcatcattctggaatttttcctcatcgttttgctgataccagagcctgaaaaacagcggacaccacaggacaaccagttaacttatgtcgtgattgcaatcctaacggtggtcgctgccaccatggccaatgagatgggctttctggagaagaccaaaaaggacctcggacttggctcaattatcactcaagaaagtgagtctaacatactggatatcgacttgcgtccagcatccgcttggaccctgtacgccgttgcgacaaccttcgtgactcctatgctcagacacagcattgaaaattcaagtgtaaacgtgagcctgacagctatcgccaatcaggcaacggtccttatggggctcggaaggggttggcccctgtccaaaatggatattggcgtgccgttgctggccatcgggtgttactctcaggttaacccaattaccttaactgctgcactactgctccttgtggcccattatgcgatcataggacctggcctgcaggctaaggccacacgcgaggcacaaaagcgggccgctgccggtattatgaaaaatcccaccgtcgacgggatcaccgtaatcgatttggaaccaattccctacgaccctaagtttgagaaacagctgggccaggtgatgctcctggttctttgcgtgacacaggtcttaatgatgcgaactacgtgggcactgtgtgaggctctcaccttggccacaggaccgataagcactctgtgggaaggcaaccccgggagattctggaataccacaatcgcggtgtccatggccaacatttttaggggatcatatctagcaggcgctggtctactcttctctatcatgaagaataccactaacacgcgccgggggacaggaaatattggcgagacccttggtgaaaaatggaagagtagactgaacgccttgggcaagtcggagtttcaaatctacaaaaagagcgggatacaggaggtcgatcgtactctggcaaaagaaggaatcaagaggggcgagaccgaccaccatgctgtgtcccgggggtctgccaaactccgctggttcgttgaacgaaacatggtgacaccagagggaaaggtagtggatctgggctgcggtagagggggatggtcatattactgtggcggtcttaaaaatgtcagggaagttaagggcctaactaaagggggacctggccacgaggagcccattcctatgagcacctatgggtggaacctggtgcggctccagtccggagtcgacgtgttctttacaccacccgaaaaatgcgatacgctactgtgtgacatcggcgagagttctcctaatccaaccattgaagccggtcgcactttgagagtactgaacctcgtggagaattggcttaacaataacacacaattctgcatcaaggttctgaatccctacatgccgagcgtgatagagaaaatggagaccttgcagaggaagtacgggggagcgctggtccgaaaccctctctcaagaaattccactcatgagatgtattgggtgagtaacgctacaggcaatattgtcagctctgtgaacatgatctcccgtatgttaatcaatagatttaccatgaaacacaagaaggcaacgtacgaaccagatgttgacctgggctcagggacccgcaacattggaatagagaacgaaatccccaatcttgacattatcggtaaaaggattgagaagatcaaacaggaacacgagacaagctggcattatgatcaggaccacccttacaagacttgggcctatcatggctcgtacgagaccaaacaaacagggtctgctagttccatggtaaacggagtggtccggctgctaactaagccatgggatgtggttcccatggtgacccagatggccatgacagacaccactccgttcggccagcagagagtctttaaggaaaaagtggatacgcgcacacaagagcctaaggaaggtaccaaaaagctcatgaggataactgcagagtggctgtggaaagagttggggaagaagaaaaccccacgaatgtgtacacgggaagagttcacgagaaaggtaaggagcaatgccgctctgggagcgatctttaccgacgaaaacaaatggaagtcagcccgcgaggcagtggaagattcccgtttctgggagctcgttgaccgggagagaaatcttcacctggaaggcaaatgcgagacttgtgtctataacatgatgggcaagagggagaaaaagttaggggagtttggaaaggctaaaggttctcgcgccatttggtacatgtggctgggcgcacgattcttggaatttgaggccctcgggttcctgaatgaggatcactggtttagccggggaaacagtctatccggcgtggaaggtgaggggcttcataagctgggatacatcctcagagacgtgagcaaaaaggaaggcggcgctatgtatgccgatgacacagcggggtgggacaccaggattactctggaggatttgaaaaatgaagagatggtcacaaaccacatgaagggagagcataagaaactggcagaagccatcttcaagctcacctaccagaataaagttgtgcgcgtacagagaccaacacctcggggtactgtgatggacattatatctaggaaggatcagcgtggctcagggcaagtcggaacctatggccttaacacgttcaccaatatggaggctcagctgatccgacagatggaaggtgaggggatttttaaaagtatccaacacttaacagtgactgaggaaatcgccgttcgcaactggctggcaagagtgggacgggagaggttgtcccgcatggctattagcggcgacgattgcgtcgtgaagcccctcgacgatagattcgcctctgctctgaccgccctaaatgacatgggcaaggtacggaaagatatacagcagtgggaaccatcgagggggtggaacgactggacacaggttcccttttgctcacatcacttccacgagcttgtgatgaaggatggacgagtcctggtggtgccttgtcgtaaccaagacgaactcatcggtagagcacgcattagccagggcgcggggtggtccctgaaagagactgcctgcttgggaaagagttacgctcagatgtggaccttaatgtattttcatcggagggatctgagactcgccgcaaatgctatctgttctgccgtcccaagccactgggttccgacgtcccgcacaacctggtcaattcatgcaaaacacgagtggatgactacagaagacatgcttgccgtgtggaaccgggtatggatccaggagaatccctggatggaagacaagacccctgtggagagttgggaagaggtcccatacctgggcaagagggaggatcaatggtgcggttctctaatagggctgactagccgagcgacctgggctaaaaacatccagacagccattaatcaggtgagatccctcatcggaaacgaagagtatacggactacatgccctcaatgaagcggttcaggaaagaagaggaagaggcaggcgttttgtggtga

SEQ ID NO: 14672 - RNA, 9876 nt, synthetic construct
  misc_feature 1..9876: note = derived and/or modified CDS sequence (opt3) from DENV-2__EU596487__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgaggtaaaatcttgccactggcctaagtcccatacgttgtggagtaatggagtcctcgaaagcgagatgatcattccaaaaaacttcgccggccccgtgtctcagcacaactaccgacctggttatcatacacagaccgcaggcccatggcacctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtacgggatggaaattaggccattgaaggagaaggaagagaacctggtgaatagcttagttactgccggacatggccaaatagataacttttcgctcggtgtgctgggcatggcgcttttcctggaagagatgttgcgcacacgagtagggaccaaacacgccatcctcctggtcgctgtgtcctttgtgactctaattacaggaaatatgtctttccgggacctgggccgtgtcatggttatggtgggggcaaccatgacggatgacatcggaatgggcgtaacttatctcgccctgcttgctgcctttaaggtgagacccaccttcgcagcgggtttgctgttaaggaaactcacaagcaaggagctgatgatggccaccattgggatcgctcttctgtcacagagtactatacctgaaacaatcctagagctcaccgatgccctggcattgggaatgatggtcctgaaaattgtgcgcaacatggaaaagtaccagttagctgttacaatcatggccatttcctgcgtgcccaatgcagtcatcctccaaaacgcctggaaggtgtcttgtactatactggctgcggttagcgtgtccccacttctgttgacctcaagccagcagaaagccgactggattcctctcgcactgacgatcaagggcctaaatcccacagctatctttctgaccactcttagtcggacctctaaaaagagatcctggccactcaacgaggccgtcatggccgtaggcatggtgagcattctggcttcgtcattgctgaaaaatgacataccgatgacagggcctttagttgcaggaggtctcctgactgtgtgctatgtccttaccggcaggtctgccgatctggaattggagcgagcggctgacgtgaagtgggaggatcaggccgaaatcagtgggtccagccccattctctctatcacgattagcgaggacggatccatgtcaatcaaaaacgaagaggaggaacacacactgaccatactaatccgcactggcctgcttgtaattagtggtgtgttcccagtcagcatccccattacagcagccgcttggtacctctgggaggttaagaagcaacgggcaggggtgctgtgggatgtgccttctccaccccctgtcggaaaagccgaattggaggacggcgcgtatagaatcaagcagaggggcatatttgggtactcccagattggagctggtgtgtataaagaaggcaccttccatactatgtggcacgttacacgtggggccgtattaatgcatcgcggaaagcggatcgagccgtcatgggcagatgtgaaaaaggacctgatcagttacggcggtgggtggaagctcgagggagaatggaaagagggcgaagaggtccaggtgctggcccttgaaccaggcaagaatcccagagctgttcaaaccaaacctgggctgtttaagacgaacactggaaccattggtgccgtgagcttggatttctccccaggcacatctgggtcgcccatcgtcgacaggaaaggaaaggtggtaggcctatacggtaatggggtcgtgacccgaagcggagcatatgtttcagctatagcccagacagagaagtccattgaggataaccctgaaatcgaggacgatattttccggaaaaagcgcctgactatcatggacctccacccgggcgcgggcaaaaccaagagatacctgcccgccatagtgagggaagcaattaaacgggggcttcgaacgttaatcctggctccaacaagagtcgtggccgctgagatggaagaggcactccgcggattgcctatcaggtatcagactcccgccattcgtgccgagcataccggtcgggaaatcgttgacctgatgtgtcacgctacatttaccatgagactcctgagtccagtgagggtccctaactacaatcttattataatggatgaggcgcacttcactgaccccgcatctatcgccgctcgcggctatattagcacccgagtggaaatgggggaggccgcaggaatctttatgacagccacgccaccgggctccagagatcctttcccccagtcaaacgctccaatcatggacgaggaacgggagattcccgaaaggtcttggaatagcggtcatgagtgggtaactgattttaaggggaagaccgtgtggttcgttcctagtataaaagcgggaaacgacatcgccgcatgcctgcgcaagaatggcaaaaaggtcattcaattgtcccgtaaaacatttgatagcgaatacgtgaagaccagagctaacgactgggatttcgtggtcactacagacatctctgagatgggcgccaattttcgggcagagagggtaattgatccacgccgatgtatgaagcccgtgatcctaaccgacggggaagagagagttatactggccggacctatgccggtgacgcactcatccgctgcccagcggaggggtcgcatcggcagaaacccaaaaaatgaaaacgaccagtatatttacatgggggagcccctcgaaaatgatgaggactgcgcgcattggaaggaggcaaaaatgttactggataacatcaatactcctgaaggaattatccccagtatgttcgagccagaaagggagaaggtcgacgccatagatggcgaataccggcttcgtggtgaggctcgcaaaacatttgtggacctgatgcgaagaggggatctccctgtttggttggcctatagggtggctgcagagggcattaactacgccgaccggcgctggtgtttcgatggaatcaagaataaccaaattctggaagagaacgtcgaagtggagatctggaccaaagagggcgaaagaaagaagctcaaacccaggtggctggacgctcggatatatagcgatccacttgccctaaaggagttcaaagaatttgcagcggggcgaaagtcgctgaccttgaatttaatcactgagatgggaagactgcctacattcatgacccagaaagcccgcgacgctctcgataacctggccgtacttcacacagcagaagtgggtggcagggcttacaatcacgccctgtctgagctcccggagactttggaaacgctgctactgctcacccttctggcaacagttactgggggaatttttttattcttgatgtccggcaagggtatcgggaagatgaccctgggcatgtgctgcattatcacagccagcatactcctgtggtatgctcagattcagccccattggatcgcggcctcaatcattcttgagtttttcctgatcgtcctcttgataccagaacctgagaaacaacggaccccccaggacaaccagctgacttacgtggtgattgcaatcttaacggtcgttgctgccaccatggccaatgaaatgggatttctagagaagacaaaaaaggacctgggcctcgggagtattactacccaggagtctgaatccaacatccttgatatagacctgcgtccagcaagcgcttggacattgtatgccgtggcgaccactttcgtaacacctatgctgagacactcaatcgagaatagtagcgtgaacgtctccctcacggctattgccaatcaagcaaccgtgctgatgggacttggtaggggctggcccctctctaaaatggatatcggggttccgctgttggccattggatgttacagccaggtgaacccaatcactctgacagctgcattactactgctcgtcgcccattacgcgattatcggccctggtcttcaggctaaggccacccgcgaagcacagaagcgggccgctgccgggataatgaaaaatcccaccgtagacggcattacagtgatcgatctggagccaatcccctatgaccctaagtttgaaaaacaattgggacaggttatgctgctcgtgctgtgcgtcactcaggtgcttatgatgcgaacgacctgggcattatgtgaggctctgacactcgccactggcccgatttccaccttgtgggaggggaaccccggaagattctggaatacaaccatagcggtctcaatggccaacatctttaggggctcttacctggcaggtgctgggctactgttcagtattatgaagaatactacgaacacacgccggggaaccggcaatatcggtgaaactctcggcgagaaatggaagtcgagacttaacgccctggggaagagcgaatttcagatttataaaaagtccggaatccaagaggtggatcgtaccttggcaaaagagggcataaagaggggggaaacagaccaccatgctgtttctcggggatcagccaaactgcgctggttcgtggagcgaaacatggtaactccagaaggcaaggtggtcgatctcggttgcgggagaggaggctggagctactattgtggtggcctgaaaaatgttagggaggtgaaggggttaaccaagggaggccctgggcacgaagagcccatccctatgtccacatacggatggaaccttgtccggctgcagagtggcgtggacgtattctttacgccacccgagaaatgcgataccctcctatgtgacattggtgaatctagccctaatccaactatcgaggccgggcgcacactgagagtgttgaacctggttgaaaattggctcaacaataacacccagttctgcattaaggtgcttaatccctatatgccgtcagtcatcgagaaaatggaaactctgcaaaggaagtacggaggcgcgttggtgcgaaaccctctgtcccggaatagtacacacgagatgtactgggtcagcaacgctaccggcaatatagtgtcttccgttaacatgatttcacgtatgctcatcaatagatttacgatgaaacataagaaggcaacctatgagccagatgtagacttagggagcggaacacgcaacatcggtattgaaaacgagatacccaatctggacatcattggcaaaaggatcgaaaagattaaacaggagcacgaaacttcgtggcattacgatcaggaccacccttataagacctgggcctaccacgggtcttatgagacaaaacagactggaagtgcttccagcatggtgaacggcgtcgtgaagcttctgaccaagccatgggatgttgtgcccatggtcacacaaatggccatgaccgacactacgccgttcggtcagcagcgggtgtttaaagagaaggtagatacaagaacccaggaacctaaagaggggactaagaaactaatgcgcatcaccgcagaatggctctggaaggagctgggaaagaaaaagacacccaggatgtgtacgcgagaggaattcacccggaaagtgagatcaaatgccgctttgggcgcgatatttactgacgagaacaagtggaaatccgccagggaagcagttgaggattctcgcttctgggaactggtcgaccgtgagcggaatctccatcttgagggcaagtgcgaaacatgtgtgtacaacatgatggggaaaagagagaagaagctgggagaatttggtaaagctaagggcagcagggccatctggtatatgtggttaggggcacgcttcctggagtttgaagccttgggattcctcaatgaggatcactggtttagtcgaggcaactccctgagcggtgtggagggggaaggactacataaacttggctacattctgcgggacgtctctaagaaagagggcggggctatgtacgccgatgacaccgcgggatgggacactagaatcacactcgaagatctgaagaatgaggaaatggttaccaaccacatgaagggtgagcataaaaagttggcagaggccattttcaaactgacatatcaaaataaggtggtaagggtgcagcgcccaactcctagaggcaccgtcatggacatcatttcacggaaagatcagagggggagtggacaggtgggcacgtacggtctcaacaccttcacaaatatggaagctcaacttatacgtcagatggagggggaaggaatctttaagtccattcagcgactgactgttaccgaggagatcgccgtgcaaaactggttagcacgcgtcggcagagaacggctgagcaggatggctatctctggcgacgattgcgtggtaaagcccttggacgatcgcttcgcctcggctctcacagccctgaatgacatggggaaagttagaaaggatattcagcagtgggagccatcacggggatggaacgactggactcaggtgcccttttgcagccaccacttccatgaactagtcatgaaagatggtagggtgcttgtggtcccttgtcgaaaccaagacgagctgataggccgtgcaagaatctcccagggggcgggatggagtctcaaggaaaccgcctgcctgggcaaatcttatgctcagatgtggacgttgatgtactttcaccgccgggatttaaggctggccgcaaatgctatttgtagcgccgttccatcccattgggtgccgacatcaagaaccacttggagtatccacgcaaagcacgagtggatgacaaccgaggacatgctcgccgtatggaaccgcgtgtggattcaggaaaatccctggatggaggacaagactcctgtcgaatcttgggaggaagtgccatatcttggtaaacgggaggatcaatggtgcgggagcctgatcggactaacctccagggcgacatgggctaagaacatacagacggccatcaatcaggttcgatcactgattggcaacgaggaatacaccgactatatgcccagcatgaaaagattccggaaggaggaagaggaagcaggcgtgctctggtga

SEQ ID NO: 14673 - RNA, 9876 nt, synthetic construct
  misc_feature 1..9876: note = derived and/or modified CDS sequence (opt3) from DENV-2__EU569713__SS-prME
  source 1..9876: mol_type = other RNA
accgccggcgtgatcattatgctgatacccaccgctatggcattccacctcactacgaggaacggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggattctgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggattattcggcaagggcgggattgtaacatgcgccatgtttacatgcaaaaagaatatggaaggaaaagtggtgctccctgagaacctggaatacaccatagtcatcactccacacagcggtgaggagcatgctgttggctccgacacggggaagcacggaaaagaaattaagatcacaccgcagtcaagtataaccgaggccgaacttactggctatggtaccgtgacaatggagtgtagccccaggaccgggctggatttcaatgaaatggtattgctccagatggaggacaaagcatggctggtgcaccggcaatggtttttagatctgcctctcccatggcttcccggcgctgacactcagggatctaactggattcagaaggagacactggtcacgttcaagaatcctcatgccaaaaagcaggacgtggttgtgttgggctcccaagaaggggcgatgcacaccgccctgactggagcaacagagatccagatgtcaagcggtaacctgctctttaccggccatctgaaatgccgtcttcgcatggataagctgcagttgaaagggatgagttactctatgtgtacaggaaagttcaagatcgtcaaagaaattgctgagactcaacacggcaccatcgtgattagagtacagtatgagggtgacgggtccccatgcaagatacccttcgaaatcatggatctcgagaaaaggtacgttctgggccggttaattacggtgaatccgatcgtcaccgaaaaggacagccctgtgaacatcgaggccgaacccccatttggagattcgtacattataatcggcgtcgagcctgggcagctgaaactaaactggttcaagaagggatcttccattggtcagatgtttgagacaactatgcgaggcgctaaacgcatggccatcctcggggacaccgcatgggatttcggatcactgggcggtgtgtttacaagtattgggaaggcccttcatcaagttttcggcgctatctatggagcggcatttagcggcgtgtcctggactatgaaaatattgatcggggtaattatcacctggattggaatgaactctagaagcacgtcactgagtgtctccctcgtgctggttggcgtggtcacactttacctgggtgtgatggtacaggccgacagcgggtgtgtggtttcttggaagaacaaagaattgaagtgcggatcaggcatcttcataaccgataatgtccacacttggacagagcagtataagtttcagcccgaaagtccaagcaaactcgcttccgccattcaaaaggcacacgaggaaggtatctgtggcattaggtctgtgacccggctggagaacttaatgtggaaacagatcactcccgagctgaatcatatactatcggaaaacgaggccaagctcaccatcatgacaggggacattaaaggaatcatgcaggctggcaagcgcagcctgagacctcagccaacggaacttaaatactcctggaagacctgggggaaggccaaaatgttgtcaactgagagtcacaatcaaacattcctgattgatggaccggaaaccgcagagtgccccaacacaaatagggcgtggaactctctcgaggtggaagactatggctttggtgtcttcagcactaatatctggctgaagttacgtgagaaacaggacgtattttgtgattccaagctgatgtcagctgccataaaagacaaccgggcagtgcatgccgatatggggtactggattgaaagcgctcttaatgacacctggaagatggagaaggcctctttcatcgaggtgaaatcctgccactggcctaagagtcacacgttgtggagcaacggagtactcgaatctgagatgatcattcccaaaaatttcgcaggccccgtctcccagcataactatcgacctggttaccacacacagaccgctggcccatggcatctggggaagctagaaatggattttgacttctgtgagggaactaccgtggttgtgacagaagattgcggcaacagagggccctcactgaggactaccacagccagtggaaaactcatcacggagtggtgctgtcgcagctgcaccctgccgcctcttcggtacagaggcgaggacggttgttggtatgggatggaaattaggccattgaaggagaaggaagagaatctggtcaactcgttagtgactgcgggacacggccaaatagataatttttccctcggtgttctgggcatggcccttttcctggaagagatgttgcgcacacgagtggggaccaaacatgctatcctcctggtagcagtctcttttgtgactctaattacaggaaacatgagcttccgggacctgggccgtgtgatggtcatggttggggccaccatgacggatgacatcggaatgggcgtgacttacctcgctctgcttgccgcatttaaggtaagacccaccttcgcggccggtttgctgttaaggaaactcacatcaaaggagctgatgatggctaccattgggatcgcccttctgagtcagtccactatacctgaaacaatcctagagctcaccgatgcactggctttgggaatgatggtgctgaaaattgtccgcaatatggaaaagtatcagttagccgtgacaatcatggcaattctctgcgttcccaacgccgtgatcctgcaaaatgcttggaaggtctcttgtactatacttgcggccgtgagcgtttccccactgttgctcacctcaagccagcagaaagcagactggattcctctggctctaacgatcaagggcctgaaccccacagccatctttcttaccactctcagtcggacctctaaaaagagatcctggccactgaatgaggccgtgatggctgtcggcatggtaagcattttggcatcgtcactgctcaaaaatgacataccgatgacagggcctctagtggccggaggtctgcttactgtttgctacgtgctgaccggcaggtctgcggatttggaactcgagcgagctgccgacgtcaagtgggaggatcaggcagaaatcagtgggtccagccccattctgtctatcacgattagcgaggacggatccatgtcaatcaaaaatgaagaggaggaacaaacactaaccatactgatccgcactggccttctcgtgattagtggtgtattcccagtgagcatccccattacagccgctgcatggtatctgtgggaggtcaagaagcagcgggccggggttttgtgggatgtgccttctccaccccctgtgggaaaagcggaattagaggacggcgcttacagaatcaagcagaggggcatatttgggtattcccagattggagccggtgtctacaaagaaggcaccttccacactatgtggcacgtgacacgtggggcagttctgatgcatcgcggaaagcggatcgagccgtcatgggccgatgtcaaaaaggacctcatcagttacggcggtgggtggaagctggagggagaatggaaagagggcgaagaggtgcaagtccttgctctggaaccaggcaagaaccccagagccgtgcagaccaaacctgggttgtttaagacgaatactggaaccattggtgcagttagcctagatttctccccaggcacatctgggtcgcccatcgtggacaggaaaggaaaggtcgtgggcctgtatggtaacggggtagtcacccgaagcggagcttacgtgtcagccatagcgcagacagagaagtccattgaggataatcctgaaatcgaggacgatattttccggaaaaagcgcctcactatcatggacctgcacccgggcgccggcaaaaccaagagatatcttcccgcaatagttagggaagctattaaacgggggttacgaacgctgatcctcgccccaacaagagtggtcgctgcagagatggaagaggccttgcgcggactgcctatcaggtaccagactcccgccattcgtgctgagcataccggtcgggaaatcgtggacctcatgtgtcacgcgacatttaccatgagactgcttagtccagttagggtgcctaactataacctgattataatggatgaggcacatttcactgaccccgcctctatcgctgcccgcggctacattagcacccgagtcgaaatgggggaggcagccggaatctttatgacagctacgccaccgggctccagagatcctttcccccaatcaaatgcgccaatcatggacgaggaacgggagattcccgaaaggtcttggaacagcggtcacgagtgggtgactgattttaaggggaagaccgtatggttcgtgcctagtataaaagccggaaatgacatcgcagcttgcttgcgcaagaacggcaaaaaggttattcagctatcccgtaaaacatttgatagcgaatatgtcaagaccagagccaatgactgggatttcgtggtgactacagacatctctgagatgggcgcaaactttcgggccgagagggtcattgatccacgccgatgtatgaagcccgtaatcctgaccgacggggaagagagagtgatactcgctggacctatgccggttacgcactcatccgccgcgcagcggaggggtcgcatcggcagaaatcccaaaaacgaaaatgaccaatacatttacatgggggagcccttagaaaacgatgaggactgcgcacattggaaggaggccaaaatgctgcttgataatatcaacactcctgaaggaattatccccagtatgttcgagccagaaagggagaaggtggacgctatagatggcgaatatcggctgcgtggtgaggcccgcaaaacatttgtcgacctcatgcgaagaggggatttgcctgtgtggctggcttacagggttgcagccgagggcattaattatgctgaccggcgctggtgtttcgatggaatcaagaacaatcagattctcgaagagaacgtggaagtcgagatctggaccaaagagggcgaaagaaagaagctgaaacccaggtggcttgacgcccggatatacagcgatccactagcactgaaggagttcaaagaatttgcggccgggcgaaagtcgttgaccttaaacctgatcactgagatgggaagactccctacattcatgacccagaaagctcgcgacgccctggataatcttgcagtgctgcacacagctgaagtaggtggcagggcctataaccatgcactctctgagttgccggagactctggaaacgctactgctccttaccctgttagccacagtgactgggggaatatttttgttcctgatgtccggcaagggtatcgggaagatgaccctcggcatgtgctgcattatcacagctagcatactgctttggtacgcgcagattcaaccccactggatcgccgcatcaatcattctggagtttttcctcatcgttttgctgataccagaacctgagaaacagcggaccccacaggacaatcagttaacttatgtcgtgattgctatcctaacggtggtcgccgccaccatggcaaacgaaatgggatttctggagaagaccaaaaaggacctcggccttgggagtattatcactcaagagtctgaatccaatatactggatatcgacttgcgtccagctagcgcctggaccctgtacgcggttgctacaaccttcgtgactcctatgctcagacactcaattgagaacagtagcgtaaatgtgtccctgacagccatcgcaaaccaggccacggtccttatgggactcggtaggggctggcccctgtctaaaatggatattggggtgccgttgctggctatcggatgttacagccaggttaatccaattaccttaactgcagccctactgctccttgtggcgcattatgctatcataggccctggtctgcaggccaaggcaacacgcgaagcccaaaagcgggctgccgcagggattatgaaaaaccccaccgtcgacggcatcaccgtaatcgatttggagccaattccctacgaccctaagtttgaaaaacagctgggacaggtgatgctcctggttctttgcgtgacacaggtcttaatgatgcgaactacgtgggctctgtgtgaggccctcaccttggcgacaggcccgatatccactctgtgggaggggaatcccggaagattctggaacaccacaatcgccgtgtcaatggcaaatatttttaggggctcttatctagctggtgccgggctactcttcagtatcatgaagaacaccactaatacgcgccggggaacaggcaacattggtgaaacccttggcgagaaatggaagtcgagactgaatgcattgggaaagagcgaatttcaaatctacaaaaagtccggaatacaggaggtcgatcgtactctggctaaagagggcatcaagagaggggaaaccgaccaccatgccgtgtctcggggatcagccaaactccgctggttcgttgagcgaaacatggtgacaccagaaggcaaggtagtggatctgggttgcgggagaggaggctggagctattactgtggtggccttaaaaacgtcagggaggttaaggggctaactaagggaggccctgggcacgaggaaccaattcctatgtccacctatggatggaatctggtgcggctccagagtggcgtcgacgtgttctacacaccacccgagaaatgcgatacgctactgtgtgacatcggtgaatctagccctaacccaaccattgaggcggggcgcactttgagagtactgaatctcgtggaaaactggcttaataacaatacacaattttgcatcaaggttctgaacccctacatgccgtcagtgatagagaaaatggaaaccttgcagaggaagtatggaggcgctctggtccgaaatcctctctcccggaacagtactcatgagatgtactgggtgagcaatgcaacaggcaacattgtctcttccgtgaatatgatctcacgtatgttaatcaacagattcaccatgaaacacaagaaggccacgtatgagccagatgttgacctggggagcggaacccgcaatattggtatagaaaacgagatccccaaccttgacattatcggcaaaaggattgaaaagatcaaacaggagcacgaaacatcgtggcattacgatcaggaccacccttataagacttgggcttaccatgggtcttatgagaccaaacaaacaggaagtgcctccagcatggtaaatggcgtggtccggctgctaactaagccatgggatgtggttcccatggtgacccagatggcaatgacagacaccactccgtttggtcagcagagagtcttcaaggagaaagtggatacgcgcacacaagaacctaaggaggggaccaaaaagctcatgaggataactgccgaatggctgtggaaagagttgggaaagaagaaaacaccccgaatgtgtacacgggaggaatttacgagaaaggtaaggtcaaacgctgcgctgggcgccatcttcaccgacgagaataaatggaagtccgcacgcgaagctgtggaggattctcgtttttgggaactcgttgaccgggagagaaaccttcacctggagggcaaatgcgaaacttgtgtctacaatatgatggggaagagggagaaaaagttaggagagttcggtaaggccaaaggcagccgcgcaatttggtacatgtggctgggggcccgatttttggagttcgaagctctcggatttctgaacgaggatcactggttcagtcggggcaattccctaagcggtgtggagggggaaggacttcataagctgggctatatcctcagagacgtgtctaaaaaggagggcggggccatgtacgcggatgacacagcaggatgggacaccaggattactctggaagatttgaaaaacgaggaaatggtcacaaatcacatgaagggtgagcataagaaactggccgaggctatctttaagctcacctatcagaacaaagttgtgcgcgtacagagaccaacacctcggggcactgtgatggacattatatcaaggaaggatcagcgtgggagtggacaagtcggcacctacggtcttaatacgttcaccaacatggaagcccagctgatccgacagatggagggggaaggaattttcaaatccatccaacacttaacagtgactgaggagatcgcagttcagaattggctggctcgcgtgggcagagaacggttgagcaggatggccatttctggcgacgattgcgtcgtgaagcccctcgacgatcgctttgcttcggccctgaccgcactaaacgacatggggaaggtaagaaaagatatacagcagtgggagccatcacggggatggaatgactggacacaagttcccttctgcagccatcactttcacgaacttgtgatgaaggatggtagggtcctggtggtgccttgtcgaaaccaggacgagctcatcggccgtgcgagaatttcccagggggccggatggagtctgaaagaaactgcttgcttgggcaagtcttatgcccagatgtggaccttaatgtacttccatcgccgggatctgaggctcgcagctaacgccatctgtagcgcagtcccatcccactgggttccgacgtcaagaacaacctggagtattcatgccaaacacgagtggatgactacagaggacatgcttgcggtgtggaatcgcgtatggatccaagaaaacccctggatggaggacaagacccctgtggaatcttgggaggaagtcccatatctgggtaagcgggaggatcagtggtgcgggagcctaataggactgacttccagggctacctgggccaaaaatatccagacagcaattaaccaggtgcgatcactcatcggcaatgaggaatacacggactacatgcccagcatgaagagatttcggaaagaggaagagaaggccggcgttttgtggtga

SEQ ID NO: 14674 - RNA, 9876 nt, synthetic construct
  misc_feature 1..9876: note = derived and/or modified CDS sequence (opt3) from DENV-2__EU569714__SS-prME
  source 1..9876: mol_type = other RNA
accgccggcgtgatcattatgctgataccaacagctatggcattccacctcactacgaggaacggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtcgcgctggtgccccatgtcggtatggggcttgagaccagaacagaaacttggatgagtagcgagggagcttggaaacacgtgcagaggatcgagacctggattctgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggactattcggcaagggcgggattgtaacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgaggtaaaatcttgccactggcctaagtcccatacgttgtggagtaatggagtcctcgaaagcgagatgatcattcccaagaacttcgccggccccgtgtctcagcacaactaccgacctggttatcatacacagaccgcaggcccatggcacctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtacgggatggaaattaggccattgaaggagaaggaagagaacctggtgaatagcttagttactgccggacatggccaaatagataacttttcgctcggtgtgctgggcatggcgcttttcctggaagagatgttgcgcacacgagtagggaccaaacacgtcatcctcctggtggccgtgtcctttgtcactctaattacaggaaatatgtctttccgggacctgggccgtgttatggtgatggtaggggctaccatgacggatgacatcggaatgggcgtgacttatctcgcactgcttgccgcttttaaggtcagacccaccttcgccgcaggtttgctgttaaggaaactcacaagcaaggagctgatgatggcgaccattgggatcgcccttctgtcacagagtactatacctgaaacaatcctagagctcaccgatgctctggccttgggaatgatggtgctgaaaattgttcgcaacatggaaaagtaccagttagcagtgacaatcatggctatttcctgcgtccccaatgccgtgatcctccaaaacgcatggaaggtttcttgtactatactggccgtggtcagcgtatccccacttctgttgacctcaagccagcagaaagctgactggattcctctcgcgctgacgatcaagggcctaaatcccacagccatctttctgaccactcttagtcggacctctaaaaagagatcctggccactcaacgaggcagtgatggctgttggcatggtgagcattctggcctcgtcattgctgaaaaatgacataccgatgacagggcctttagtcgccggaggtctcctgactgtgtgctatgtacttaccggcaggtctgctgatctggaattggagcgagcagccgacgtgaagtgggaggatcaggcggaaatcagtgggtccagccccattctctctatcacgattagcgaggacggatccatgtcaatcaaaaacgaagaggaggaacaaacactgaccatactaatccgcactggcctgcttgtcattagtggtgttttcccagtgagcatccccattacagctgccgcatggtacctctgggaggtgaagaagcagcgggccggggtcctgtgggatgtgccttctccaccccctgttggaaaagctgaattggaggacggcgcatatagaatcaagcagaggggcatatttgggtactcccagattggagccggtgtatataaagaaggcaccttccacactatgtggcatgtgacacgtggggcggtcttaatgcaccgcggaaagcggatcgagccgtcatgggctgatgtgaaaaaggacctgatcagttacggcggtgggtggaagctcgagggagaatggaaagagggcgaagaggttcaagtgctggcccttgaaccaggcaagaatcccagagcagtccagaccaaacctgggctgtttaagacgaacactggaaccattggtgccgtgagcttggatttctccccaggcacatctgggtcgcccatcgtagacaggaaaggaaaggtcgtgggcctatacggtaatggggttgtgacccgaagcggagcttatgtctcagccatagcacagacagagaagtccattgaggataaccctgaaatcgaggacgatattttccggaaaaagcgcctgactatcatggacctccatccgggcgctggcaaaaccaagagatacctgcccgccatagtgagggaagcgattaaacgggggcttcgaacgttaatcctggccccaacaagagttgtggcagctgagatggaagaggccctccgcggattgcctatcaggtatcagactcccgctattcgtgcagagcacaccggtcgggaaatcgtcgacctgatgtgtcatgccacatttaccatgagactcctgagtccagtgagggtacctaactacaatcttattataatggatgaggcccacttcactgaccccgcttctatcgcggcacgcggctatattagcacccgagtggaaatgggggaggccgctggaatctttatgacagccacgccaccgggctccagagatcctttcccccaatcaaacgcaccaatcatggacgaggaacgggagattcccgaaaggtcttggaatagcggtcacgagtgggttactgattttaaggggaagaccgtctggttcgtgcctagtataaaagccggaaacgacatcgctgcgtgcctgcgcaagaatggcaaaaaggtgattcagttgtcccgtaaaacatttgatagcgaatacgtcaagaccagagccaacgactgggatttcgtagtgactacagacatctctgagatgggcgcaaattttcgggctgagagggttattgatccacgccgatgtatgaagcccgtgatcctaaccgacggggaagagagagtcatactggccggacctatgccggtgacgcattcatccgcagcccagcggaggggtcgcatcggcagaaaccccaaaaatgaaaacgaccaatatatttacatgggggagcccctcgaaaatgatgaggactgcgctcactggaaggaggccaaaatgttactggataacatcaatactcctgaaggaattatccccagtatgttcgagccagaaagggagaaggttgacgcgatagatggcgaataccggcttcgtggtgaggcacgcaaaacatttgtggacctgatgcgaagaggggatctccctgtctggttggcctatagggtggctgccgagggcattaactacgctgaccggcgctggtgtttcgatggaatcaagaataaccagattctggaagagaacgtagaagtggagatctggaccaaagagggcgaaagaaagaagctcaaacccaggtggctggacgcacggatatatagcgatccacttgccctaaaggagttcaaagaatttgctgccgggcgaaagtcgctgaccttgaatttaatcactgagatgggaagactgcctacattcatgacccagaaagcacgcgacgcgctcgataacctggccgttcttcatacagctgaagtcggtggcagggcctacaatcacgcactgtctgagctcccggagactttggaaacgctgctactgctcacccttctggctgccgtgacagggggaatatttttattcttgatgtccggcaagggtatcgggaagatgactctgggcatgtgctgcattatcaccgcaagcatactcctgtggtatgcccagattcaaccccactggatcgctgcgtcaatcattcttgagtttttcctgatcgtgctcttgataccagaacctgagaaacagcggacaccccaggacaaccagctgacctacgtcgttattgccatcttaactgtggtagcagctacgatggccaatgaaatgggatttctagagaagaccaaaaaggacctgggcctcgggagtattatcacacaagagtctgaatccaacatacttgatatcgacctgcgtccagccagcgcatggactttgtatgctgtggccaccacattcgtcacccctatgctgagacattcaattgagaatagtagcgtgaacgtttccctcactgcgatcgctaatcaggccacagtgctgatgggacttggtaggggctggcccctctctaaaatggatattggggtcccgctgttggcaatcggatgttacagccaggtaaacccaattacgctgaccgccgctttactactgctcgtggcacactacgccatcataggccctggtcttcaggcgaaggctactcgcgaagcccaaaagcgggcagccgctgggattatgaaaaatcccacagttgacggcatcaccgtgatcgatctggagccaattccctatgaccctaagtttgaaaaacagttgggacaggtcatgctgctcgtgctgtgcgtcacccaggtgcttatgatgcgaacaacttgggccttatgtgaggcactgacgctcgctaccggcccgatatccacattgtgggaggggaaccccggaagattctggaatactaccatcgccgtttcaatggcgaacatttttaggggctcttacctggccggtgcagggctactgttcagtatcatgaagaatacaaccaacactcgccggggaacgggcaatattggtgaaacactcggcgagaaatggaagtcgagacttaacgctctgggaaagagcgaatttcaaatctataaaaagtccggaatacaggaggtggatcgtaccttggccaaagagggcatcaagagaggggaaactgaccatcacgcagtatctcggggatcagctaaactgcgctggttcgtggagcgaaacatggtcaccccagaaggcaaggttgtggatctcggttgcgggagaggaggctggagctactattgtggtggcctgaaaaatgtcagggaggtgaaggggttaacaaagggaggccctgggcatgaagaaccaattcctatgtccacttacggatggaaccttgtacggctgcagagtggcgtggacgttttctttaccccacccgagaaatgcgatacactcctatgtgacatcggtgaatctagccctaatccaacgattgaggccgggcgcaccctgagagtgttgaacctggtcgaaaattggctcaacaataacactcaattctgcatcaaggtgcttaatccctatatgccgtcagtcatagagaaaatggaaacactgcagaggaagtacggaggcgccttggtgcgaaaccctctgtcccggaatagtacccacgagatgtactgggttagcaacgcgactggcaatattgtatcttccgtgaacatgatctcacgtatgctcatcaatagatttacaatgaaacacaagaaggctacctatgagccagatgtcgacttagggagcggaacgcgcaacattggtatagaaaacgagatccccaatctggacattatcggcaaaaggattgaaaagatcaaacaggagcatgaaacctcgtggcactacgatcaggaccatccttataagacatgggcataccacgggtcttatgagactaaacaaaccggaagtgcctccagcatggtgaacggcgttgtgcggcttctgacaaagccatgggatgtcgtgcccatggtaactcagatggctatgaccgacacaaccccgttcggtcagcagagagtgtttaaggagaaagttgatactcgcacgcaagaacctaaggaggggaccaaaaagctaatgaggataacagccgaatggctctggaaagagctgggaaagaagaaaactccccgaatgtgtacccgggaggagttcacaagaaaggtcaggtcaaatgcagccttgggcgctatctttacggacgagaacaaatggaagtccgcgcgcgaagccgtggaggattctcgtttctgggaactggtggaccgggagagaaatctccaccttgagggcaaatgcgaaacctgtgtctacaacatgatggggaagagggagaaaaagctgggagaatttggtaaggcaaaaggcagccgcgctatttggtatatgtggttaggggcccgattcctggagtttgaagcattgggattcctcaatgaggatcattggtttagtcggggcaactccctgagcggtgttgagggggaaggactacacaaacttggctacatcctgagagacgtgtctaaaaaggagggcggggccatgtacgctgatgacactgccggatgggacacaaggattaccctcgaagatctgaaaaatgaggaaatggtaactaaccatatgaagggtgagcacaagaaattggcggaggcaatcttcaagctgacatatcagaataaagtggtccgcgtgcagagaccaacccctcggggcacagttatggacattatatcaaggaaggatcagcgtgggagtggacaagtgggcacttacggtctcaacaccttcacgaatatggaagcccagcttatccgacagatggagggggaaggaatttttaaatccatccaacatctgaccgtcacagaggagatcgctgtgcagaactggttagcccgcgtaggcagagaacggctgagcaggatggcaatttctggcgacgattgcgttgtgaagcccttggacgatcgcttcgcttcggccctcactgctctgaatgacatggggaaggtcagaaaagatatacagcagtgggagccatcacggggatggaacgactggacccaagtgcccttttgcagccaccacttccatgagctagtgatgaaggatggtagggtccttgttgtgccttgtcgaaaccaggacgagctgatcggccgtgccagaatttcccagggggcaggatggagtctcaaagaaacagcgtgcctgggcaagtcttatgcccagatgtggactttgatgtactttcaccgccgggatttaaggctggctgccaatgcaatctgtagcgctgtaccatcccattgggtgccgacctcaagaacgacatggagtattcacgccaaacacgagtggatgaccactgaggacatgctcgcagtctggaaccgcgtgtggatccaagaaaatccctggatggaggacaagacacctgttgaatcttgggaggaagtgccatatcttggtaagcgggaggatcagtggtgcgggagcctgataggactaacctccagggccacttgggcgaaaaacatccagaccgctattaatcaggtccgatcactgatcggcaacgaggaatacacagactatatgcccagcatgaagagattccggaaagaggaagaggaagccggcgtgctctggtga

SEQ ID NO: 14675 - RNA, 9876 nt, synthetic construct
  misc_feature 1..9876: note = derived and/or modified CDS sequence (opt3) from DENV-2__EU569715__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgaggtaaaatcttgccactggcctaagtcccatacgttgtggagtaatggagtcctcgaaagcgagatgatcattccaaaaaacttcgccggccccgtgtctcagcacaactaccgacctggttatcatacacagaccgcaggcccatggcacctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtacgggatggaaattaggccattgaaggagaaggaagagaacctggtgaatagcttagttactgccggacatggccaaatagataacttttcgctcggtgtgctgggcatggcgcttttcctggaagagatgttgcgcacacgagtagggaccaaacacgccatcctcctggtcgctgtgtcctttgtgactctaattacaggaaatatgtctttccgggacctgggccgtgtcatggttatggtgggggcaaccatgacggatgacatcggaatgggcgtaacttatctcgccctgcttgctgcctttaaggtgagacccaccttcgcagcgggtttgctgttaaggaaactcacaagcaaggagctgatgatggccaccattgggatcgctcttctgtcacagagtactatacctgaaacaatcctagagctcaccgatgccctggcattgggaatgatggtcctgaaaattgtgcgcaacatggaaaagtaccagttagctgttacaatcatggccatttcctgcgtgcccaatgcagtcatcctccaaaacgcctggaaggtgtcttgtactatactggctgcggttagcgtgtccccacttctgttgacctcaagccagcagaaagccgactggattcctctcgcactgacgatcaagggcctaaatcccacagctatctttctgaccactcttagtcggacctctaaaaagagatcctggccactcaacgaggccgtcatggccgtaggcatggtgagcattctggcttcgtcattgctgaaaaatgacataccgatgacagggcctttagttgcaggaggtctcctgactgtgtgctatgtccttaccggcaggtctgccgatctggaattggagcgagcggctgacgtgaagtgggaggatcaggccgaaatcagtgggtccagccccattctctctatcacgattagcgaggacggatccatgtcaatcaaaaacgaagaggaggaacacacactgaccatactaatccgcactggcctgcttgtaattagtggtgtgttcccagtcagcatccccattacagcagccgcttggtacctctgggaggttaagaagcaacgggcaggggtgctgtgggatgtgccttctccaccccctgtcggaaaagccgaattggaggacggcgcgtatagaatcaagcagaggggcatatttgggtactcccagattggagctggtgtgtataaagaaggcaccttccatactatgtggcacgttacacgtggggccgtattaatgcatcgcggaaagcggatcgagccgtcatgggcagatgtgaaaaaggacctgatcagttacggcggtgggtggaagctcgagggagaatggaaagagggcgaagaggtccaggtgctggcccttgaaccaggcaagaatcccagagctgttcaaaccaaacctgggctgtttaagacgaacactggaaccattggtgccgtgagcttggatttctccccaggcacatctgggtcgcccatcgtcgacaggaaaggaaaggtggtaggcctatacggtaatggggtcgtgacccgaagcggagcatatgtttcagctatagcccagacagagaagtccattgaggataaccctgaaatcgaggacgatattttccggaaaaagcgcctgactatcatggacctccacccgggcgcgggcaaaaccaagagatacctgcccgccatagtgagggaagcaattaaacgggggcttcgaacgttaatcctggctccaacaagagtcgtggccgctgagatggaagaggcactccgcggattgcctatcaggtatcagactcccgccattcgtgccgagcataccggtcgggaaatcgttgacctgatgtgtcacgctacatttaccatgagactcctgagtccagtgagggtccctaactacaatcttattataatggatgaggcgcacttcactgaccccgcatctatcgccgctcgcggctatattagcacccgagtggaaatgggggaggccgcaggaatctttatgacagccacgccaccgggctccagagatcctttcccccagtcaaacgctccaatcatggacgaggaacgggagattcccgaaaggtcttggaatagcggtcatgagtgggtaactgattttaaggggaagaccgtgtggttcgttcctagtataaaagcgggaaacgacatcgccgcatgcctgcgcaagaatggcaaaaaggtcattcaattgtcccgtaaaacatttgatagcgaatacgtgaagaccagagctaacgactgggatttcgtggtcactacagacatctctgagatgggcgccaattttcgggcagagagggtaattgatccacgccgatgtatgaagcccgtgatcctaaccgacggggaagagagagttatactggccggacctatgccggtgacgcactcatccgctgcccagcggaggggtcgcatcggcagaaacccaaaaaatgaaaacgaccagtatatttacatgggggagcccctcgaaaatgatgaggactgcgcgcattggaaggaggcaaaaatgttactggataacatcaatactcctgaaggaattatccccagtatgttcgagccagaaagggagaaggtcgacgccatagatggcgaataccggcttcgtggtgaggctcgcaaaacatttgtggacctgatgcgaagaggggatctccctgtttggttggcctatagggtggctgcagagggcattaactacgccgaccggcgctggtgtttcgatggaatcaagaataaccaaattctggaagagaacgtcgaagtggagatctggaccaaagagggcgaaagaaagaagctcaaacccaggtggctggacgctcggatatatagcgatccacttgccctaaaggagttcaaagaatttgcagcggggcgaaagtcgctgaccttgaatttaatcactgagatgggaagactgcctacattcatgacccagaaagcccgcgacgctctcgataacctggccgtacttcacacagcagaagtgggtggcagggcttacaatcacgccctgtctgagctcccggagactttggaaacgctgctactgctcacccttctggcaacagttactgggggaatttttttattcttgatgtccggcaagggtatcgggaagatgaccctgggcatgtgctgcattatcacagccagcatactcctgtggtatgctcagattcagccccattggatcgcggcctcaatcattcttgagtttttcctgatcgtcctcttgataccagaacctgagaaacaacggaccccccaggacaaccagctgacttacgtggtgattgcaatcttaacggtcgttgctgccaccatggccaatgaaatgggatttctagagaagacaaaaaaggacctgggcctcgggagtattactacccaggagtctgaatccaacatccttgatatagacctgcgtccagcaagcgcttggacattgtatgccgtggcgaccactttcgtaacacctatgctgagacactcaatcgagaatagtagcgtgaacgtctccctcacggctattgccaatcaagcaaccgtgctgatgggacttggtaggggctggcccctctctaaaatggatatcggggttccgctgttggccattggatgttacagccaggtgaacccaatcactctgacagctgcattactactgctcgtcgcccattacgcgattatcggccctggtcttcaggctaaggccacccgcgaagcacagaagcgggccgctgccgggataatgaaaaatcccaccgtagacggcattacagtgatcgatctggagccaatcccctatgaccctaagtttgaaaaacaattgggacaggttatgctgctcgtgctgtgcgtcactcaggtgcttatgatgcgaacgacctgggcattatgtgaggctctgacactcgccactggcccgatttccaccttgtgggaggggaaccccggaagattctggaatacaaccatagcggtctcaatggccaacatctttaggggctcttacctggcaggtgctgggctactgttcagtattatgaagaatactacgaacacacgccggggaaccggcaatatcggtgaaactctcggcgagaaatggaagtcgagacttaacgccctggggaagagcgaatttcagatttataaaaagtccggaatccaagaggtggatcgtaccttggcaaaagagggcataaagaggggggaaacagaccaccatgctgtttctcggggatcagccaaactgcgctggttcgtggagcgaaacatggtaactccagaaggcaaggtggtcgatctcggttgcgggagaggaggctggagctactattgtggtggcctgaaaaatgttagggaggtgaaggggttaaccaagggaggccctgggcacgaagagcccatccctatgtccacatacggatggaaccttgtccggctgcagagtggcgtggacgtattctttacgccacccgagaaatgcgataccctcctatgtgacattggtgaatctagccctaatccaactatcgaggccgggcgcacactgagagtgttgaacctggttgaaaattggctcaacaataacacccagttctgcattaaggtgcttaatccctatatgccgtcagtcatcgagaaaatggaaactctgcaaaggaagtacggaggcgcgttggtgcgaaaccctctgtcccggaatagtacacacgagatgtactgggtcagcaacgctaccggcaatatagtgtcttccgttaacatgatttcacgtatgctcatcaatagatttacgatgaaacataagaaggcaacctatgagccagatgtagacttagggagcggaacacgcaacatcggtattgaaaacgagatacccaatctggacatcattggcaaaaggatcgaaaagattaaacaggagcacgaaacttcgtggcattacgatcaggaccacccttataagacctgggcctaccacgggtcttatgagacaaaacagactggaagtgcttccagcatggtgaacggcgtcgtgaagcttctgaccaagccatgggatgttgtgcccatggtcacacaaatggccatgaccgacactacgccgttcggtcagcagcgggtgtttaaagagaaggtagatacaagaacccaggaacctaaagaggggactaagaaactaatgcgcatcaccgcagaatggctctggaaggagctgggaaagaaaaagacacccaggatgtgtacgcgagaggaattcacccggaaagtgagatcaaatgccgctttgggcgcgatatttactgacgagaacaagtggaaatccgccagggaagcagttgaggattctcgcttctgggaactggtcgaccgtgagcggaatctccatcttgagggcaagtgcgaaacatgtgtgtacaacatgatggggaaaagagagaagaagctgggagaatttggtaaagctaagggcagcagggccatctggtatatgtggttaggggcacgcttcctggagtttgaagccttgggattcctcaatgaggatcactggtttagtcgaggcaactccctgagcggtgtggagggggaaggactacataaacttggctacattctgcgggacgtctctaagaaagagggcggggctatgtacgccgatgacaccgcgggatgggacactagaatcacactcgaagatctgaagaatgaggaaatggttaccaaccacatgaagggtgagcataaaaagttggcagaggccattttcaaactgacatatcaaaataaggtggtaagggtgcagcgcccaactcctggcgggaccgtcatggacatcatttcaagaaaagatcagcggggaagtggccaggtgggtacgtacgggctcaacaccttcacaaatatggaagctcaacttataaggcagatggagggagaaggcatctttaagtccattcagcgtctgactgttaccgaggagatcgccgtgcaaaactggttagcacgagtcggccgcgaaagactgagccggatggctatctctggggacgattgcgtggtaaagcccttggacgataggttcgcctcggctctcacagccctgaatgacatgggaaaagttcgcaaggatattcagcagtgggagccatcaagaggttggaacgactggactcaggtgcccttttgcagccaccacttccatgaactagtcatgaaagatggccgggtgcttgtggtcccttgtaggaaccaagacgagctgatagggcgagcacgtatctcccagggagcgggctggagtctcaaggaaaccgcctgcctgggtaaatcttatgctcagatgtggacgttgatgtactttcacagacgcgatttacggctggccgcaaatgctatttgtagcgccgttccatcccattgggtgccgacatcaaggaccacttggagtatccacgcaaagcacgagtggatgacaaccgaggacatgctcgccgtatggaacagagtgtggattcaggaaaatccctggatggaggacaagactcctgtcgaatcttgggaggaagtgccatatcttgggaaacgcgaggatcaatggtgcggaagcctgatcggcctaacctcccgggcgacatgggctaagaacatacagacggccatcaatcaggttaggtcactgattggcaacgaggaatacaccgactatatgcccagcatgaaacgattcagaaaggaggaagaggaagcaggggtgctctggtga

SEQ ID NO: 14676 - RNA, 9876 nt, synthetic construct
  misc_feature 1..9876: note = derived and/or modified CDS sequence (opt3) from DENV-2__EU569716__SS-prME
  source 1..9876: mol_type = other RNA
accgccggcgtgataattatgctgataccaactgctatggcattccacctcactacgaggaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtcgcgctggtgccccatgtcggtatggggcttgagacccggacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttatctgcaagcattctatggtggatagaggctggggtaacgggtgtggattattcggcaagggcgggattgtaacctgcgccatgtttatatgcaaaaagaatatggaaggaaaagtggtgctccctgagaacctggaatacacaatcgtcattaccccacacagcggtgaggagcatgctgttggcaatgacactgggaagcacggaaaagaaatcaagataacgccgcagtcctcaattacagaggccgaacttaccggctatggtactgtgaccatggagtgtagtcccaggacagggctggatttcaacgaaatggtattgctccagatggaggacaaagcatggctggtgcaccggcaatggtttttagatctgcctctcccatggcttcccggcgctgacacccagggaagcaattggatccagaaggagactctggtcacattcaagaaccctcatgccaaaaagcaggacgtggttgtgttgggctctcaagaaggggcgatgcacacggccctgaccggagcaactgagatccagatgtcctcaggtaatctgctctttacaggccatctgaaatgccgtcttcgcatggataagctgcagttgaaagggatgagctacagtatgtgtaccggaaagttcaagattgtcaaagaaatcgctgagacacaacacggcactattgtgataagagtacagtatgagggtgacgggtctccatgcaagatccccttcgaaattatggatctcgagaaaaggtacgttctgggccggttaatcaccgtgaacccgatcgtcacggaaaaggactcccctgtgaacattgaggccgaacccccatttggagatagctacataatcattggcgtcgagcctgggcagctgaaactaaattggttcaagaagggatcgtctatcggtcagatgtttgagaccacaatgcgaggcgctaaacgcatggccattctcggggacactgcatgggatttcggatccctgggcggtgtgtttacctcaatcgggaaggcccttcatcaagttttcggcgctatatatggagcggcatttagtggcgtgagctggacaatgaaaatcttgattggggtaatcattacttggatcggaatgaactccagatctaccagcctgtcagtcagtctcgtgctggttggcgtggtcacgctttacctgggtgtgatggtacaggccgactccgggtgtgtggttagctggaagaataaagaattgaagtgcggatctggcatattcattacagataacgtccacacctggactgagcagtataagtttcagcccgaatcaccaagtaaactcgctagcgccatccaaaaggcacacgaggaaggtatttgtggcatcaggtccgtgacacggctggagaatttaatgtggaaacagataacccccgagctgaaccatatcctatctgaaaatgaggtgaagctcactattatgaccggggacatcaaaggaattatgcaggccggcaagcgctcgctgagacctcagccaacagaacttaaatacagctggaagacgtgggggaaggctaaaatgttgtccaccgagtcacacaaccaaactttcctgatcgatggaccggaaacagccgagtgccccaataccaacagggcatggaatagtctcgaggtcgaagactatggctttggtgttttctctacaaacatatggctgaagttacgtgagaaacaggacgtgttttgtgatagcaagctgatgtccgcggctattaaagacaatcgggccgtgcatgcagatatggggtactggatcgaatcagcccttaacgacacttggaagatggagaaggctagcttcatcgaggtaaaatcttgccactggcctaagtcccacaccttgtggagtaatggagtcctcgaaagcgagatgattatccccaaaaatttcgccggccccgtgtctcagcataactatcgacctggttaccacacgcagacagcaggcccatggcatctggggaagctagaaatggattttgacttctgtgagggaaccactgttgtggtcaccgaagattgcggcaatagagggccctccctgaggacaactaccgcttcaggaaaactcattacagagtggtgctgtcgcagttgcacgctgccgcctcttcggtacagaggcgaggacggttgttggtatgggatggaaataaggccattgaaggagaaggaagagaacctggtgaatagcttagttaccgccggacacggccaaatcgataacttttcgctcggtgtgctgggcatggcgcttttcctggaagagatgttgcgcactcgagtagggacaaaacatgccattctcctggtcgctgtgtcctttgtgaccctaatcactggaaatatgtctttccgggacctgggccgtgtcatggttatggtgggggcaacaatgaccgatgacattggaatgggcgtaacgtacctcgccctgcttgctgcctttaaggtgagacccactttcgcagcgggtttgctgttaaggaaactcaccagcaaggagctgatgatggccacaatcgggatagcacttctgtcacagagtaccatccctgaaactattctagagctcacagatgccctggcattgggaatgatggtcctgaaaatcgtgcgcaacatggaaaagtatcagttagctgttaccattatggccatcctctgcgtgcccaatgcagtcatactgcaaaacgcctggaaggtgtcctgtacaattcttgctgcggtttctgtgagcccactgttgctcacttcctcacagcagaaagccgactggatccctctggcactaaccatcaagggcctgaatcccacggctatttttcttacaaccctcagccggacaagtaaaaagagatcttggccactgaacgaggccgtcatggccgtaggcatggtgtccatattggctagctcgctgctcaaaaatgacatcccgatgaccgggcctctagttgcaggaggtctgcttacagtgtgctacgtcctgactggcaggtcagccgatttggaactcgagcgagcggctgacgtgaagtgggaggatcaggccgaaatttctgggagttcccccatcctgagcattaccatctctgaggacggaagcatgtccatcaaaaacgaagaggaggaacaaacgctaacaatcctgattcgcaccggccttctcgtaatctcaggtgtgttcccagtcagtattcccatcactgcagccgcttggtatctgtgggaggttaagaagcagcgggcaggggtgttgtgggatgtgcctagcccaccccctgtcggaaaagccgaattagaggacggcgcgtacagaataaagcagaggggcatttttgggtattctcagatcggagctggtgtgtacaaagaaggcacattccacaccatgtggcacgttactcgtggggccgtactgatgcatcgcggaaagcggatcgagccgtcctgggcagatgtgaaaaaggacctcatttcatacggcggtgggtggaagctggagggagaatggaaagagggcgaagaggtccaagtgcttgccctggaaccaggcaagaatcccagagctgttcagacaaaacctgggttgtttaagaccaacacgggaactatcggtgccgtgagtctagatttcagcccaggcacctccgggtctcccatagtcgacaggaaaggaaaggtggtaggcctgtatggtaatggggtcgtgacacgatcgggagcatacgttagcgctattgcccagaccgagaagtcaatcgaggataaccctgaaattgaggacgatatcttccggaaaaagcgcctcacaataatggacctgcacccgggcgcgggcaaaactaagagatatcttcccgccattgtgagggaagcaatcaaacgggggttacgaaccctgatcctcgctccaacgagagtcgtggccgctgagatggaagaggcattgcgcggactgcctattaggtaccagacacccgccatccgtgccgagcatactggtcgggaaattgttgacctcatgtgtcacgctacctttacaatgagactgctttccccagtgagggtccctaactataatctgataatcatggatgaggcgcatttcaccgaccccgcaagtattgccgctcgcggctacatctctactcgagtggaaatgggggaggccgcaggaatctttatgaccgccacaccaccgggcagcagagatcctttcccccaatccaacgctccaattatggacgaggaacgggagatacccgaaaggtcatggaactctggtcacgagtgggtaacggattttaaggggaagactgtgtggttcgttcctagcatcaaagcgggaaacgacattgccgcatgcttgcgcaagaatggcaaaaaggtcatccagctaagtcgtaaaacctttgattccgaatatgtgaagacaagagctaacgactgggatttcgtggtcaccactgacattagcgagatgggcgccaattttcgggcagagagggtaatcgatccacgccgatgtatgaagcccgtgatactgacagacggggaagagagagttatcctcgccggacctatgccggtgacccactcttcagctgcccagcggaggggtcgcattggcagaaaccccaaaaatgaaaacgaccaatacatctacatgggggagcccttagaaaatgatgaggactgcgcgcattggaaggaggcaaaaatgctgcttgataacattaatacgcctgaaggaatcataccctccatgttcgagccagaaagggagaaggtcgacgccattgatggcgaatatcggctgcgtggtgaggctcgcaaaacttttgtggacctcatgcgaagaggggatttgcctgtttggctggcctacagggtggctgcagagggcatcaactatgccgaccggcgctggtgtttcgatggaattaagaataaccagatcctcgaagagaacgtcgaagtggagatatggacaaaagagggcgaaagaaagaagctgaaacccaggtggcttgacgctcggatctacagtgatccactagccctgaaggagttcaaagaatttgcagcggggcgaaagagcttgaccttaaatctgattaccgagatgggaagactccctactttcatgacacagaaagcccgcgacgctctggataaccttgccgtactgcacaccgcagaagtgggtggcagggcttataatcatgccctctcggagttgccggagacactggaaactctactgctccttacgctgttagcaaccgttacagggggaatctttttgttcctgatgtctggcaagggtattgggaagatgactctcggcatgtgctgcatcataaccgcctccattctgctttggtacgctcagatccaaccccactggatcgcggccagcattatcctggagtttttcctcatagtcttgctgattccagaacctgagaaacagcggacaccccaggacaaccagttaacctatgtggtgatcgcaattctaactgtcgttgctgccacgatggccaatgaaatgggatttctggagaagaccaaaaaggacctcggccttgggtcaatcataacacaagagagtgaatctaacatcctggatattgacttgcgtccagcatccgcttggactctgtacgccgtggcgaccacattcgtaacccctatgctcagacacagcatcgaaaattcaagtgtgaacgtcagcctgactgctattgccaatcaggcaacagtgcttatgggactcggtaggggctggcccctgtccaaaatggatatcggggttccgttgctggccattggatgttactctcaggtgaacccaatcacgttaaccgctgcactactgctccttgtcgcccattatgcgataattggccctggtctgcaggctaaggccactcgcgaagcacaaaagcgggccgctgccgggatcatgaaaaatcccacagtagacggcatcaccgtgattgatttggagccaataccctacgaccctaagtttgaaaaacagctgggacaggttatgctcctggtgctttgcgtcacccaggtgttaatgatgcgaacaacttgggcactgtgtgaggctctcacgttggccaccggcccgatcagcacactgtgggaggggaaccccggaagattctggaatactaccattgcggtctccatggccaacatctttaggggctcatatctagctggtgctgggctactcttctctattatgaagaatacaaccaacactcgccggggaacgggcaatatcggtgaaacacttggcgagaaatggaagagtagactgaacgccttggggaagtcggaatttcaaatatacaaaaagagcggaatccaggaggtggatcgtaccctggcaaaagagggcattaagagaggggaaactgaccaccatgctgtttcccggggatctgccaaactccgctggttcgtggagcgaaacatggtaaccccagaaggcaaggtggtcgatctgggttgcgggagaggaggctggtcatattactgtggtggccttaaaaatgttagggaggtgaaggggctaacaaagggaggccctgggcacgaggaaccaatccctatgagcacttatggatggaacctggtccggctccagtccggcgtggacgtattctttaccccacccgagaaatgcgatacactactgtgtgacattggtgaaagttctcctaatccaacgatcgaggccgggcgcaccttgagagtgctgaacctcgttgaaaattggcttaacaataacactcaattctgcataaaggtgctgaatccctacatgccgagcgtcattgagaaaatggaaacattgcagaggaagtacggaggcgcgctggtgcgaaaccctctctcaagaaattccacccatgagatgtattgggtcagtaacgctactggcaatatcgtgagctctgttaacatgatctcccgtatgttaattaatagatttacaatgaaacacaagaaggcaacctacgagccagatgtagacctggggtcaggaacgcgcaacataggtatcgaaaacgagattcccaatcttgacatcattggcaaaaggatcgaaaagataaaacaggagcacgaaaccagctggcattatgatcaggaccacccttacaagacatgggcctatcatgggtcgtacgagactaaacaaaccggatctgctagttccatggtgaacggcgtcgtgcggctgctaacaaagccatgggatgttgtgcccatggtcactcagatggccatgaccgacacaaccccgttcggtcagcagagagtgtttaaggagaaagtagatactcgcacgcaagaacctaaggaggggaccaaaaagctcatgaggatcacagcagaatggctgtggaaagagttgggaaagaagaaaactccccgaatgtgtacccgggaggagttcacaagaaaggtgaggagcaatgccgctctgggcgcgatttttacggacgagaacaaatggaagtcagcccgcgaagcagttgaggattcccgtttctgggaactcgtcgaccgggagagaaatcttcacctggagggcaaatgcgaaacctgtgtgtataacatgatggggaagagggagaaaaagttaggagaatttggtaaggctaaaggctctcgcgccatctggtacatgtggctgggggcacgattcttggagtttgaagccctcggattcctgaatgaggatcactggtttagccggggcaacagtctatccggtgtggagggggaaggacttcataagctgggctacattctcagagacgtcagcaaaaaggagggcggggctatgtatgccgatgacactgcgggatgggacacaaggatcaccctggaagatttgaaaaatgaggaaatggttactaaccacatgaagggtgagcataagaaactggcagaggccattttcaagctcacataccagaataaagtggtacgcgtgcagagaccaacccctcggggcacagtcatggacataatctctaggaaggatcagcgtgggtcaggacaagtgggcacttatggtcttaacaccttcacgaatatggaagctcagctgattcgacagatggagggggaaggaatctttaaaagtatccaacacttaaccgttacagaggagattgccgtgcagaactggctggcacgcgtcggcagagaacggttgtccaggatggctataagcggcgacgattgcgtggtaaagcccctcgacgatcgcttcgcctctgctctgactgccctaaatgacatggggaaggttagaaaagatatccagcagtgggagccatcgcggggatggaacgactggacccaagtgcccttttgctcacatcacttccacgaacttgtcatgaaggatggtagggtgctggtggtcccttgtcgaagccaggacgagctcattggccgtgcaagaatctcccagggggcgggatggagtctgaaagaaacagcctgcttgggcaagtcttacgctcagatgtggactttaatgtattttcatcgccgggatctgaggctcgccgcaaacgctatttgtagcgccgttccatcccactgggtgccgacctcaagaacgacatggagtatccatgcaaaacacgagtggatgaccactgaggacatgcttgccgtatggaatcgcgtgtggatacaagaaaacccctggatggaggacaagacacctgtcgaatcttgggaggaagtgccatacctgggtaagcgggaggatcagtggtgcgggagcctaatcggactgacctccagggcgacttgggctaaaaatattcagaccgccatcaaccaggttcgatcactcattggcaatgaggaatatacagactacatgcccagcatgaagagattccggaaagaggaagaggaagcaggcgtgttgtggtga

SEQ ID NO: 14677 - RNA, 9876 nt, synthetic construct
  misc_feature 1..9876: note = derived and/or modified CDS sequence (opt3) from DENV-2__EU569717__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgaggtaaaatcttgccactggcctaagtcccatacgttgtggagtaatggagtcctcgaaagcgagatgatcattccaaaaaacttcgccggccccgtgtctcagcacaactaccgacctggttatcatacacagaccgcaggcccatggcacctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtacgggatggaaattaggccattgaaggagaaggaagagaacctggtgaatagcttagttactgccggacatggccaaatagataacttttcgctcggtgtgctgggcatggcgcttttcctggaagagatgttgcgcacacgagtagggaccaaacacgccatcctcctggtcgctgtgtcctttgtgactctaattacaggaaatatgtctttccgggacctgggccgtgtcatggttatggtgggggcaaccatgacggatgacatcggaatgggcgtaacttatctcgccctgcttgctgcctttaaggtgagacccaccttcgcagcgggtttgctgttaaggaaactcacaagcaaggagctgatgatggccaccattgggatcgctcttctgtcacagagtactatacctgaaacaatcctagagctcaccgatgccctggcattgggaatgatggtcctgaaaattgtgcgcaacatggaaaagtaccagttagctgttacaatcatggccatttcctgcgtgcccaatgcagtcatcctccaaaacgcctggaaggtgtcttgtactatactggctgcggttagcgtgtccccacttctgttgacctcaagccagcagaaagccgactggattcctctcgcactgacgatcaagggcctaaatcccacagctatctttctgaccactcttagtcggacctctaaaaagagatcctggccactcaacgaggccgtcatggccgtaggcatggtgagcattctggcttcgtcattgctgaaaaatgacataccgatgacagggcctttagttgcaggaggtctcctgactgtgtgctatgtccttaccggcaggtctgccgatctggaattggagcgagcggctgacgtgaagtgggaggatcaggccgaaatcagtgggtccagccccattctctctatcacgattagcgaggacggatccatgtcaatcaaaaacgaagaggaggaacacacactgaccatactaatccgcactggcctgcttgtaattagtggtgtgttcccagtcagcatccccattacagcagccgcttggtacctctgggaggttaagaagcaacgggcaggggtgctgtgggatgtgccttctccaccccctgtcggaaaagccgaattggaggacggcgcgtatagaatcaagcagaggggcatatttgggtactcccagattggagctggtgtgtataaagaaggcaccttccatactatgtggcacgttacacgtggggccgtattaatgcatcgcggaaagcggatcgagccgtcatgggcagatgtgaaaaaggacctgatcagttacggcggtgggtggaagctcgagggagaatggaaagagggcgaagaggtccaggtgctggcccttgaaccaggcaagaatcccagagctgttcaaaccaaacctgggctgtttaagacgaacactggaaccattggtgccgtgagcttggatttctccccaggcacatctgggtcgcccatcgtcgacaggaaaggaaaggtggtaggcctatacggtaatggggtcgtgacccgaagcggagcatatgtttcagctatagcccagacagagaagtccattgaggataaccctgaaatcgaggacgatattttccggaaaaagcgcctgactatcatggacctccacccgggcgcgggcaaaaccaagagatacctgcccgccatagtgagggaagcaattaaacgggggcttcgaacgttaatcctggctccaacaagagtcgtggccgctgagatggaagaggcactccgcggattgcctatcaggtatcagactcccgccattcgtgccgagcataccggtcgggaaatcgttgacctgatgtgtcacgctacatttaccatgagactcctgagtccagtgagggtccctaactacaatcttattataatggatgaggcgcacttcactgaccccgcatctatcgccgctcgcggctatattagcacccgagtggaaatgggggaggccgcaggaatctttatgacagccacgccaccgggctccagagatcctttcccccagtcaaacgctccaatcatggacgaggaacgggagattcccgaaaggtcttggaatagcggtcatgagtgggtaactgattttaaggggaagaccgtgtggttcgttcctagtataaaagcgggaaacgacatcgccgcatgcctgcgcaagaatggcaaaaaggtcattcaattgtcccgtaaaacatttgatagcgaatacgtgaagaccagagctaacgactgggatttcgtggtcactacagacatctctgagatgggcgccaattttcgggcagagagggtaattgatccacgccgatgtatgaagcccgtgatcctaaccgacggggaagagagagttatactggccggacctatgccggtgacgcactcatccgctgcccagcggaggggtcgcatcggcagaaacccaaaaaatgaaaacgaccagtatatttacatgggggagcccctcgaaaatgatgaggactgcgcgcattggaaggaggcaaaaatgttactggataacatcaatactcctgaaggaattatccccagtatgttcgagccagaaagggagaaggtcgacgccatagatggcgaataccggcttcgtggtgaggctcgcaaaacatttgtggacctgatgcgaagaggggatctccctgtttggttggcctatagggtggctgcagagggcattaactacgccgaccggcgctggtgtttcgatggaatcaagaataaccaaattctggaagagaacgtcgaagtggagatctggaccaaagagggcgaaagaaagaagctcaaacccaggtggctggacgctcggatatatagcgatccacttgccctaaaggagttcaaagaatttgcagcggggcgaaagtcgctgaccttgaatttaatcactgagatgggaagactgcctacattcatgacccagaaagcccgcgacgctctcgataacctggccgtacttcacacagcagaagtgggtggcagggcttacaatcacgccctgtctgagctcccggagactttggaaacgctgctactgctcacccttctggcaacagttactgggggaatttttttattcttgatgtccggcaagggtatcgggaagatgaccctgggcatgtgctgcattatcacagccagcatactcctgtggtatgctcagattcagccccattggatcgcggcctcaatcattcttgagtttttcctgatcgtcctcttgataccagaacctgagaaacaacggaccccccaggacaaccagctgacttacgtggtgattgcaatcttaacggtcgttgctgccaccatggccaatgaaatgggatttctagagaagacaaaaaaggacctgggcctcgggagtattactacccaggagtctgaatccaacatccttgatatagacctgcgtccagcaagcgcttggacattgtatgccgtggcgaccactttcgtaacacctatgctgagacactcaatcgagaatagtagcgtgaacgtctccctcacggctattgccaatcaagcaaccgtgctgatgggacttggtaggggctggcccctctctaaaatggatatcggggttccgctgttggccattggatgttacagccaggtgaacccaatcactctgacagctgcattactactgctcgtcgcccattacgcgattatcggccctggtcttcaggctaaggccacccgcgaagcacagaagcgggccgctgccgggataatgaaaaatcccaccgtagacggcattacagtgatcgatctggagccaatcccctatgaccctaagtttgaaaaacaattgggacaggttatgctgctcgtgctgtgcgtcactcaggtgcttatgatgcgaacgacctgggcattatgtgaggctctgacactcgccactggcccgatttccaccttgtgggaggggaaccccggaagattctggaatacaaccatagcggtctcaatggccaacatctttaggggctcttacctggcaggtgctgggctactgttcagtattatgaagaatactacgaacacacgccggggaaccggcaatatcggtgaaactctcggcgagaaatggaagtcgagacttaacgccctggggaagagcgaatttcagatttataaaaagtccggaatccaagaggtggatcgtaccttggcaaaagagggcataaagaggggggaaacagaccaccatgctgtttctcggggatcagccaaactgcgctggttcgtggagcgaaacatggtaactccagaaggcaaggtggtcgatctcggttgcgggagaggaggctggagctactattgtggtggcctgaaaaatgttagggaggtgaaggggttaaccaagggaggccctgggcacgaagagcccatccctatgtccacatacggatggaaccttgtccggctgcagagtggcgtggacgtattctttacgccacccgagaaatgcgataccctcctatgtgacattggtgaatctagccctaatccaactatcgaggccgggcgcacactgagagtgttgaacctggttgaaaattggctcaacaataacacccagttctgcattaaggtgcttaatccctatatgccgtcagtcatcgagaaaatggaaactctgcaaaggaagtacggaggcgcgttggtgcgaaaccctctgtcccggaatagtacacacgagatgtactgggtcagcaacgctaccggcaatatagtgtcttccgttaacatgatttcacgtatgctcgtaaatagatttacgatgaaacataagaaggcaacctatgagccagatgtggacttagggagcggaacacgcaacatcggtatcgaaaacgagattcccaatctggacataatcggcaaaaggattgaaaagatcaaacaggagcacgaaacttcgtggcattacgatcaggaccacccttataagacctgggcctaccacgggtcttatgagacaaaacagactggaagtgcttccagcatggtcaacggcgtggttcggcttctgaccaagccatgggatgtggtccccatggtgacacaaatggccatgaccgacactacgccgttcggtcagcagagagtatttaaggagaaagtggatacacgcacccaggaacctaaggaggggactaaaaagctaatgaggattaccgcagaatggctctggaaagagctgggaaagaagaaaacaccccgaatgtgtacgcgggaggaattcaccagaaaggttaggtcaaatgccgctttgggcgcgatctttactgacgagaacaaatggaagtccgcccgcgaagcagtcgaggattctcgtttctgggaactggtggaccgggagagaaatctccatcttgagggcaaatgcgaaacatgtgtgtacaacatgatggggaagagggagaaaaagctgggagaatttggtaaggctaaaggcagccgcgccatatggtatatgtggttaggggcacgattcctggagtttgaagccttgggattcctcaatgaggatcactggtttagtcggggcaactccctgagcggtgtcgagggggaaggactacataagcttggctacatcctgagagacgtttctaaaaaggagggcggggctatgtacgccgatgacaccgcgggatgggacactaggattacactcgaagatctgaaaaatgaggaaatggtgaccaaccacatgaagggtgagcataagaaattggcagaggccatcttcaagctgacatatcaaaataaagtagtgcgcgtccagagaccaactcctcggggcaccgtgatggacattatctcaaggaaggatcagcgtgggagtggacaggttggcacgtacggtctcaacaccttcacaaatatggaagctcaacttattcgacagatggagggggaaggaatatttaaatccatccagcgcctgactgtgaccgaggagattgccgtccaaaactggttagcaagagtgggccgggaaaggctgagccgcatggctatctctggcgacgattgcgtagttaagcccttggacgatagattcgcctcggctctcacagccctgaatgacatggggaaggtgcggaaagatatccagcagtgggagccatcaaggggatggaacgactggactcaggtccccttttgcagccaccacttccatgaactagtgatgaaggatggtcgagtgcttgtcgttccttgtcgtaaccaagacgagctgattggcagagcacgcatatcccagggggcgggatggagtctcaaagaaaccgcctgcctgggcaagtcttatgctcagatgtggacgttgatgtactttcaccggagggatttaagactggccgcaaatgctatctgtagcgccgtgccatcccattgggtaccgacatcacgcaccacttggagtattcacgcaaaacacgagtggatgacaaccgaggacatgctcgccgtgtggaaccgggtctggatccaggaaaatccctggatggaggacaagactcctgtggaatcttgggaggaagttccatatcttggtaagagggaggatcaatggtgcgggagcctgattggactaacctcccgagcgacatgggctaaaaacatccagacggccataaatcaggtgagatcactgatcggcaacgaggaatacaccgactatatgcccagcatgaagcggttcaggaaagaggaagaggaagcaggcgtcctctggtga

SEQ ID NO: 14678 - RNA, 9876 nt, synthetic construct
  misc_feature 1..9876: note = derived and/or modified CDS sequence (opt3) from DENV-2__EU569718__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagtatgctgttggcaatgacacggggaagcatggaaaagaaattaagatcacaccgcagtcctcaataaccgaggccgaacttactggctacggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcacgccaaaaagcaggacgtggttgtgttgggctctcaagaaggggcgatgcataccgccctaactggagcaacagagatccagatgtcctcaggtaatctgctctttaccggccacctgaaatgccgtcttcgcatggataagctgcagttgaaagggatgagctatagtatgtgtacaggaaagttcaagatcgtcaaagaaattgctgagactcaacatggcaccatcgtgattagagtacagtacgagggtgacgggtctccatgcaagatacccttcgaaatcatggatctcgagaaaaggcacgttctgggccggttaattacggtgaacccgatcgtcaccgaaaaggactcccctgtgaacgtcgaggccgaacccccatttggagatagctacatcattataggcgtggagcctgggcagctgaaactaaattggttcaagaagggatcgtctatcggtcagatgtttgagacaactatgcgaggcgctaaacgcatggccattctcggggacaccgcatgggatttcggatccctgggcggtgtttttacatcaatcgggaaggcccttcatcaagtgttcggcgctatttatggagcggcatttagtggcgtaagctggactatgaaaatcttgataggggtcatcattacctggatcggaatgaactccagatctacgagcctgtcagtgagtctcgttctggtgggcgtcgtgacactttacctgggtgtaatggtgcaggccgactccgggtgtgttgtcagctggaagaataaagaattgaagtgcggatctggcattttcatcaccgataacgtgcacacttggacagagcagtataagtttcagcccgaatcaccaagtaaactcgctagcgccatacaaaaggcacacgaggaaggtatttgtggcatcaggtccgtgacccggctggagaatttaatgtggaaacagattactcccgagctgaaccatatcctatctgaaaatgaggtcaagctcaccataatgacaggggacatcaaaggaattatgcaggccggcaagcgctcgctgagacctcagccaacggaacttaaatacagctggaagacctgggggaaggctaaaatgttgtccactgagtcacacaaccaaacattcctgatcgatggaccggaaaccgccgagtgccccaatacaaacagggcatggaatagtctcgaggttgaagactatggctttggtgtgttctctactaacatttggctgaagttacgtgagaaacaggacgtgttttgtgatagcaagctgatgtccgcggctatcaaagacaatcgggccgtacatgcagatatggggtactggatagaatcagcccttaacgacacctggaagatggagaaggctagcttcattgaggtcaaatcttgccactggcctaagtcccacacgttgtggagtaatggagtgctcgaaagcgagatgatcatcccaaaaaacttcgccggccccgtttctcagcataactatcgacctggttaccacacacagaccgcaggcccatggcatctggggaagctagaaatggattttgacttctgtgagggaactaccgtggtcgtgacagaagattgcggcaatagagggccctccctgaggactaccacagcttcaggaaaactcattacggagtggtgctgtcgcagttgcaccctgccgcctcttcggtacagaggcgaggacggttgttggtatgggatggaaatcaggccattgaaggagaaggaagagaacctggttaatagcttagtgactgccggacacggccaaattgataacttttcgctcggtgtactgggcatggcgcttttcctggaagagatgttgcgcacacgagtcgggaccaaacatgccatactcctggtggctgtgtcctttgtcactctaatcacaggaaatatgtctttccgggacctgggccgtgttatggtgatggtaggggcaaccatgacggatgacattggaatgggcgtgacttacctcgccctgcttgctgcctttaaggtcagacccaccttcgcagcgggtttgctgttaaggaaactcacaagcaaggagctgatgatggccaccatcgggattgctcttctgtcacagagtactatccctgaaacaatactagagctcaccgatgccctggcattgggaatgatggtgctgaaaatcgttcgcaacatggaaaagtatcagttagctgtgacaattatggccatctcctgcgtccccaatgcagtgattctccaaaacgcctggaaggtttcttgtactatcctggctgcggtgagcgtctccccacttctgttgacctcaagccagcagaaagccgactggatacctctcgcactgacgattaagggcctaaatcccacagctatctttctgaccactcttagtcggacctctaaaaagagatcctggccactcaacgaggccgtaatggccgtgggcatggttagcatcctggcttcgtcattgctgaaaaatgacattccgatgacagggcctttagtggcaggaggtctcctgactgtctgctacgtgcttaccggcaggtctgccgatctggaattggagcgagcggctgacgtaaagtgggaggatcaggccgaaataagtgggtccagccccatcctctctattacgatcagcgaggacggatccatgtcaattaaaaacgaagaggaggaacaaacactgaccatcctaatacgcactggcctgcttgtgatcagtggtgtcttcccagttagcattcccatcacagcagccgcttggtatctctgggaggtgaagaagcagcgggcaggggtgctgtgggatgtcccttctccaccccctgtgggaaaagccgaattggaggacggcgcgtacagaattaagcagaggggcatctttgggtattcccagataggagctggtgtttacaaagaaggcaccttccacactatgtggcacgtaacacgtggggccgtgttaatgcatcgcggaaagcggattgagccgtcatgggcagatgtcaaaaaggacctgatcagttacggcggtgggtggaagctcgagggagaatggaaagagggcgaagaggtgcaagttctggcccttgaaccaggcaagaatcccagagctgtgcagaccaaacctgggctgtttaagacgaacactggaaccatcggtgccgtcagcttggatttctccccaggcacatctgggtcgcccattgtggacaggaaaggaaaggtagtcggcctatatggtaatggggtggttacccgaagcggagcatacgtgtcagctatcgcccagacagagaagtccatagaggataaccctgaaattgaggacgatatcttccggaaaaagcgcctgactattatggacctccacccgggcgcgggcaaaaccaagagatatctgcccgccatcgtcagggaagcaataaaacgggggcttcgaacgttaattctggctccaacaagagtggttgccgctgagatggaagaggcactccgcggattgcctatcaggtaccagactcccgccatccgtgccgagcataccggtcgggaaattgtggacctgatgtgtcacgctacatttaccatgagactcctgagtccagtcagggtgcctaactataatcttatcattatggatgaggcgcatttcactgaccccgcatctatagccgctcgcggctacatcagcacccgagtagaaatgggggaggccgcaggaatttttatgacagccacgccaccgggctccagagatcctttcccccaatcaaacgctccaatcatggacgaggaacgggagatccccgaaaggtcttggaatagcggtcacgagtgggtgactgattttaaggggaagaccgtttggttcgtccctagtattaaagcgggaaacgacatagccgcatgcctgcgcaagaatggcaaaaaggtgatccagttgtcccgtaaaacatttgatagcgaatatgtgaagaccagagctaacgactgggatttcgtcgtaactacagacatttctgagatgggcgccaattttcgggcagagagggtgatcgatccacgccgatgtatgaagcccgttattctaaccgacggggaagagagagtgatcctggccggacctatgccggtcacgcactcatccgctgcccagcggaggggtcgcataggcagaaacccaaaaaatgaaaacgaccaatacatctacatgggggagcccctcgaaaatgatgaggactgcgcgcattggaaggaggcaaaaatgttactggataacattaatactcctgaaggaatcattcccagtatgttcgagccagaaagggagaaggtggacgccatcgatggcgaatatcggcttcgtggtgaggctcgcaaaacatttgttgacctgatgcgaagaggggatctccctgtgtggttggcctacagggtcgctgcagagggcataaactatgccgaccggcgctggtgtttcgatggaattaagaataaccagatcctggaagagaacgtggaagtagagatttggaccaaagagggcgaaagaaagaagctcaaacccaggtggctggacgctcggatctacagcgatccacttgccctaaaggagttcaaagaatttgcagcggggcgaaagtcgctgaccttgaatttaataactgagatgggaagactgcctacattcatgacccagaaagcccgcgacgctctcgataacctggccgtgcttcacacagcagaagttggtggcaaggcttataatcatgccctgtctgagctcccggagactttggaaacgctgctactgctcacccttctggcaacagtcactgggggaatctttttattcttgatgtccggcaagggtattgggaaaatgaccctgggcatgtgctgcatcattacagccagcatcctcctgtggtacgctcagatacaaccccactggattgcggcctcaatcatccttgagtttttcctgattgtgctcttgatcccagaacctgagaagcagaggaccccccaggacaaccagctgacttatgtggtcatagcaattttaacggttgtggctgccaccatggccaatgaaatgggatttctagagaaaacaaagaaagacctgggcctcgggagtatcactacccaagagtctgaatccaacattcttgatatcgacctgcggccagcaagcgcttggacattgtacgccgtagcgaccactttcgtgacacctatgctgcgtcactcaatagagaatagtagcgtcaacgtgtccctcacggctatcgccaatcaggcaaccgttctgatgggacttggtagaggctggcccctctctaagatggatattggggtgccgctgttggccatcggatgttacagccaggtcaacccaattactctgacagctgcattactactgctcgtagcccattatgcgatcattggccctggtcttcaggctaaggccaccagggaagcacaaaaacgcgccgctgccgggatcatgaagaatcccaccgtggacggcataacagttattgatctggagccaatcccctacgaccctaaatttgaaaagcagttgggacaggtgatgctgctcgtcctgtgcgtgactcaggtccttatgatgcggacgacctgggcattatgtgaggctctgacactcgccactggcccgatctccaccttgtgggaggggaaccccggacgattctggaatacaaccattgcggtgtcaatggccaacatatttagaggctcttatctggcaggtgctgggctactgttcagtatcatgaaaaatactacgaacacaaggcgcggaaccggcaatattggtgaaactctcggcgagaagtggaagtcgcggcttaacgccctggggaaaagcgaatttcaaatctacaagaaatccggaattcaggaggttgatagaaccttggcaaaggagggcatcaaacgtggggaaacagaccaccatgctgtgtctaggggatcagccaagctgcggtggttcgtagagcgcaacatggtgactccagaaggcaaagtcgttgatctcggttgcgggcgaggaggctggagctattactgtggtggcctgaagaatgtgagagaggtcaaggggttaaccaaaggaggccctgggcacgaagagcccatacctatgtccacatatggatggaaccttgtgaggctgcagagtggcgtagacgtgttctttacgccacccgagaagtgcgataccctcctatgtgacatcggtgaatctagccctaatccaactattgaggccgggcggacactgcgcgttttgaacctggtggaaaattggctcaacaataacacccaattctgcatcaaagtccttaatccctacatgccgtcagtgattgagaagatggaaactctgcagagaaaatacggaggcgcgttggtcaggaaccctctgtcccgaaatagtacacatgagatgtattgggtgagcaacgctaccggcaatatcgtttcttccgtaaacatgatatcacggatgctcattaatcgttttacgatgaagcacaagaaagcaacctacgagccagatgtggacttagggagcggaacaagaaacatcggtatcgaaaacgagattcccaatctggacataatcggcaagcgcattgaaaaaatcaagcaggagcacgaaacttcgtggcattatgatcaggaccacccttacaaaacctgggcctatcatgggtcttacgagacaaagcaaactggaagtgcttccagcatggtcaacggcgtggttaggcttctgaccaagccatgggatgtggtccccatggtgacacagatggccatgaccgacactacgccgttcggtcagcagcgggtatttaaagagaaggtggatacaagaacccaagaacctaaagaggggactaagaaactaatgcgcattaccgcagaatggctctggaaggagctgggaaagaaaaagacacccaggatgtgtacgcgagaggaattcacccggaaagttagatcaaatgccgctttgggcgcgatctttactgacgagaacaagtggaaatccgccagggaagcagtcgaggattctcgcttctgggaactggtggaccgtgagcggaatctccaccttgagggcaagtgcgaaacatgtgtgtataacatgatggggaaaagagagaagaagctgggagaatttggtaaagctaagggcagcagggccatatggtacatgtggttaggggcacgcttcctggagtttgaagccttgggattcctcaatgaggatcactggtttagtcgaggcaactccctgagcggtgtcgagggggaaggactacataaacttggctacatcctgcgggacgtttctaagaaagagggcggggctatgtatgccgatgacaccgcgggatgggacactagaattacactcgaagatctgaagaatgaggaaatggtgaccaaccacatgaagggtgagcataaaaagttggcagaggccatcttcaaactgacataccagaataaggtagtgagggtccagcgcccaactcctagaggcaccgtgatggacattatctcacggaaagatcagagggggagtggacaagttggcacgtatggtctcaacaccttcacaaatatggaagctcagcttattcgtcagatggagggggaaggaatatttaagtccatccaacgactgactgtgaccgaggagattgccgtccagaactggttagcacgcgtgggcagagaacggctgagcaggatggctatctctggcgacgattgcgtagttaagcccttggacgatcgcttcgcctcggctctcacagccctgaatgacatggggaaagtgagaaaggatatccagcagtgggagccatcacggggatggaacgactggactcaagtccccttttgcagccaccatttccacgaactagtgatgaaagatggtagggtgcttgtcgttccttgtcgaaaccaggacgagctgattggccgtgcaagaatatcccagggggcgggatggagtctcaaggaaaccgcctgcctgggcaaatcttacgctcagatgtggacgttgatgtattttcaccgccgggatttaaggctggccgcaaatgctatctgtagcgccgtgccatcccattgggtaccgacatcaagaaccacttggagtattcacgcaaagcatgagtggatgacaaccgaggacatgctcgccgtgtggaaccgcgtctggatccaagaaaatccctggatggaggacaagactcctgtggaatcttgggaggaagttccataccttggtaaacgggaggatcagtggtgcgggagcctgattggactaacctccagggcgacatgggctaagaacatccagacggccataaatcaggtgcgatcactgatcggcaacgaggaatataccgactacatgcccagcatgaaaagattccggaaggaggaagaggaagcaggcgtcctctggtga

SEQ ID NO: 14679 - RNA, 9876 nt, synthetic construct
  misc_feature 1..9876: note = derived and/or modified CDS sequence (opt3) from DENV-2__EU596488__SS-prME
  source 1..9876: mol_type = other RNA
accgccggcgtgatcattatgctgatacccacagtcatggctttccacctcactacgagaaacggggagcctcatatgatcgttggaaggcaggaaaagggtaaaagccttctgtttaagaccgaggacggcgtgaatatgtgcacattgatggcaattgatttaggggaactgtgtgaggacactatcacctacaaatgcccactactccggcaaaacgaaccggaggatattgactgttggtgcaattccacatctacctgggtaacttatggaacatgtaccacgactggcgagcaccgccgagaaaagcgttcagtggccctggtcccccatgtgggtatggggcttgagaccagaacagaaacttggatgagtagcgagggagcgtggaaacacgttcagaggatcgagacctggatactgcggcatcctggcttcacaatcatggctgccattttggcatacaccatcggcacgactcactttcagcgcgccctcattttcatcctgctgacagctgtggcaccatccatgaccatgagatgcatagggatttctaacagggattttgtcgaaggagtgtcgggtggctcatgggtagacatcgttctcgagcacgggagctgtgtgactacaatggccaagaataagcccaccttagatttcgaactgattaaaacggaggctaagcagcctgccacccttcggaaatattgcatcgaagcgaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggattgtgacctgcgcaatgtttacatgcaaaaagaatatggaaggaaaagtggtcctccctgagaacctggaatacaccatagttatcactccacacagcggtgaggagcatgccgtgggcaatgacacggggaagcacggaaaagaaattaagatcacaccgcagtcctcaataaccgaggctgaacttactggctatggtaccgtaacaatggagtgtagtcccaggaccgggctggatttcaacgaaatggtgttgctccagatggaggacaaagcctggctggtccaccggcaatggtttttagatctgcctctcccatggcttcccggcgcagacactcagggaagcaattggattcagaaggagacactggtgacgttcaagaaccctcatgctaaaaagcaggacgttgtggtcttgggctctcaagaaggggccatgcacaccgcgctaactggagccacagagatccagatgtcctcaggtaatctgctctttaccggccatctgaaatgccgtcttcgcatggataagctgcagttgaaagggatgagctacagtatgtgtacaggaaagttcaagatcgtgaaagaaattgcagagactcaacacggcaccatcgtaattagagttcagtatgagggtgacgggtctccatgcaagatacccttcgaaatcatggatctcgagaaaaggcatgtgctgggccggttaattacggtcaacccgatcgtgaccgaaaaggactcccctgtcaacatcgaggctgaacccccatttggagatagctacattataatcggcgtggagcctgggcagctgaaactaaattggttcaagaagggatcgtctattggtcagatgtttgagacaactatgcgaggcgccaaacgcatggctatcctcggggacaccgcctgggatttcggatccctgggcggtgtttttacatcaattgggaaggcacttcaccaagtgttcggcgccatctacggagctgcgtttagtggcgtaagctggactatgaaaatattgatcggggtcattatcacctggattggaatgaactccagatctacgagcctgtcagtgagtctcgttctggtgggcgtcgtgacactttatctgggtgtaatggtgcaggcagacaccgggtgtgttgtctcctggaagaataaagaattgaagtgcggaagcggcatcttcataactgataacgtgcacacatggaccgagcagtacaagtttcagcccgaatctccatcaaaactcgccagtgctattcaaaaggcccatgaggaaggtatctgtggcattaggagcgtgactcggctggagaatttaatgtggaaacagatcacccccgagctgaaccacatactatccgaaaatgaggtcaagctcacaatcatgacgggggacattaaaggaatcatgcaggcaggcaagcgctctctgagacctcagccaaccgaacttaaatattcgtggaagacttgggggaaggccaaaatgttgagcacagagtcccataaccaaaccttcctgattgatggaccggaaacagctgagtgccccaatactaacagggcctggaattcactcgaggttgaagactacggctttggtgtgttcagtaccaacatctggctgaagttacgtgagaaacaggacgtgttttgtgattctaagctgatgagcgcagcgataaaagacaatcgggctgtacacgccgatatggggtattggattgaatccgcacttaacgacacgtggaagatggagaaggcctcattcatcgagatcaaaagctgccactggcctaagtctcatacattgtggtccaatggagtcctcgaaagtgagatgattatcccaaaaaacttcgctggccccgtgagccagcacaactaccgacctggttatcatacccagactgccggcccatggcacctggggaagctagaaatggattttgacttctgtgagggaaccacagttgtggtcactgaagattgcggcaatagagggccctctctgaggaccacaacggcatccggaaaactcattaccgagtggtgctgtcgctcatgcactctgccgcctcttcggtacagaggcgaggacggttgttggtacgggatggaaataaggccattgaaggagaaggaagagaacctggtgaatagtttagttacagctggacatggccaaatcgataactttagcctcggtgtgctgggcatggcccttttcctggaagagatgttgcgcacccgagtagggactaaacacgcgattctcctggtcgccgtgtcgtttgtgacactaatcaccggaaatatgtccttccgggacctgggccgtgtcatggttatggtgggggctacgatgactgatgacattggaatgggcgtaacctatctcgcactgcttgccgcttttaaggtgagacccacattcgccgcaggtttgctgttaaggaaactcacctctaaggagctgatgatggcgactatcgggatagcccttctgagccagtcaacaatccctgaaaccattctagagctcacagatgctctggccttgggaatgatggtcctgaaaatcgtgcgcaacatggaaaagtaccagttagcagttactattatggctatcagttgcgtgcccaatgccgtcatactccaaaacgcatggaaggtgtcctgtaccattctggccgctgtttctgtgagcccacttctgttgacgtcctcacagcagaaagcggactggatccctctcgccctgacaatcaagggcctaaatcccaccgcaatttttctgactacccttagccggacaagtaaaaagagatcttggccactcaacgaggctgtcatggccgtaggcatggtgtccatactggccagctcgttgctgaaaaatgacatcccgatgactgggcctttagttgctggaggtctcctgaccgtgtgctatgtccttacgggcaggtcagcagatctggaattggagcgagccgcggacgtgaagtgggaggatcaggctgaaatttctgggagttcccccatcctcagcattacaatctctgaggacggaagcatgtccataaaaaacgaagaggaggaacacaccctgactatcctaattcgcacaggcctgcttgtaatctcaggtgtgttcccagtcagtattcccatcaccgccgcagcctggtacctctgggaggttaagaagcaacgggctggggtgctgtgggatgtgcctagcccaccccctgtcggaaaagcagaattggaggacggcgcctatagaataaagcagaggggcatttttgggtactctcagatcggagcgggtgtgtataaagaaggcactttccatacaatgtggcacgttacccgtggggctgtattaatgcatcgcggaaagcggatcgagccgtcctgggccgatgtgaaaaaggacctgatttcatacggcggtgggtggaagctcgagggagaatggaaagagggcgaagaggtccaggtgctggcacttgaaccaggcaagaatcccagagccgttcaaacgaaacctgggctgtttaagactaacaccggaacaatcggtgctgtgagtttggatttcagcccaggcacctccgggtctcccatagtcgacaggaaaggaaaggtggtaggcctatacggtaatggggtcgtgacacgatcgggagcctatgttagcgcaattgctcagactgagaagtcaatcgaggataaccctgaaattgaggacgatatcttccggaaaaagcgcctgaccataatggacctccacccgggcgccggcaaaacgaagagatacctgcccgcgattgtgagggaagccatcaaacgggggcttcgaacattaatcctggcaccaactagagtcgtggctgccgagatggaagaggctctccgcggattgcctattaggtatcagacccccgcaatccgtgccgagcatacaggtcgggaaattgttgacctgatgtgtcacgccacctttactatgagactcctgtccccagtgagggtccctaactacaatcttataatcatggatgaggctcacttcaccgaccccgcgagtattgcagcccgcggctatatctctacacgagtggaaatgggggaggctgccggaatctttatgacggcaactccaccgggcagcagagatcctttcccccagtccaacgccccaattatggacgaggaacgggagatacccgaaaggtcatggaattctggtcatgagtgggtaaccgattttaaggggaagacagtgtggttcgttcctagcatcaaagctggaaacgacattgcggcctgcctgcgcaagaatggcaaaaaggtcatccaattgagtcgtaaaacctttgattccgaatacgtgaagactagagcaaacgactgggatttcgtggtcacaaccgacattagcgagatgggcgctaattttcgggccgagagggtaatcgatccacgccgatgtatgaagcccgtgatactaacggacggggaagagagagttatcctggcaggacctatgccggtgactcactcttcagccgctcagcggaggggtcgcattggcagaaacccaaaaaatgaaaacgaccagtatatctacatgggggagcccctcgaaaatgatgaggactgcgcccattggaaggaggcgaaaatgttactggataacattaatacacctgaaggaatcataccctccatgttcgagccagaaagggagaaggtcgacgcaattgatggcgaataccggcttcgtggtgaggcccgcaaaacctttgtggacctgatgcgaagaggggatctccctgtttggttggcttatagggtggccgctgagggcatcaactacgcagaccggcgctggtgtttcgatggaattaagaataaccaaatcctggaagagaacgtcgaagtggagatatggaccaaagagggcgaaagaaagaagctcaaacccaggtggctggacgcccggatctatagtgatccacttgctctaaaggagttcaaagaatttgccgcagggcgaaagagcctgactttgaatttaattacagagatgggaagactgcctaccttcatgacacagaaagcgcgcgacgccctcgataacctggctgtacttcacactgccgaagtgggtggcagggcatacaatcacgctctgtcggagctcccggagacgttggaaaccctgctactgctcacacttctggccactgttaccgggggaatctttttattcttgatgtctggcaagggtattgggaagatgacactgggcatgtgctgcatcataaccgcatccattctcctgtggtatgcccagatccagccccattggatcgctgcgagcattatccttgagtttttcctgatagtcctcttgattccagaacctgagaaacaacggactccccaggacaaccagctgacgtacgtggtgatcgccattttaaccgtcgttgcagctacaatggccaatgaaatgggatttctagagaagactaaaaaggacctgggcctcgggtcaatcaccacacaggagagtgaatctaacatacttgatatcgacctgcgtccagcctccgcatggaccttgtatgctgtggccactacattcgtaacgcctatgctgagacacagcattgagaattcaagtgtgaacgtcagcctcaccgcgatcgctaatcaagccactgtgctgatgggacttggtaggggctggcccctctccaaaatggatattggggttccgctgttggcaatcggatgttactctcaggtgaacccaattacactgaccgccgctttactactgctcgtcgcacattacgccatcataggccctggtcttcaggcgaaggctacccgcgaagcccagaagcggacagcagccgggattatgaaaaatcccactgtagacggcatcacggtgatcgatctggagccaattccctatgaccctaagtttgaaaaacaattgggacaggttatgctgctcgtgctgtgcgtcacccaggtgcttatgatgcgaacaacttgggctttatgtgaggccctgaccctcgcaacaggcccgataagcaccttgtgggaggggaaccccggaagattctggaatactacgatcgctgtctccatggccaacatttttaggggctcatacctggcgggtgccgggctactgttctctatcatgaagaatacaattaacacccgccggggaactggcaatatcggtgaaaccctcggcgagaaatggaagagtagacttaacgcactggggaagtcggaatttcagatatataaaaagagcggaatccaagaggtggatcgtacattggctaaagagggcattaagaggggggaaactgaccaccatgccgtttcccggggatctgcaaaactgcgctggttcgtggagcgaaacatggtaaccccagaaggcaaggtggtcgatctcggttgcgggagaggaggctggtcatactattgtggtggcctgaaaaatgttagggaggtgaaggggttaacaaagggaggccctgggcacgaagagcccatccctatgagcacgtacggatggaaccttgtccggctgcagtccggcgtggacgtattctttaccccacccgagaaatgcgatactctcctatgtgacattggtgaaagttctcctaatccaacaatcgaggctgggcgcaccctgagagtgttgaacctggttgaaaattggctcaacaataacactcagttctgcgtgaaggtccttaatccctatatgccgagcgtgatagagaaaatggaaacactgcaaaggaagtacggaggcgccttggtccgaaaccctctgtcacggaattccacccacgagatgtactgggtgagtaacgccacgggcaatattgttagctctgtaaacatgatctcccgtatgctcatcaatagatttaccatgaaacataagaaggcgacatatgagccagatgtggacttagggtcaggaactcgcaacattggtatagaaaacgagatccccaatctggacattatcggcaaaaggattgaaaagatcaaacaggagcacgaaaccagctggcattacgatcaggaccacccttataagacatgggcttaccacgggtcgtatgagactaaacagaccggatctgcaagttccatggtcaacggcgtggttaagcttctgacaaagccatgggatgtggtccccatggtgacccaaatggccatgactgacacgacaccgttcggtcagcagcgggtatttaaagagaaggtggataccagaactcaggaacctaaagaggggaccaagaaactaatgcgcataacagctgaatggctctggaaggagctgggaaagaaaaagacgcccaggatgtgtacccgagaggaattcactcggaaagttagaagcaatgccgcattgggcgccatctttacagacgagaacaagtggaaatcagctagggaagcggtcgaggattcccgcttctgggaactggtggaccgtgagcggaatctccatcttgagggcaagtgcgaaacctgtgtgtacaacatgatggggaaaagagagaagaagctgggagaatttggtaaagccaagggctctagggcaatttggtatatgtggttaggggctcgcttcctggagtttgaagccttgggattcctcaatgaggatcactggtttagccgaggcaacagtctgtccggtgtcgagggggaaggactacataaacttggctacatcctgcgggacgttagcaagaaagagggcggggcaatgtacgccgatgacactgctggatgggacacaagaattaccctcgaagatctgaagaatgaggaaatggtgacaaaccacatgaagggtgagcataaaaagttggccgaggcgatcttcaaactgacttatcaaaataaggtagtgagggtccagcgcccaacccctagaggcacggtgatggacattatatctcggaaagatcagagggggtcaggacaggttggcacctacggtctcaacacattcactaatatggaagcacaacttatccgtcagatggagggggaaggaatttttaagagtatccagcgactgaccgtgacagaggagatcgccgtccaaaactggttagctcgcgtgggcagagaacggctgtccaggatggccattagcggcgacgattgcgtagttaagcccttggacgatcgcttcgcatctgctctcactgccctgaatgacatggggaaagtgagaaaggatatacagcagtgggagccatcgcggggatggaacgactggacccaggtccccttttgctcacaccacttccatgaactagtgatgaaagatggtagggtgcttgtcgttccttgtcgaaaccaagacgagctgatcggccgtgctagaattagccagggggccggatggtccctcaaggaaacggcatgcctgggcaaaagttatgcgcagatgtggacattgatgtactttcaccgccgggatttaaggctggccgctaatgccatctgttctgcagtgccaagccattgggtaccgacctccagaactacatggtcaattcacgctaagcacgagtggatgaccactgaggacatgctcgccgtgtggaaccgcgtctggatccaggaaaatccctggatggaggacaagacccctgtggaaagttgggaggaagttccatatcttggtaaacgggaggatcaatggtgcgggtctctgataggactaacaagcagggcaacgtgggccaagaacatccagaccgcgattaatcaggtgcgatccctgatcggcaacgaggaatacactgactatatgccctcaatgaaaagattccggaaggaggaagaggaagctggcgtcctctggtga

SEQ ID NO: 14680 - RNA, 9876 nt, synthetic construct
  misc_feature 1..9876: note = derived and/or modified CDS sequence (opt3) from DENV-2__EU596489__SS-prME
  source 1..9876: mol_type = other RNA
accgccggcgtgatcattatgctgatacccacagctatggctttccacctcactacgcgaaatggggaacctcatatgatcgtaggaaggcaggaaaagggtaaaagccttctgtttaagaccgaggacggcgttaatatgtgcacattgatggccattgatttaggggaactgtgtgaggacactatcacctacaaatgcccactactccggcaaaatgaaccggaggatattgactgttggtgcaattccacatctacctgggtgacttatggaacatgtaccacgactggcgagcaccgccgagaaaagcgttcagtggcgctggtgccccatgtcggtatggggcttgagaccaggacagaaacttggatgagtagcgagggagcttggaaacacgtgcagaggatcgagacctggatactgcggcatcctggcttcacaaccatggccgcaatcttggcctacacgattggcactacacactttcagcgcgctctcatcttcattctgctgaccgcagttgccccatccatgactatgagatgcatcgggatatctaacagggattttgtggaaggagtctcgggtggctcatgggtggacattgtactcgagcacgggagctgtgttacaaccatggctaagaataagcccacgttagatttcgaactgatcaaaaccgaggccaagcagcctgcgacacttcggaaatattgcattgaagcaaagttgactaacaccacaactgagagtcgctgtccaacccaaggagagccctccctgaatgaagaacaggacaaacgatttatctgcaagcattctatggtggatagaggctggggtaacgggtgtggactattcggcaagggcgggatcgtcacatgcgccatgtttacctgcaaaaagaatatggaaggaaaagtggtgctccctgagaacctggaatacactattgtcataacgccacacagcggtgaggagcatgctgttggcaatgacacagggaagcacggaaaagaaatcaagattaccccgcagtcctcaatcactgaggccgaacttaccggctatggtacagtgaccatggagtgtagtcccaggactgggctggatttcaacgaaatggtattgctccagatggaggacaaagcatggctggtgcaccggcaatggtttttagatctgcctctcccatggcttcccggcgctgacacacagggaagcaattggatacagaaggagacgctggtcaccttcaagaaccctcatgccaaaaagcaggacgtggttgtgttgggctctcaagaaggggcgatgcacactgccctaacaggagcaaccgagattcagatgtcctcaggtaatctgctctttacaggccatctgaaatgccgtcttcgcatggataagctgcagttgaaagggatgagctacagtatgtgtactggaaagttcaagatcgtcaaagaaatcgctgagacccaacacggcacgattgtgatcagagtacagtatgagggtgacgggtctccatgcaagattcccttcgaaataatggatctcgagaaaaggcatgttctgggccggttaatcaccgtgaacccgattgtcacagaaaaggactcccctgtgaacatcgaggccgaacccccatttggagatagctacatcattataggcgtcgagcctgggcagctgaaactaaattggttcaagaagggatcgtctatcggtcagatgtttgagactaccatgcgaggcgctaaacgcatggccattctcggggacacagcatgggatttcggatccctgggcggtgtgtttacttcaatcgggaaggcccttcaccaagttttcggcgctatttacggagcggcatttagtggcgtgagctggaccatgaaaatcttgataggggtaatcattacgtggatcggaatgaactccagatctacaagcctgtcagtcagtctcgtgctggttggcattgtgaccctttatctgggtgtcatggtgcaggccgacactgggtgtgtagtgtcctggaagaataaagaattgaagtgcggaagcggcatcttcataacagataacgttcacacctggactgagcagtacaagtttcagcccgagttcccatctaaactcgcttcagccattaagaaagcacatgaggaaggtatctgtggcattaggagtgtcacccggctggagaatttaatgtggaagcaaatcacacccgagctgaaccacatactaagcgaaaatgaggtgaaactcacgatcatgaccggggacattaagggaatcatgcaggccggcaaacgctccctgagacctcagccaactgaacttaagtattcttggaagacatgggggaaagctaagatgttgtcgaccgagagccataaccagacatttctgattgatggaccggaaactgccgagtgccccaataccaacagggcatggaactccctcgaggtggaagactacggcttcggtgtcttttcaacgaacatctggctgaaattacgtgagaagcaagacgttttctgtgatagtaaactgatgtctgcggctataaaggacaatcgggccgtgcacgcagatatggggtattggattgaaagcgcccttaacgacacatggaagatggagaaggcttccttcatcgagatcaagtcatgccactggcctaaaagccataccttgtggtctaatggagtgctcgaatccgagatgattatcccaaagaactttgccggccccgtaagtcagcacaactaccgacctggttatcatactcagaccgcaggcccatggcacctggggaaactagaaatggatttcgacttttgtgagggaacaactgtcgtggttaccgaagattgcggcaatagagggcccagcctgaggacaacgaccgcttctggaaagctcattactgagtggtgctgtcgctcctgcacactgccgcctcttcggtacagaggcgaggacggttgttggtacgggatggaaataaggccattgaaggagaaagaagagaacctggtaaattcattagtcaccgccggacatggccagatcgataacttcagtctcggtgtgctgggcatggcgctttttctggaagagatgttgcgcactcgagttgggacaaagcacgccattctcctggtggctgtcagcttcgtcaccctaatcacgggaaatatgtcgtttcgggacctgggccgtgtgatggtgatggtcggggcaactatgaccgatgacattggaatgggcgttacatatctcgccctgcttgctgccttcaaagtgagacccacctttgcagcgggtttgctgttaaggaagctcacttccaaagagctgatgatggccacaatcgggatagcacttctgtctcaaagcaccatccctgaaacaattctagagctcactgatgccctggcattgggaatgatggtactgaagatcgtgcgcaacatggaaaagtaccagttagctgtcaccattatggccatctcatgcgtgcccaatgcagttatactccagaacgcctggaaagtgagttgtacgattctggctgcggtctccgtgtctccacttctgttgacaagctcccaacagaaggccgactggatccctctcgcactgaccatcaaaggcctaaatcccactgctattttcctgaccacactttcacggactagcaagaaaagaagttggccactcaacgaggccgttatggccgtgggcatggtctctatactggcttccagcttgctgaagaatgacatcccgatgaccgggcctttagtagcaggaggtctcctgacggtgtgctatgttcttacaggcaggtcggccgatctggaattggagaaagcggctgacgtgaagtgggaggatcaggccgaaatttcagggtctagtcccatcctctccattaccatcagcgaggacggatctatgagcataaagaacgaagaggaggaacacactctgacaatcctaattcgaaccggcctgcttgtcatctccggtgtgtttccagtatcaattcccatcactgcagccgcttggtacctctgggaggtgaaaaagcagcgcgcaggggtcctgtgggatgttcctagtccaccccctgtgggaaaagccgaattggaggacggcgcgtatcggataaagcaaagaggcattttcgggtacagccagatcggagctggtgtgtataaagaaggcacatttcataccatgtggcacgtcacgagaggggccgtgttaatgcatcgtggaaagcgcatcgagccgtcttgggcagatgttaagaaagacctgatttcctacggcggtgggtggaagctcgagggagaatggaaagagggcgaagaggtacaggtgctggcccttgaaccaggcaagaatccccgggctgtccagactaaacctgggctgttcaagaccaacacaggaaccatcggtgccgtgtcattggatttcagtccaggcacaagcgggtcccccatagttgacagaaagggaaaagtggtcggcctatacggtaatggggtggtaactaggtctggagcatatgtctcggctattgcccaaaccgagaaaagcatcgaagataaccctgaaattgaggacgatatctttcggaaaaagagactgacgataatggacctccacccgggcgcgggcaaaacaaagcgctacctgcccgccattgtgagagaagcaatcaagagggggcttcggactttaatcctggctccaacccgagttgtggccgctgagatggaagaggcactcagaggattgcctattcgctatcagacacccgccatcagggccgagcataccggtcgtgaaattgtcgacctgatgtgtcacgctactttcaccatgcggctcctgtcaccagtgagagttcctaactacaatcttataatcatggatgaggcgcactttacagaccccgcatccattgccgctaggggctatatcagtacgcgcgtggaaatgggggaggccgcaggaatcttcatgactgccaccccaccgggctctcgagatccttttccccagagcaacgctccaattatggacgaggaaagagagatacccgaacggtcctggaactcaggtcatgagtgggtcacagatttcaaagggaagaccgtgtggtttgtaccttctatcaaagcgggaaacgacattgccgcatgcctgaggaagaatggcaaaaaggtgatccagttgagccgcaagactttcgatagtgaatacgttaaaacacgtgctaacgactgggattttgtcgtgaccacggacatttccgagatgggcgccaatttcagagcagagcgggtgatcgatccaaggcgctgtatgaagcccgtcatactaactgacggggaagaacgagtaatcctggccggacctatgccggtgacacacagctctgctgcccaaagacggggtaggattggccgcaaccccaaaaatgaaaacgaccagtatatctacatgggggagcccctcgaaaatgatgaggactgcgcgcattggaaggaggcaaaaatgttactggataacattaatacccctgaaggaatcataccctcaatgtttgagccagaaagagagaaggttgacgccattgatggcgaatacaggcttcggggtgaggctcgtaaaaccttcgtggacctgatgcgccgaggggatctccctgtctggttggcctatagagtggctgcagagggcatcaactacgccgacaggcggtggtgtttcgatggaattaagaataaccagatcctggaagagaacgttgaagtggagatatggactaaggagggcgaacgcaaaaagctcaaacccagatggctggacgctaggatctattccgatccacttgccctaaaggagtttaaagagttcgcagcggggcggaagagtctgacattgaatttaattaccgagatgggacgactgcctacatttatgactcaaaaggccagagacgctctcgataacctggccgtccttcacacggcagaagtgggtggccgcgcttacaatcacgccctgagcgagctcccggagaccttggaaacactgctactgctcactcttctggcaaccgtaacagggggaatcttcttatttttgatgtcgggcaaaggtattgggaagatgaccctgggcatgtgctgcatcataactgcctctattctcctgtggtatgctcagatccagccccattggatcgcggcctccattatccttgagttctttctgatagtgctcttgattccagaacctgagaaacagaggacgccccaagacaaccagctgacctacgttgtcatcgcaattttaacagtggtggctgccactatggccaatgaaatgggattcctagagaagaccaaaaaggacctgggcctcgggagcatcacaacccaggagtcagaaagtaacatacttgatatcgacctgcggccagcatctgcttggactttgtatgccgtcgcgacaacgtttgttacccctatgctgcgtcactccattgagaatagctcagtgaacgtaagtctcactgctatcgccaatcaggcaacagtgctgatgggacttggtagaggctggcccctcagcaagatggatattggggtcccgctgttggccatcggatgttactcccaagtgaacccaattaccctgaccgctgcattactactgctcgttgcccattacgcgatcataggccctggtcttcaggctaaagccacaagggaagcacagaagcgcactgccgctgggattatgaaaaatcccacggtggacggcatcaccgtcatcgatctggagccaattccctatgaccctaagttcgaaaaacagttgggacaagtaatgctgctcgtgctgtgcgttacacaggtgcttatgatgcggactacctgggccttatgtgaggcactgacactcgctaccggcccgatatctactttgtgggaggggaaccccggacgattttggaatacgacaatcgccgtcagcatggcgaacattttcagaggctcctacctggccggtgcagggctactgttttcaatcatgaagaataccactaacaccaggcgcggaacaggcaatattggtgaaactctcggcgagaagtggaaatctcggcttaacgctctggggaagagtgagttccagatctataaaaagtcgggaatacaggaggtggatagaaccttggccaaagagggcatcaagcgtggggaaacagaccaccatgcagtcagcaggggatccgctaaactgcggtggttcgtggagcgcaacatggttacgccagaaggcaaggtggtagatctcggttgcgggcgaggaggctggtcttactattgtggtggcctgaagaatgtgagagaggtcaaagggttaaccaagggaggccctgggcacgaagaaccaattcctatgtcaacttacggatggaaccttgttaggctgcaaagcggcgtggacgtctttttcacaccacccgagaaatgcgataccctcctatgtgacatcggtgaatccagtcctaatccaactattgaggccgggcggacactgcgcgtgttgaacctggtagaaaattggctcaacaataacacccagttttgcgtgaaggttcttaatccctatatgccgtctgtgatcgagaaaatggaaacgctgcagagaaagtacggaggcgccttggtcaggaaccctctgagccgaaattcaacccacgagatgtactgggtgtccaacgcgacaggcaatatagtcagtagcgtgaacatgatttctcggatgctcatcaatcgtttcactatgaagcataaaaaggctacctatgagccagatgttgacttagggtccggaacaagaaacatcggtattgaaaacgagatacccaatctggacatcattggcaaacgcatcgaaaagattaaacaagagcacgaaacttcatggcattacgatcaggaccacccttataagacctgggcataccacgggagctatgagacaaagcagaccggatcggcctctagtatggtaaacggcgtggtcaaacttctgactaagccatgggatgtggttcccatggtgacgcagatggctatgacagacaccactccgtttggtcaacagagggtcttcaaagagaaggtggatacccggacacaggaacctaaagaggggacgaagaagctaatgagaatcaccgccgaatggctctggaaagagctgggaaagaaaaagactccccgcatgtgtacaagggaggaatttacccgaaaagtacggtccaatgcagccttgggcgctatattcactgacgagaacaagtggaaaagcgcgagagaagccgtggaggattcaaggttttgggaactggttgaccgcgagcgtaatctccatcttgagggcaagtgcgaaacatgtgtctacaacatgatggggaagcgggagaaaaagctgggagagttcggtaaagcaaagggctccagagctatctggtatatgtggttaggggccaggtttctggagttcgaagcattgggatttctcaatgaggatcactggttctctcgcggcaacagcctgagtggtgtggagggggaaggactacataaacttggctacattctgcgagacgtgtccaagaaggagggcggggccatgtacgctgatgacaccgccggatgggacacacggatcactctcgaagatctgaaaaatgaggaaatggtcaccaaccacatgaagggtgagcataaaaagttggcggaggcaattttcaaactgacgtatcagaataaggttgtgagagtacaaaggccaacccctcgcggcacagtgatggacatcattagcagaaaggatcagcgggggtctggacaggtcggcacttacggtctcaacacctttacaaatatggaagcccagcttataaggcaaatggagggggaaggaatcttcaaatcaattcagcgtctgactgtgaccgaggagatcgctgttcagaactggttagcccgagtgggccgcgaaagactgagtcggatggcaatctccggcgacgattgcgtcgtgaagcccttggacgataggtttgctagcgccctcacggctctgaatgacatggggaaagtacgcaaggatattcaacagtgggagccatctagaggatggaacgactggacacaggttcccttctgctcgcaccactttcatgagctagtgatgaaagatggtcggatgcttgtcgtgccttgtaggaaccaggacgagctgataggccgagcccgtatctcacaaggggcaggatggagcctcaaggaaaccgcgtgcctgggcaagtcctatgcccagatgtggactttgatgtacttccacagacgcgatttacggctggctgccaatgcaatttgtagtgctgtgccatctcattgggtcccgacaagcaggaccacttggtccatccacgccaaacacgagtggatgaccacagaggacatgctcgcagtttggaacagagtgtggattcaggaaaatccctggatggaggacaagacgcctgtagaatcatgggaggaagtgccatatcttggtaaacgcgaggatcagtggtgcgggagtctgatcggactaacctctcgggccacttgggcgaagaacatacaaacagctatcaatcaggtcaggagcctgattggcaacgaggaatacaccgactatatgccctccatgaaacgatttagaaaggaggaagaggaagccggcgtgctctggtga

SEQ ID NO: 14681 - RNA, 9876 nt, synthetic construct
  misc_feature 1..9876: note = derived and/or modified CDS sequence (opt3) from DENV-2__EU596490__SS-prME
  source 1..9876: mol_type = other RNA
accgccggcgtgatcattatgctgatacccacagtcatggctttccacctcactacgagaaacggggagcctcatatgatcgttggaaggcaggaaaagggtaaaagccttctgtttaagaccgaggacggcgtgaatatgtgcacattgatggcaattgatttaggggaactgtgtgaggacactatcacctacaaatgcccactactccggcaaaacgaaccggaggatattgactgttggtgcaattccacatctacctgggtaacttatggaacatgtaccacgactggcgagcaccgccgagaaaagcgttcagtggccctggtcccccatgtgggtatggggcttgagaccagaacagaaacttggatgagtagcgagggagcgtggaaacacgttcagaggatcgagacctggatactgcggcatcctggcttcacaatcatggctgccattttggcatacaccatcggcacgactcactttcagcgcgccctcattttcatcctgctgacagctgtggcaccatccatgaccatgagatgcatagggatttctaacagggattttgtcgaaggagtgtcgggtggctcatgggtagacatcgttctcgagcacgggagctgtgtgactacaatggccaagaataagcccaccttagatttcgaactgattaaaacggaggctaagcagcctgccacccttcggaaatattgcatcgaagcgaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggattgtgacctgcgcaatgtttacatgcaaaaagaatatggaaggaaaagtggtcctccctgagaacctggaatacaccatagttatcactccacacagcggtgaggagcatgccgtgggcaatgacacggggaagcacggaaaagaaattaagatcacaccgcagtcctcaataaccgaggctgaacttactggctatggtaccgtaacaatggagtgtagtcccaggaccgggctggatttcaacgaaatggtgttgctccagatggaggacaaagcctggctggtccaccggcaatggtttttagatctgcctctcccatggcttcccggcgcagacactcagggaagcaattggattcagaaggagacactggtgacgttcaagaaccctcatgctaaaaagcaggacgttgtggtcttgggctctcaagaaggggccatgcacaccgcgctaactggagccacagagatccagatgtcctcaggtaatctgctctttaccggccatctgaaatgccgtcttcgcatggataagctgcagttgaaagggatgagctacagtatgtgtacaggaaagttcaagatcgtgaaagaaattgcagagactcaacacggcaccatcgtaattagagttcagtatgagggtgacgggtctccatgcaagatacccttcgaaatcatggatctcgagaaaaggcatgtgctgggccggttaattacggtcaacccgatcgtgaccgaaaaggactcccctgtcaacatcgaggctgaacccccatttggagatagctacattataatcggcgtggagcctgggcagctgaaactaaattggttcaagaagggatcgtctattggtcagatgtttgagacaactatgcgaggcgccaaacgcatggctatcctcggggacaccgcctgggatttcggatccctgggcggtgtttttacatcaattgggaaggcacttcaccaagtgttcggcgccatctacggagctgcgtttagtggcgtaagctggactatgaaaatattgatcggggtcattatcacctggattggaatgaactccagatctacgagcctgtcagtgagtctcgttctggtgggcgtcgtgacactttatctgggtgtaatggtgcaggcagacaccgggtgtgttgtctcctggaagaataaagaattgaagtgcggaagcggcatcttcataactgataacgtgcacacatggaccgagcagtacaagtttcagcccgaatctccatcaaaactcgccagtgctattcaaaaggcccatgaggaaggtatctgtggcattaggagcgtgactcggctggagaatttaatgtggaaacagatcacccccgagctgaaccacatactatccgaaaatgaggtcaagctcacaatcatgacgggggacattaaaggaatcatgcaggcaggcaagcgctctctgagacctcagccaaccgaacttaaatattcgtggaagacttgggggaaggccaaaatgttgagcacagagtcccataaccaaaccttcctgattgatggaccggaaacagctgagtgccccaatactaacagggcctggaattcactcgaggttgaagactacggctttggtgtgttcagtaccaacatctggctgaagttacgtgagaaacaggacgtgttttgtgattctaagctgatgagcgcagcgataaaagacaatcgggctgtacacgccgatatggggtattggattgaatccgcacttaacgacacgtggaagatggagaaggcctcattcatcgagatcaaaagctgccactggcctaagtctcatacattgtggtccaatggagtcctcgaaagtgagatgattatcccaaaaaacttcgctggccccgtgagccagcacaactaccgacctggttatcatacccagactgccggcccatggcacctggggaagctagaaatggattttgacttctgtgagggaaccacagttgtggtcactgaagattgcggcaatagagggccctctctgaggaccacaacggcatccggaaaactcattaccgagtggtgctgtcgctcatgcactctgccgcctcttcggtacagaggcgaggacggttgttggtacgggatggaaataaggccattgaaggagaaggaagagaacctggtgaatagtttagttacagctggacatggccaaatcgataactttagcctcggtgtgctgggcatggcccttttcctggaagagatgttgcgcacccgagtagggactaaacacgcgattctcctggtcgccgtgtcgtttgtgacactaatcaccggaaatatgtccttccgggacctgggccgtgtcatggttatggtgggggctacgatgactgatgacattggaatgggcgtaacctatctcgcactgcttgccgcttttaaggtgagacccacattcgccgcaggtttgctgttaaggaaactcacctctaaggagctgatgatggcgactatcgggatagcccttctgagccagtcaacaatccctgaaaccattctagagctcacagatgctctggccttgggaatgatggtcctgaaaatcgtgcgcaacatggaaaagtaccagttagcagttactattatggctatcagttgcgtgcccaatgccgtcatactccaaaacgcatggaaggtgtcctgtaccattctggccgctgtttctgtgagcccacttctgttgacgtcctcacagcagaaagcggactggatccctctcgccctgacaatcaagggcctaaatcccaccgcaatttttctgactacccttagccggacaagtaaaaagagatcttggccactcaacgaggctgtcatggccgtaggcatggtgtccatactggccagctcgttgctgaaaaatgacatcccgatgactgggcctttagttgctggaggtctcctgaccgtgtgctatgtccttacgggcaggtcagcagatctggaattggagcgagccgcggacgtgaagtgggaggatcaggctgaaatttctgggagttcccccatcctcagcattacaatctctgaggacggaagcatgtccataaaaaacgaagaggaggaacacaccctgactatcctaattcgcacaggcctgcttgtaatctcaggtgtgttcccagtcagtattcccatcaccgccgcagcctggtacctctgggaggttaagaagcaacgggctggggtgctgtgggatgtgcctagcccaccccctgtcggaaaagcagaattggaggacggcgcctatagaataaagcagaggggcatttttgggtactctcagatcggagcgggtgtgtataaagaaggcactttccatacaatgtggcacgttacccgtggggctgtattaatgcatcgcggaaagcggatcgagccgtcctgggccgatgtgaaaaaggacctgatttcatacggcggtgggtggaagctcgagggagaatggaaagagggcgaagaggtccaggtgctggcacttgaaccaggcaagaatcccagagccgttcaaacgaaacctgggctgtttaagactaacaccggaacaatcggtgctgtgagtttggatttcagcccaggcacctccgggtctcccatagtcgacaggaaaggaaaggtggtaggcctatacggtaatggggtcgtgacacgatcgggagcctatgttagcgcaattgctcagactgagaagtcaatcgaggataaccctgaaattgaggacgatatcttccggaaaaagcgcctgaccataatggacctccacccgggcgccggcaaaacgaagagatacctgcccgcgattgtgagggaagccatcaaacgggggcttcgaacattaatcctggcaccaactagagtcgtggctgccgagatggaagaggctctccgcggattgcctattaggtatcagacccccgcaatccgtgccgagcatacaggtcgggaaattgttgacctgatgtgtcacgccacctttactatgagactcctgtccccagtgagggtccctaactacaatcttataatcatggatgaggctcacttcaccgaccccgcgagtattgcagcccgcggctatatctctacacgagtggaaatgggggaggctgccggaatctttatgacggcaactccaccgggcagcagagatcctttcccccagtccaacgccccaattatggacgaggaacgggagatacccgaaaggtcatggaattctggtcatgagtgggtaaccgattttaaggggaagacagtgtggttcgttcctagcatcaaagctggaaacgacattgcggcctgcctgcgcaagaatggcaaaaaggtcatccaattgagtcgtaaaacctttgattccgaatacgtgaagactagagcaaacgactgggatttcgtggtcacaaccgacattagcgagatgggcgctaattttcgggccgagagggtaatcgatccacgccgatgtatgaagcccgtgatactaacggacggggaagagagagttatcctggcaggacctatgccggtgactcactcttcagccgctcagcggaggggtcgcattggcagaaacccaaaaaatgaaaacgaccagtatatctacatgggggagcccctcgaaaatgatgaggactgcgcccattggaaggaggcgaaaatgttactggataacattaatacacctgaaggaatcataccctccatgttcgagccagaaagggagaaggtcgacgcaattgatggcgaataccggcttcgtggtgaggcccgcaaaacctttgtggacctgatgcgaagaggggatctccctgtttggttggcttatagggtggccgctgagggcatcaactacgcagaccggcgctggtgtttcgatggaattaagaataaccaaatcctggaagagaacgtcgaagtggagatatggaccaaagagggcgaaagaaagaagctcaaacccaggtggctggacgcccggatctatagtgatccacttgctctaaaggagttcaaagaatttgccgcagggcgaaagagcctgactttgaatttaattacagagatgggaagactgcctaccttcatgacacagaaagcgcgcgacgccctcgataacctggctgtacttcacactgccgaagtgggtggcagggcatacaatcacgctctgtcggagctcccggagacgttggaaaccctgctactgctcacacttctggccactgttaccgggggaatctttttattcttgatgtctggcaagggtattgggaagatgacactgggcatgtgctgcatcataaccgcatccattctcctgtggtatgcccagatccagccccattggatcgctgcgagcattatccttgagtttttcctgatagtcctcttgattccagaacctgagaaacaacggactccccaggacaaccagctgacgtacgtggtgatcgccattttaaccgtcgttgcagctacaatggccaatgaaatgggatttctagagaagactaaaaaggacctgggcctcgggtcaatcaccacacaggagagtgaatctaacatacttgatatcgacctgcgtccagcctccgcatggaccttgtatgctgtggccactacattcgtaacgcctatgctgagacacagcattgagaattcaagtgtgaacgtcagcctcaccgcgatcgctaatcaagccactgtgctgatgggacttggtaggggctggcccctctccaaaatggatgttggggtgccgctgttggcaattggatgttactctcaggtcaacccaatcacactgaccgccgctttactactgctcgtagcacattacgccattatcggccctggtcttcaggcgaaggctacccgcgaagcccagaagcggacagcagccgggataatgaaaaatcccactgtggacggcattacggttatcgatctggagccaatcccctatgaccctaagtttgaaaaacaattgggacaggtgatgctgctcgtcctgtgcgtgacccaggtccttatgatgcgaacaacttgggctttatgtgaggccctgaccctcgcaacaggcccgattagcaccttgtgggaggggaaccccggaagattctggaatactacgatagctgtgtccatggccaacatctttaggggctcatacctggcgggtgccgggctactgttctctattatgaagaatacaaccaacactcgccggggaaccggcaatatcggtgaaacactcggcgagaaatggaagagtagacttaacgcactggggaagtcggaatttcagatttataaaaagagcggaatccaagaggttgatcgtactttggctaaagagggcataaagaggggggaaaccgaccaccatgccgtgtcccggggatctgcaaaactgcgctggttcgtagagcgaaacatggtgacaccagaaggcaaggtcgttgatctcggttgcgggagaggaggctggtcatactattgtggtggcctgaaaaatgtgagggaggtcaaggggttaacgaagggaggccctgggcacgaagagcccatccctatgagcacctacggatggaaccttgtgcggctgcagtccggcgtagacgtgttctttactccacccgagaaatgcgatacactcctatgtgacattggtgaaagttctcctaatccaaccatcgaggctgggcgcactctgagagttttgaacctggtggaaaattggctcaacaataacacacagttctgcgtcaaggtgcttaatccctatatgccgagcgtcattgagaaaatggaaaccctgcaaaggaagtacggaggcgccttggtgcgaaaccctctgtcacggaattccacgcacgagatgtactgggttagtaacgccaccggcaatatcgtaagctctgtgaacatgatatcccgtatgctcattaatagatttacaatgaaacataagaaggcgacttatgagccagatgtcgacttagggtcaggaacccgcaacatcggtatcgaaaacgagattcccaatctggacataatcggcaaaaggattgaaaagatcaaacaggagcacgaaacaagctggcattacgatcaggaccacccttataagacttgggcttaccacgggtcgtatgagaccaaacagacaggatctgcaagttccatggtgaacggcgttgtgaagcttctgaccaagccatgggatgtcgtgcccatggtaactcaaatggccatgacggacacaaccccgttcggtcagcagcgggtgtttaaagagaaggttgatactagaacccaggaacctaaagaggggacaaagaaactaatgcgcattacggctgaatggctctggaaggagctgggaaagaaaaagacccccaggatgtgtactcgagaggaattcacacggaaagtcagaagcaatgccgcattgggcgccatctttaccgacgagaacaagtggaaatcagctagggaagcggtggaggattcccgcttctgggaactggtggaccgtgagcggaatctccatcttgagggcaagtgcgaaacttgtgtctacaacatgatggggaaaagagagaagaagctgggagaatttggtaaagccaagggctctagggcaatatggtatatgtggttaggggctcgcttcctggagtttgaagccttgggattcctcaatgaggatcactggtttagccgaggcaacagtctgtccggtgttgagggggaaggactacataaacttggctacatcctgcgggacgtgagcaagaaagagggcggggcaatgtacgccgatgacacagctggatgggacaccagaattacactcgaagatctgaagaatgaggaaatggtaactaaccacatgaagggtgagcataaaaagttggccgaggcgatcttcaaactgacctatcaaaataaggtggtcagggtgcagcgcccaacgcctagaggcaccgttatggacattatctctcggaaagatcagagggggtcaggacaggtgggcacatacggtctcaacactttcaccaatatggaagcacaacttattcgtcagatggagggggaaggaatatttaagagtatccagcgactgacagtcactgaggagattgccgtgcaaaactggttagctcgcgtaggcagagaacggctgtccaggatggccatcagcggcgacgattgcgttgtgaagcccttggacgatcgcttcgcatctgctctcaccgccctgaatgacatggggaaagtcagaaaggatatccagcagtgggagccatcgcggggatggaacgactggacgcaggtgcccttttgctcacaccacttccatgaactagtgatgaaagatggtagggtccttgttgtgccttgtcgaaaccaagacgagctgattggccgtgctagaataagccagggggccggatggtccctcaaggaaacagcatgcctgggcaaaagttatgcgcagatgtggaccttgatgtactttcaccgccgggatttaaggctggccgctaatgccatctgttctgcagtaccaagccattgggtgccgacttccagaacaacctggtcaattcacgctaagcacgagtggatgactaccgaggacatgctcgccgtctggaaccgcgtgtggatccaggaaaatccctggatggaggacaagacacctgttgaaagttgggaggaagtgccatatcttggtaaacgggaggatcaatggtgcgggtctctgattggactaacgagcagggcaacctgggccaagaacatccagactgcgataaatcaggtccgatccctgatcggcaacgaggaatacacagactatatgccctcaatgaaaagattccggaaggaggaagaggaagctggcgtgctctggtga

SEQ ID NO: 14682 - RNA, 9876 nt, synthetic construct
  misc_feature 1..9876: note = derived and/or modified CDS sequence (opt3) from DENV-2__EU596491__SS-prME
  source 1..9876: mol_type = other RNA
accgccggagtgatcattatgctgatacccactgtaatggctttccacctcactacgagaaacggggagcctcatatgatcgttggaaggcaggaaaagggtaaaagccttctgtttaagaccgaggacggcgtgaatatgtgcacattgatggcaattgatttaggggaactgtgtgaggacactatcacctacaaatgcccattactccggcaaaacgaaccggaggatattgactgttggtgcaattccacatctacctgggtaacttatggaacatgtaccacgactggcgagcaccgccgagaaaagcgttcagtggccctggtcccccatgtgggtatggggcttgagaccagaacagaaacttggatgagtagcgagggagcgtggaaacacgttcagaggatcgagacctggatactgcggcatcctggcttcacaatcatggctgccattttggcatacaccatcggcacgactcactttcagcgcgccctcattttcatcctgctgacagctgtggcaccatccatgaccatgagatgcatagggatttctaacagggattttgtcgaaggagtgtcgggtggctcatgggtagacatcgttctcgagcacgggagctgtgtgactacaatggccaagaataagcccaccttagatttcgaactgattaaaacggaggctaagcagcctgccacccttcggaaatattgcatcgaagcgaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggattgtgacctgcgcaatgtttacatgcaaaaagaatatggaaggaaaaatagtgcagcctgagaacctcgaatacaccatcgtcattactccacacagcggtgaggagcatgccgttggcaatgacacggggaagcacggaaaagaaatcaagataacaccgcagtcctcaaccactgaggctgaactgaccggctatggtacagtgaccatggagtgtagtcccaggactgggcttgatttcaacgaaatggtactgttgcaaatggaggacaaagcctggctcgtgcaccggcagtggtttctggatttacctctgccatggctccccggcgcagacacacagggaagcaattggattcagaaggagacgcttgtcaccttcaagaaccctcatgctaaaaagcaagacgtggttgtgctgggctctcaggaaggggccatgcacactgcgttgacaggagccaccgagatccagatgtcctcaggtaatctactgtttacaggccatctcaaatgccgtctgcgcatggataaacttcaactgaaagggatgagctacagtatgtgtactggaaagttcaagatcgtcaaagaaattgcagagacccagcacggcacgatcgtgattagagtacagtatgagggtgacgggtctccatgcaagatacccttcgaaatcaccgatttggagaaaaggcatgttctcggccggctgattacagtgaacccgatcgtcactgaaaaggacgctcctgtgaacatcgaggccgaacccccatttggagattcctacattatagtcggcgtggagcctgggcagttaaaactgaattggttcaagaagggaagctcgatcggtcaaatgtttgagaccacaatgcgaggcgctaaacgcatggccattctaggggacactgcatgggatttcggatctctcggcggtgtttttacctccatcgggaaggccctgcaccaggtgttcggcgctatttacggagcggcattttcaggcgtaagttggacgatgaaaatccttataggggtcatcattacatggatcggaatgaacagcagatccacctctttgagcgtgtcactggttctcgtgggcgtcgtgactctgtatcttggtgccgtagtgcaggctgacagtgggtgtgttgtctcctggaagaataaagaactgaagtgcggaagcggcattttcatcacagataacgtgcacacctggactgagcagtacaagtttcaacccgaatctccatcaaaattggccagtgcaatacagaaggcccatgaggaaggtatttgtggcatcaggagcgtgacccggctcgagaatctgatgtggaaacagattacacccgagttaaaccacatcctgtccgaaaatgaggtcaagctaacgataatgaccggggacatcaaaggaattatgcaggctggcaagcgctctctcagacctcaaccaactgaactgaaatattcgtggaagacatgggggaaggccaaaatgcttagcaccgagtcccataaccagacattcttgatcgatggaccggaaactgcagagtgccccaataccaacagggcgtggaactcactggaggttgaagactacggctttggtgtgttcacgacaaacatttggctcaagctgcgtgagaaacaggacgtgttttgtgatagtaagttaatgtctgctgccatcaaagacaatcgggcagtacacgccgatatggggtattggatagaaagcgctctgaacgacacctggaagatggagaaggcctccttcattgaggtcaaatcatgccactggcctaagagccatactctttggtctaatggagtgttggaatccgagatgatcatccccaagaatttcgcaggccccgttagtcagcacaactaccgacctggttatcatacccaaacagctggcccatggcacctcgggaagctggaaatggattttgacttctgtgagggaactaccgtggtcgtgacagaagattgcggcaatagagggcccagcctaaggacgaccactgcctctggaaaactgattacagagtggtgctgtcgctcctgcaccctcccgcctctgcggtacagaggcgaggacggttgttggtacgggatggaaatcaggccacttaaggagaaggaagagaacttggttaattcactggtgactgcgggacatggccagattgataactttagtttaggtgtactcggcatggccctgttccttgaagagatgctgcgcacacgagtcgggaccaaacacgctacgttgctcgtggcactgagctttgtgactctaataaccggaaatatgtcgttccgggacctgggccgtgtcatggttatggtgggggccacaatgaccgatgacatcggaatgggcgtaacttatctcgctctgcttgccgcatttaaggtgagacccacattcgcggccggtttgctgttaaggaaactcacctccaaggagctgatgatggctacaattgggatcgcccttctgtctcagagcactctacctgaaaccattctcgagctgacggatgcattggctctgggaatgatggtcttaaaaatcgtgcgcaacatggaaaagtaccaactcgccgttacaataatggcaatctcatgcgtgcccaatgccgtcattctgcagaacgcttggaaggtgagttgtaccatccttgcggccgtttccgtgtctccactgttgctcactagctcccagcagaaagcagactggattcctctggctctaaccatcaagggcctgaatcccacagccatatttcttactaccctctcacggacgagcaaaaagagaagttggccactgaacgaggccattatggctgtcggcatggtatctatcttggcatccagcctgctaaagaatgacatcccgatgacagggcctctcgtggccggaggtctgcttaccgtttgctatgtgctgactggcaggtcggcggatttggaactcgagcgagctgccgacgtcaagtgggaggatcaagcagaaatttcagggtctagtcccatactgtccatcacaattagcgaggacggatctatgagcatcaaaaacgaagaggaggaacagaccctaactattctgatccgcacaggccttctcgtgatatccggtgtattcccagtgtcaatccccattaccgccgctgcatggtacctgtgggaggtcaagaagcagcgggccggggttttgtgggatgtgcctagtccaccccctgtgggaaaagcggaattagaggacggcgcttatagaatcaagcagaggggcattctggggtacagccaaatcggagccggtgtctataaagaaggcacgtttcacactatgtggcatgtgacccgtggggcagttctcatgcaccgcggaaagcggatagagccgtcttgggccgatgtcaaaaaggacctgatttcctacggcggtgggtggaaacttgagggagaatggaaagagggcgaagaggtgcaggtcctggctttggaaccaggcaagaatcccagagccgtgcagacaaaacctgggatcttcaagaccaacacaggaactatcggtgcagtttcactagattttagtccaggcaccagcgggtcccccattgtggacaggaaaggaaaggtcgtgggcctgtacggtaatggggtagtcacgcgatctggagcttatgtgtcggccatcgcgcagacagaaaagagcatagaggataaccctgaaattgaggacgatatcttccggaaaaagcgcctcactattatggacctgcatccgggcgccggcaaaaccaagagataccttcccgcaatcgttagggaagctataaaacgggggttacgaacactgattctcgccccaaccagagtggtcgctgcagagatggaagaggccttgcgcggactgcctatcaggtatcaaactcccgccatccgtgctgagcacaccggtcgggaaattgtggacctcatgtgtcatgcgacattcacgatgagactgctttcaccagttagggtgcctaactacaatctgatcattatggatgaggcacactttactgaccccgcctccatagctgcccgcggctatatcagtacccgagtcgaaatgggggaggcagccggaattttcatgacagctaccccaccgggctctagagatccttttccccagagcaacgcgccaatcatcgacgaggaacgggagattcccgaaaggtcctggaactcaggtcacgagtgggtgactgatttcaaggggaagacagtatggtttgtgccttctataaaagccggaaacgacatcgcagcttgcttgcgcaagaatggcaaaaaggttattcagctaagccgtaaaaccttcgatagtgaatacgtcaagacgagagccaacgactgggattttgtggtgactacagacatctccgagatgggcgcaaatttcaaggccgagcgggtcattgatccaaggcgctgtatgaaacccgtaatcctgaccgacggggaagaacgagtgatactcgctggacctatgccggttacccatagctctgccgcgcaaagacggggtaggatcggccgcaacccaaagaatgaaaacgaccagtatatttacatgggggagcccttagaaaatgatgaggactgcgcacactggaaagaggccaagatgctgcttgataacatcaatactcctgaaggaattatcccctcaatgtttgagccagaaagagagaaagtggacgctgtcgatggcgaatacaggctgcggggtgaggcccgtaagacattcgtggacctcatgcgccgaggggatttgcctgtttggctggcttataaagtggcagccgagggcataaactacgctgacagaaagtggtgttttgatggaattaagaataaccagatcctcgaagagaacgtcgaagtggagatttggaccaaagagggcgaaaggaagaaactgaagccccggtggcttgacgcccgcatctattccgatccactagcactgaaagagttcaaggagttcgcggccgggagaaagagtttgacattaaatctgataactgagatgggaaggctccctacgtttatgacccagaaagctcggaacgccctggacaatcttgcagtactgcatacagctgaagtgggtggccgagcccacaaccacgcactcagcgagttgccggagactctggaaaccctactgctccttacactgttagccaccgttactgggggaatcttcttgtttctgatgtcgggcaagggtattgggaaaatgacgctcggcatgtgctgcatcattaccgcttctatcctgctttggtacgcgcaaatacagccccattggattgccgcatccatcatcctggagttctttctcattgtcttgctgatcccagaacctgagaagcagagaacaccccaggataatcaattaacttatgtggtgatagctattctaaccgtcgttgccgccacaatggcaaacgaaatgggattcctggagaaaaccaagaaggacctcggctttgggagcatcactacacaggagtcagaaagtaatattcttgacatcgatctgcgcccagcttctgcctggacgttgtacgcggtggctaccactttcgtaacacctatgctgaggcactccatagagaacagctcagtgaatgtcagtctcaccgccatcgcaaaccaggccaccgtgctgatgggacttggtaaaggctggcccctcagcaagatggacattggggttccgctgttggctatcggatgttattcccaggtgaatccaattacactgactgcagccttactactgctcgtcgcgcattacgctatcattggccctggtcttcaagccaaagcaacgcgggaagcccagaagcgtgctgccgcagggatcatgaaaaaccccaccgtagatggcataacagtgattgacctggagccaatcccctacgatcctaagtttgaaaagcagttgggacaggttatgctgctcatcctgtgcgtgactcaagtccttatgatgagaaccacatgggctttatgtgaggccctgaccctcgcgactggcccgatttctacgttgtgggaggggaatcccggaaggttctggaacacaaccatagccgtgagcatggcaaatatctttcgcggctcctatctggctggtgccgggctactgttctcaattatgaaaaacactaccaatacacggcgaggaactggcaacgtcggtgaaaccctcggcgagaagtggaaatctagacttaacgcactggggaagagtgaatttcagatctacaaaaagtcgggcattcaggaggtggacaggacattggctaaagagggcatcaagcgcggggaaacggatcaccatgccgttagccggggatccgccaagctgagatggttcgtggagcgtaatatggtaaccccagaaggcaaagtggtcgacctcggttgcgggaggggaggctggtcttattactgtggtggcctgaagaacgttcgggaggtgaaagggttaactaagggaggccctgggcacgaggaaccaatacctatgtcaacatatggatggaatcttgtccgcctgcaaagcggcgtggatgtattctttaccccacccgagaaatgcgacactctcctatgtgatatcggtgaatccagtcctaacccaacaattgaggcggggcgaaccctgagagtgttgaatctggttgaaaactggctcaataacaatacgcagttctgcatcaaggtgcttaacccctacatgccgtctgtcattgagaagatggaaaccctgcagaggaaatatggaggcgctttggtgcggaatcctctgagccgcaactcaacacacgagatgtactgggtctccaatgcaactggcaacatcgtgagtagcgttaatatgatatctagaatgctcattaacaggtttaccatgaagcataaaaaggccacatacgagccagacgtagatttagggtccggaactcgaaacatcggtatcgaatcagagattcccaatctggacataatcggcaaacggattgaaaagatcaagcaggagcacgaaaccagctggcattatgaccaagatcacccttacaaaacatgggcttatcacgggtcgtacgagaccaagcagactggatctgccagttccatggtgaacggcgtcgtgcgtcttctgacgaaaccatgggacgttgtgcccatggtcacacagatggcaatgaccgatactaccccgttcggtcagcaaagagtgtttaaggagaaagtagacacacgcacgcaggaacctaaggaggggaccaagaaactaatgaagattactgccgaatggctctggaaagagctgggaaagaaaaagacacccaggatgtgtacccgggaggagttcactagaaaagtgcgcagcaatgctgcgttgggcgccatctttacagatgagaacaagtggaagtcagcaagggaagctgttgaggacggccgattctgggaactggtcgatcgggagagaaatctccatcttgaggggaaatgcgaaacctgtgtgtataacatgatgggaaagagggagaaaaagctgggtgaatttggcaaagccaaggggtcccgcgcaatatggtacatgtggttaggagcccgtttcctggagtttgaggctttgggcttcctcaatgaggaccactggttttctcggggtaacagcctgagtggggtggagggagaaggcctacatagacttggctatatcctgagggaggtcgggaagaaagaaggaggtgccatgtacgcggatgacacagcaggctgggatactcgcattaccctcgaggacctgaagaatgaagagatggttacgaaccacatgaaaggggagcataagaaattggccgaagctatcttcaagctgacctaccagaataaggtggtacgagtgcagcggccaacacctagaggaactgtcatggacattatctccaggaaagatcaacgcggcagcggtcaggtggggacctatggactcaacacattcactaatatggaggcccagcttattagacaaatggaaggcgagggcatatttaagtctatccagcacctgaccgcaacggaggaaattgctgttcagaactggttagcccgggtggggagggagcgtctgtcacgaatggctatcagtggagacgattgcgtcgtgaaacccatcgacgatcgcttcgcctccgcattgacagcgctcaatgacatgggtaaggtaagaaaagatattcagcaatgggaaccaagccggggctggaacgactggacccaggttcccttttgctctcaccatttccacgagctggtgatgaaggatgggagggtcctagtggtgccttgtcgcaaccaggacgaacttataggcagagcacggatctcgcagggagctggttggtcactgaaggagactgcctgcctcgggaaaagctacgcacaaatgtggacactgatgtattttcataggcgagatttgcgtttagctgccaatgcaatttgttccgccgtcccaagtcactgggttccgacctctagaactacctggagcatccacgcgaagcatgagtggatgacaacggaagacatgctggctgtgtggaaccgcgtatggattcaggagaatccctggatggaagataaaacccctgtggagtcctgggaagaggtcccatacctcggaaagcgggaggaccagtggtgcggctcacttatcggcctgacaagtagggccacatgggccaaaaatatacagaccgccatcaatcaagtgagatctctaattgggaacgaagagtatactgactacatgcccagcatgaagcgcttccggagggaagaggaagaggctggagttctgtggtga

SEQ ID NO: 14683 - RNA, 9876 nt, synthetic construct
  misc_feature 1..9876: note = derived and/or modified CDS sequence (opt3) from DENV-2__EU677141__SS-prME
  source 1..9876: mol_type = other RNA
accgccggcgtgatcattatgctgatacccacagctatggcattccacctcactacgcggaacggggaacctcatatgatcgtcggaaggcaggaaaagggtaaaagccttctgtttaagaccgaagacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggattctgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggattattcggcaagggcgggattgtcacatgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctgactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggtacgttctgggccggttaattacggtgaacccgatcgtcaccggaaaggactcccctgtgaacatcgaagccgagcccccatttggcgatagctacattataatcggggtcgaacctggacagctgaaactaaattggttcaagaagggttcgtctattggccagatgtttgagacaactatgcgaggggctaaacgcatggccatcctcggagacaccgcatgggatttcggctccctgggtggggtgtttacatcaattggcaaggcccttcatcaagttttcggagctatctatggcgcggcatttagtggggtgagctggactatgaaaatattgatcggagtaattatcacctggattggcatgaactccagatctacgagcctgtcagtcagtctcgtgctggttggtgtggtcacactttacctgggggtgatggtacaggccgactccggatgtgtggttagctggaagaataaagagttgaagtgcggctctggtatcttcataaccgataacgtccacacttggacagaacagtataagtttcagcccgagtcaccaagtaaactcgctagcgccattcaaaaggcacacgaagagggcatctgtgggattaggtccgtgacccggctggaaaatttaatgtggaaacagatcactcccgagctgaaccatatactatctgagaatgaagtgaagctcaccatcatgacaggagacattaaaggcatcatgcaggccgggaagcgctcgctgagacctcagccaacggagcttaaatacagctggaagacctggggaaaggctaaaatgttgtccactgaatcacacaaccaaacattcctgattgatggcccggagaccgccgaatgccccaatacaaacagggcatggaatagtctcgaggtcgaggactatggttttggggttttctctactaacatctggctgaagttacgtgaaaaacaggacgtgttttgtgatagcaagctgatgtccgcggctataaaagacaatcgggccgtgcatgcagatatgggatactggattgagtcagcccttaacgacacctggaagatggaaaaggctagcttcatcgaggtaaaatcttgccactggcctaagtcccacacgttgtggagtaatggcgtcctcgagagcgaaatgatcattcccaaaaatttcgccggtcccgtgtctcagcataactatcgacctggctaccacacacagaccgcagggccatggcatctgggaaagctagagatggattttgacttctgtgaaggcactaccgttgtggtcacagaggattgcgggaatagaggaccctccctgaggactaccacagcttcaggcaaactcatcacggaatggtgctgtcgcagttgcaccctgccgcctcttcggtacagaggtgaggacgggtgttggtatggaatggagattaggccattgaaggaaaaggaggaaaacctggtgaatagcttagttactgccggccacggtcaaatagataacttttcgctcggcgtgctggggatggcgcttttcctggaggaaatgttgcgcacacgagtaggaaccaaacatgccatcctcctggtcgctgtgtcctttgtgactctaattacaggcaatatgtctttccgggacctggggcgtgtcatggttatggtgggagcaaccatgacggatgacatcggcatgggtgtaacttacctcgccctgcttgctgcctttaaggtgagacccaccttcgcagcggggttgctgttaaggaaactcacaagcaaggagctgatgatggccaccattggaatcgcacttctgtcacagagtactatacctgagacaatcctagaactcaccgatgccctggcattgggcatgatggtcctgaaaattgtgcgcaacatggagaagtatcagttagctgttacaatcatggccattctctgcgtgcccaatgcagtcatcctgcaaaacgcctggaaggtgtcctgtactatacttgctgcggtttctgtgagcccactgttgctcacctcctcacagcagaaagccgactggattcctctggcactaacgatcaagggcctgaatcccacagctatctttcttaccactctcagccggaccagtaaaaagagatcttggccactgaacgaagccgtcatggccgtagggatggtgtccattttggctagctcgctgctcaaaaatgacataccgatgacaggacctctagttgctggtggcctgcttactgtgtgctacgtcctgaccgggaggtcagccgatttggagctcgaacgagcggctgacgtgaagtgggaggatcaggccgagatctctggaagttcccccattctgagcatcacgatttctgaagacggcagcatgtccatcaaaaacgaggaagaggagcaaacactaaccatactgatccgcactggtcttctcgtaatttcaggggtgttcccagtcagtatccccattacagcagccgcttggtatctgtgggaagttaagaagcagcgggcaggagtgttgtgggatgtgcctagcccaccccctgtcggcaaagccgagttagaagacggcgcgtacagaatcaagcagagggggatatttggatattctcagattggtgctggcgtgtacaaagaggggaccttccacactatgtggcacgttacacgtggagccgtactgatgcatcgcggcaagcggatcgaaccgtcctgggcagatgtgaaaaaggacctcatctcatacggtgggggatggaagctggagggcgagtggaaagaaggcgaggaagtccaagtgcttgccctggagccagggaagaatcccagagctgttcagaccaaacctggattgtttaagacgaacactggtaccattggcgccgtgagtctagatttcagcccagggacatccggatctcccatcgtcgacaggaaaggcaaggtggtaggtctgtatgggaatggagtcgtgacccgatcgggcgcatacgttagcgctatagcccagacagaaaagtcaattgaggataaccctgagatcgaagacgatattttccggaaaaagcgcctcactatcatggacctgcacccgggcgcggggaaaaccaagagatatcttcccgccatagtgagggaggcaattaaacggggattacgaacgctgatcctcgctccaacaagagtcgtggccgctgaaatggaggaagcattgcgcggtctgcctatcaggtaccagactcccgccattcgtgccgagcataccggccgggagatcgttgacctcatgtgtcacgctacatttaccatgagactgctttccccagtgagggtccctaactataatctgattataatggatgaagcgcatttcactgaccccgcaagtatcgccgctcgcgggtacatttctacccgagtggagatgggagaagccgcaggcatctttatgacagccacgccaccgggtagcagagatcctttcccccaatccaacgctccaatcatggacgaggagcgggaaattcccgagaggtcatggaactctgggcacgaatgggtaactgattttaagggaaagaccgtgtggttcgttcctagcataaaagcgggcaacgacatcgccgcatgcttgcgcaagaatggcaaaaaggtcattcagctaagtcgtaaaacatttgattccgagtatgtgaagaccagagctaacgactgggatttcgtggtcactacagacatcagcgaaatgggggccaattttcgggcagagagggtaattgatccacgccgatgtatgaagcccgtgatcctgaccgacggagaggaaagagttatactcgccggtcctatgccggtgacgcactcttcagctgcccagcggaggggccgcatcgggagaaaccccaaaaatgagaacgaccaatacatttacatgggagaacccttagagaatgatgaagactgcgcgcattggaaggaggcaaaaatgctgcttgataacatcaatactcctgagggcattatcccctccatgttcgaaccagagagggaaaaggtcgacgccatagatggtgagtatcggctgcgtggggaagctcgcaaaacatttgtggacctcatgcgaagaggcgatttgcctgtttggctggcctacagggtggctgcagagggaattaactatgccgaccggcgctggtgtttcgatggcatcaagaataaccagattctcgaggaaaacgtcgaggtggaaatctggaccaaagagggggagagaaagaagctgaaacccaggtggcttgacgctcggatatacagtgatccactagccctgaaggagttcaaagagtttgcagcgggacgaaagagcttgaccttaaatctgatcactgaaatgggtagactccctacattcatgacccagaaagcccgcgacgctctggataaccttgccgtactgcacacagcagaggtgggcgggagggcttataatcatgccctctcggaattgccggagactctggagacgctactgctccttaccctgttagcaacagttactggaggcatatttttgttcctgatgtctggtaaggggatcggcaagatgaccctcggaatgtgctgcattatcacagcctccatactgctttggtacgctcagattcaaccccactggatcgcggccagcatcattctggaatttttcctcatcgtcttgctgataccagagcctgaaaaacagcggaccccacaggacaaccagttaacttatgtggtgattgcaatcctaacggtcgttgctgccaccatggccaatgagatgggctttctggaaaagaccaaaaaggacctcgggcttggatcaattatcactcaagagagtgagtctaacatactggatatcgacttgcgtccagcatccgcttggaccctgtacgccgtggcgacaaccttcgtaactcctatgctcagacacagcattgaaaattcaagtgtgaacgtcagcctgacagctatcgccaatcaggcaacggtgcttatgggtctcggcagggggtggcccctgtccaaaatggatattggagttccgttgctggccatcggctgttactctcaggtgaacccaattaccttaactgctgcactactgctccttgtcgcccattatgcgatcataggtcctgggctgcaggctaaggccacacgcgaggcacaaaagcgggccgctgccggcattatgaaaaatcccaccgtagacggaatcaccgtgatcgatttggaaccaattccctacgaccctaagtttgagaaacagctgggccaggttatgctcctggtgctttgcgtcacacaggtgttaatgatgcgaactacgtgggcactgtgtgaagctctcaccttggccacagggccgataagcactctgtgggagggaaaccccggcagattctggaataccacaatcgcggtctccatggccaacatttttaggggttcatatctagcaggggctggactactcttctctatcatgaagaataccactaacacgcgccggggcacaggtaatattggcgagacccttggggaaaaatggaagagtagactgaacgccttgggaaagtcggagtttcaaatctacaaaaagagcggcatacaggaagtggatcgtactctggcaaaagaggggatcaagaggggagagaccgaccaccatgctgtttcccggggctctgccaaactccgctggttcgtggaacgaaacatggtaacaccagagggtaaggtggtcgatctggggtgcggaagaggcggttggtcatattactgtggcgggcttaaaaatgttagggaagtgaagggactaactaagggcgggcctggacacgaggaacccattcctatgagcacctatggctggaacctggtccggctccagtccggtgtggacgtattctttacaccacccgagaaatgcgatacgctactgtgtgacatcggggagagttctcctaatccaaccattgaagccggacgcactttgagagtgctgaacctcgttgagaattggcttaacaataacacacaattctgcatcaaggtgctgaatccctacatgccgagcgtcatagagaaaatggagaccttgcagaggaagtacggcggcgcgctggtgcgaaaccctctctcaagaaattccactcatgaaatgtattgggtcagtaacgctacagggaatattgtgagctctgttaacatgatctcccgtatgttaatcaatagatttaccatgaaacacaagaaggcaacgtacgagccagatgtagacctgggatcaggtacccgcaacattggcatagagaacgaaatccccaatcttgacattatcgggaaaaggattgagaagatcaaacaggaacacgagacaagctggcattatgatcaggaccacccttacaagacttgggcctatcatggatcgtacgaaaccaaacaaacaggctctgctagttccatggtgaacggtgtcgtgcggctgctaactaagccatgggatgttgtgcccatggtcacccagatggccatgacagacaccactccgttcgggcagcagagagtgtttaaggagaaagtagatacgcgcacacaagagcctaaggaaggaaccaaaaagctcatgaggataactgcagagtggctgtggaaagaattgggcaagaagaaaaccccacgaatgtgtacacgggaggagttcacgagaaaggtgaggagcaatgccgctctgggcgcgatctttaccgacgaaaacaaatggaagtcagcccgcgaggcagttgaagattcccgtttctgggagctcgtcgaccgggaaagaaatcttcacctggaggggaaatgcgagacttgtgtgtataacatgatgggaaagagggagaaaaagttaggtgagtttggcaaggctaaagggtctcgcgccatttggtacatgtggctgggagcacgattcttggaatttgaggccctcggcttcctgaatgaagatcactggtttagccggggtaacagtctatccggggtggagggagagggccttcataagctgggctacatcctcagagacgtcagcaaaaaggaagggggagctatgtatgccgatgacacagcgggttgggacaccaggattactctggaggatttgaaaaatgaagagatggttacaaaccacatgaagggcgaacataagaaactggcagaggccatcttcaagctcacctaccagaataaagtggtacgcgtgcagagaccaacacctcgggggactgtcatggacattatatctaggaaggatcagcgtggatcaggccaagtgggtacctatgggcttaacacgttcaccaatatggaggctcagctgatccgacagatggaaggagagggcatttttaaaagtatccaacacttaacagttactgaagagatcgccgtgcagaactggctggcacgcgtcggcagagagcggttgtccaggatggctattagcggggacgattgcgtggtaaagcccctcgacgatcgcttcgcctctgctctgaccgccctaaatgacatgggaaaggttagaaaagatatacagcagtgggaaccatcgcggggttggaacgactggacacaagtgcccttttgctcacatcacttccacgagcttgtcatgaaggatggcagggtgctggtggtcccttgtcgaaaccaggacgaactcatcgggcgtgcaagaattagccagggagcgggctggtccctgaaagagactgcctgcttgggtaagagttacgctcagatgtggaccttaatgtattttcatcgccgggatctgaggctcgccgcaaatgctatctgttctgccgttccaagccactgggtgccgacgtccagaacaacctggtcaattcatgcaaaacacgaatggatgactacagaggacatgcttgccgtatggaaccgcgtgtggatccaagagaatccctggatggaagacaagacccctgtcgagagttgggaagaggtgccatacctggggaagcgggaagatcagtggtgcggatctctaataggcctgactagcagggcgacctgggctaaaaacatccagacagccattaatcaggttcgatccctcatcggcaacgaggagtatacggactacatgccctcaatgaagagattccggaaagaagaggaagaggcaggggtgttgtggtga

SEQ ID NO: 14684 - RNA, 9876 nt, synthetic construct
  misc_feature 1..9876: note = derived and/or modified CDS sequence (opt3) from DENV-2__EU677144__SS-prME
  source 1..9876: mol_type = other RNA
accgccggcatgatcattatgctgatacccacagctatggcattccacctcactacgagaaacggggagcctcatatgatcgtgggaaggcaggaaaagggtaaaagccttctgtttaagaccgaggacggcgtcaatatgtgcacattgatggccattgatttaggggaactgtgtgaggacactatcacctacaaatgcccactactccggcaaaacgaaccggaggatattgactgttggtgcaattccacatctacctgggttacttatggaacatgtaccacgactggcgagcaccgccgagaaaagcgttcagtggcgctggtaccccatgtgggtatggggcttgagaccagaacagaaacttggatgagtagcgagggagcttggaaacacgtccagaggatcgagacctggatactgcggcatcctggcttcacaatcatggccgcaattttggcctacaccatcggcacgactcactttcagcgcgctctcattttcatcctgctgacagcagtggccccatccatgaccatgagatgcatagggatttctaacagggattttgttgaaggagtgtcgggtggctcatgggtcgacatcgtgctcgagcacgggagctgtgtaactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggttgatagaggctggggtaacgggtgtggactattcggcaagggcgggattgtgacctgcgccatgtttacatgcaaaaagaatatggaaggaaaagtcgtgctccctgagaacctggaatacaccatagtgatcactccacacagcggtgaggagcatgctgtcggcaatgacacggggaagcacggaaaagaaattaagatcacaccgcagtcctcaataaccgaggccgaacttactggctatggtaccgttacaatggagtgtagtcccaggaccgggctggatttcaacgaaatggtgttgctccagatggaggacaaagcatggctggtacaccggcaatggtttttagatctgcctctcccatggcttcccggcgctgacactcagggactgaattggattcagaaggagacattggtgacgttcaagaaccctcatgccaaaaagcaggacgtcgtggttctaggcagccaagaaggggcgatgcacaccgccctgactggagcaacagagatccagatgtcttccggtaatctcctgtttaccggccatcttaaatgccgtctgcgcatggataagttgcagctcaaagggatgtcatacagcatgtgtacaggaaagttcaagatcgtgaaagaaattgctgagactcaacacggcaccatcgtcattagagtgcagtatgagggtgacgggagtccatgcaagatacccttcgaaatcatggatctggagaaaaggtacgtattaggccggctgattacggttaacccgatcgtgaccgaaaaggactctcctgtcaacatcgaggccgaacccccatttggagattcctacattataatcggcgtggagcctgggcagctaaaactcaattggttcaagaagggaagctcgattggtcagatgtttgagacaactatgcgaggcgctaaacgcatggccatcctgggggacaccgcatgggatttcggatctcttggcggtgtctttacatccattgggaaggccttgcatcaagtgttcggcgctatctatggagcggcattttcaggcgttagttggactatgaaaatactgatcggggtgattatcacctggattggaatgaacagcagatccacgtctctcagcgtatcactggtccttgtgggcgttgtgacactgtacttgggtgtcatggtgcaggccgacagtgggtgtgtagtgtcctggaagaataaagaactcaagtgcggaagcggcatcttcataaccgataacgttcacacttggacagagcagtataagtttcagcccgaatctccatcaaaactggctagtgccattcaaaaggcacacgaggaaggtatctgtggcattaggagcgtcacccggttagagaatctgatgtggaaacagatcactcccgagctaaaccatatactctccgaaaatgaggtgaagctgaccatcatgacaggggacattaaaggaatcatgcaggccggcaagcgctctcttagacctcagccaacggaattgaaatactcgtggaagacctgggggaaggctaaaatgctgagcactgagtcccacaaccaaacattcctcattgatggaccggaaaccgccgagtgccccaatacaaacagggcatggaattcactggaggtggaagactatggctttggtgtcttcagtactaacatctggttaaagctgcgtgagaaacaggacgttttttgtgattctaagcttatgagcgcggctataaaagacaatcgggccgtgcatgcagatatggggtactggattgaatccgccttgaacgacacctggaagatggagaaggcttcattcatcgaggtgaaaagctgccactggcctaagtctcacacgctctggtccaatggagtactggaaagtgagatgatcattccaaaaaacttcgccggccccgtcagccagcataactatcgacctggttaccacacacagaccgcaggcccatggcatctagggaagctggaaatggattttgacttctgtgagggaactaccgtggttgtgacagaagattgcggcaatagagggccctctctcaggactaccacagcttccggaaaactgatcacggagtggtgctgtcgctcatgcacccttccgcctttgcggtacagaggcgaggacggttgttggtatgggatggaaattaggccactgaaggagaaggaagagaacttagtcaatagtctcgtgactgccggacacggccaaatagataactttagcctgggtgttcttggcatggcgctgttcttggaagagatgctccgcacacgagtggggaccaaacatgccatcctgctagtagctgtctcgtttgtgactctgattacaggaaatatgtccttccgggacctcggccgtgtgatggtcatggttggggcaaccatgacggatgacatcggaatgggcgtgacttacctggcccttttggctgcctttaaggtaagacccaccttcgcagcgggtctgttactcaggaaactgacatctaaggagcttatgatggccaccattgggatcgctctgctaagccagtcaactatacctgaaacaatcctcgagctgaccgatgccttggcactgggaatgatggtgttaaaaattgtccgcaacatggaaaagtatcagctcgctgtgacaatcatggccattctgtgcgttcccaatgcagtgatccttcaaaacgcctggaaggtcagttgtactatactggctgcggtgtccgtttctccattgctcctgaccagctcccagcagaaagccgactggattcctctagcactgacgatcaagggccttaatcccacagctatctttctcaccactctgtcacggaccagcaaaaagagaagttggccattgaacgaggccgtgatggccgtcggcatggtatctattctggcttccagcttactcaaaaatgacataccgatgacagggcctctggtggcaggaggtcttctgactgtttgctacgtgttgaccggcaggtcggccgatctcgaactggagcgagcggctgacgtcaagtgggaggatcaggccgaaatctcagggtctagtcccattctatccatcacgattagcgaggacggatctatgagcatcaaaaacgaagaggaggaacaaacactgaccatacttatccgcactggcctcctggtgatttccggtgtattcccagtgtcaatccccattacagcagccgcttggtatttgtgggaggtcaagaagcagcgggcaggggttttatgggatgtgcctagtccaccccctatggaaaaagccgagctggaagacggagcgtacagaatcaagcagaggggcatatttggctatagccagattggggctggagtgtacaaagagggtaccttccacactatgtggcacgtcacacgtggcgccgtgctcatgcatcgcgggaagcggatcgagccgtcttgggcagatgttaaaaaggacctgatctcctacggaggcggttggaagcttgaaggggagtggaaagaaggagaggaagtacaagtgctggccttggagccaggcaagaatcccagagctgtccagaccaaacctggcctatttaagacgaacactgggaccattggagccgtgtcactggatttcagtccaggtacaagcggctcccccatcgttgacaggaaagggaaggtggtcggactctatggcaatggtgtggtaacccgatctggggcatacgtctcggctatagcccagacagagaagagcattgaagataaccctgagatcgaagacgatattttccggaaaaagcgcctgactatcatggaccttcacccgggagcgggcaaaaccaagagatatttacccgccatagtgagggaggcaattaaacggggcctgcgaacgctcatcttggctccaacaagagttgtggccgctgaaatggaggaggcactgcgcgggctccctatcaggtaccagactcccgccattcgtgccgaacataccggacgggagatcgtcgacctgatgtgtcacgctacatttaccatgagacttctgtcaccagtgagggttcctaactataatttgattataatggatgaagcgcatttcactgaccccgcatccatcgccgctcgcggttacattagtacccgagtggagatgggcgaggccgcagggatctttatgacagccacgccaccgggatctagagatcctttcccccaaagcaacgctccaatcatggacgaagagcgggaaattcccgagaggtcctggaattcaggccacgaatgggtcactgattttaagggtaagaccgtgtggttcgtaccttctataaaagcggggaacgacatcgccgcatgcctacgcaagaatggaaaaaaggtgattcagctgagccgtaaaacatttgatagtgagtatgttaagaccagagctaacgactgggatttcgtcgtgactacagacatctccgagatgggcgccaattttcgggcagaaagggtgattgatccacgccgatgtatgaagcccgtcatcctcaccgacggcgaggaaagagtaatattagccgggcctatgccggtgacgcacagctctgctgcccagcggaggggacgcatcggtagaaacccaaaaaatgagaacgaccaatacatttacatgggcgaacccctggagaatgatgaggactgcgcgcattggaaggaagcaaaaatgcttctggataacatcaatactcctgaggggattatcccctcaatgttcgaaccagagagggaaaaggttgacgccatagatggagagtatcggctccgtggcgaggctcgcaaaacatttgtggacttgatgcgaagaggtgatctgcctgtctggctcgcctacagggtggctgcagaagggattaactatgccgaccggcgctggtgtttcgatggcatcaagaataaccagattctggaggaaaacgttgaggtggagatctggaccaaagaaggagagagaaagaagcttaaacccaggtggctagacgctcggatatactccgatccactggccttgaaggaattcaaagagtttgcagcgggccgaaagagtttaaccctgaatctcatcactgaaatggggagactgcctacattcatgacccagaaagcccgcgacgctcttgataacctggccgtcctccacacagcagaggtgggaggtagggcttataatcatgccttgagcgagctgccggaaactctagagacgctgctccttctgaccttattggcaacagtaactggcgggatttttctgttcctcatgtcgggaaagggcatcggtaagatgaccctggggatgtgctgcattatcacagcctctatacttctgtggtacgctcagattcaaccccactggatcgcggcctccatcattctcgaatttttcttgatcgtgctgttaataccagagcctgaaaaacagcggaccccccaggacaaccagctaacttatgttgtcattgcaatcctgacggtggtggctgccaccatggccaatgagatgggctttctcgagaagacaaaaaaggaccttggactgggcagcattatcactcaagaatcagagagtaacatattggatatcgacctgcgtccagcatctgcttggaccctctacgccgtcgcgacaaccttcgttactcctatgctgagacactccattgaaaatagctcagtgaacgtaagtcttacagctatcgccaatcaggcaacggtgctcatggggctgggaaggggttggcccttgagcaaaatggatattggcgtcccgctgttagccatcgggtgttactcccaggtgaacccaattaccctaactgctgcactgctccttctggttgcccattatgcgatcataggacctggcttgcaggctaaggccacacgcgaggcacaaaagcgggccgctgccggtattatgaaaaatcccaccgtggacgggatcaccgtcatcgatctggaaccaattccctacgaccctaagtttgagaaacagctcggccaggtaatgctgcttgtgttatgcgttacacaggtgctgatgatgcgaactacgtgggcactctgtgaggctttgaccctggccacaggaccgatatctactctatgggaaggcaaccccgggagattctggaataccacaatcgcggtcagcatggccaacatttttaggggatcctatctggcaggcgctggtctccttttctcaatcatgaagaataccactaacacgcgccgggggacaggaaatattggcgagaccctgggtgaaaaatggaagtctagattgaacgccctgggcaagagtgagtttcaaatctacaaaaagtcggggatacaggaggtggatcgtactctcgcaaaagaaggaatcaagaggggcgagaccgaccaccatgctgtcagccgggggtccgccaaactgcgctggttcgtggaacgaaacatggttacaccagagggaaaggtggtagatttaggctgcggtagagggggatggtcttattactgtggcggtcttaaaaatgtgagggaagtcaagggcctgactaaggggggacctggccacgaggagcccattcctatgtcaacctatgggtggaacctcgttcggctacagagcggagtggacgtcttctttacaccacccgaaaaatgcgatacgctgttgtgtgacatcggcgagtccagtcctaatccaaccattgaagccggtcgcactctgagagtgctcaaccttgtagagaattggctgaacaataacacacaattctgcatcaaggtgttgaatccctacatgccgtctgttatagaaaaaatggagaccctgcagaggaagtacgggggagcgctcgtgcgaaaccctttaagccggaattcaactcatgagatgtattgggtctccaacgctacaggcaatattgtgagtagcgtcaacatgatctctcgtatgctgatcaatagatttaccatgaaacacaagaaggcaacgtacgaaccagatgtggaccttggctccgggacccgcaacattggaatagagaacgaaatccccaatctggacattatcggtaaaaggattgagaagatcaaacaggaacacgagacatcatggcattatgatcaggaccacccttacaagacttgggcctatcatggcagctacgagaccaaacaaacagggtcggcttctagtatggttaacggagtagtgcggctactcactaagccatgggatgtcgtgcccatggttacccagatggccatgacagacaccactccgttcggccagcagagagtgtttaaggaaaaagtcgatacgcgcacacaagagcctaaggaaggtaccaaaaagctgatgaggataactgcagagtggttgtggaaagagctggggaagaagaaaaccccccgaatgtgtacacgggaagagttcacgagaaaggtgaggtccaatgccgctctcggagcgatctttaccgacgaaaacaaatggaagagcgcccgcgaggcagtagaagattcacgtttctgggagcttgtggaccgggagagaaatctgcacttagaaggcaaatgcgagacttgtgtttataacatgatgggcaagagggaaaaaaagctgggggagtttggaaaggctaaaggttcccgcgccatttggtacatgtggttgggcgcacgattcctcgaatttgaggccctggggttcctaaatgaggatcactggttttctcggggaaacagccttagtggcgtcgaaggtgaggggctgcataagctcggatacatcctgagagacgtgtccaaaaaggaaggcggcgctatgtatgccgatgacacagcggggtgggacaccaggattactttggaggatctgaaaaatgaagagatggtgacaaaccacatgaagggagagcataagaaactcgcagaagccatcttcaagcttacctaccagaataaagtcgttcgcgtgcagagaccaacacctcggggtactgtaatggacattataagcaggaaggatcagcgtggctctgggcaagtgggaacctatggcctgaacacgttcaccaatatggaggctcagttaatccgacagatggaaggtgaggggatttttaaatcaatccaacacctgacagtcactgaggaaatcgccgtgcgcaactggttggcaagagttggacgggagaggctcagtcgcatggctatttccggcgacgattgcgtggtcaagcccctggacgatagattcgccagcgctctaaccgcccttaatgacatgggcaaggtgcggaaagatatacagcagtgggaaccatctagggggtggaacgactggacacaggtacccttttgctcgcatcacttccacgagctggttatgaaggatggacgagtgctcgtcgtgccttgtcgtaaccaagacgaactgatcggtagagcacgcatttcacagggcgcggggtggagcttgaaagagactgcctgcttaggaaagtcctacgctcagatgtggaccctgatgtattttcatcggagggatctcagacttgccgcaaatgctatctgtagtgccgtgccatctcactgggtcccgacgagccgcacaacctggtccattcatgcaaaacacgagtggatgactacagaagacatgctggccgtttggaaccgggtgtggatccaggagaatccctggatggaagacaagacccctgtagagtcatgggaagaggtgccatacctaggcaagagggaggatcaatggtgcggtagtctgatagggctcacttctcgagcgacctgggctaaaaacatccagacagccattaatcaggtcagaagcttgatcggaaacgaagagtatacggactacatgccctccatgaagcggttcaggaaagaagaggaagaggcaggcgtgctgtggtga

SEQ ID NO: 14685 - RNA, 9876 nt, synthetic construct
  misc_feature 1..9876: note = derived and/or modified CDS sequence (opt3) from DENV-2__EU677145__SS-prME
  source 1..9876: mol_type = other RNA
acagccggagtgatcgtcatgctgattcccacagctatggcattccacctcactacgcggaacggggaacctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagacccgtacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattatcacagaaaaggactcccctgtgaacatcgaggccgaacccccatttggagatagctacattataatcggcgtcgagcctgggcagttaaaactgaattggttcaagaagggatcgtctattggtcaaatgtttgagactaccatgcgaggcgctaaacgcatggccatcctaggggacacagcatgggatttcggatccctcggcggtgtgtttacttcaattgggaaggccctgcaccaggttttcggcgctatctacggagcggcatttagtggcgtgagctggaccatgaaaatacttatcggggtaattatcacgtggattggaatgaactccagatctaccagcttgtcagtcagtctggtgctcgttggcgtggtcaccctgtatcttggtgccatggtgcaggctgactccgggtgtgtagtgagctggaagaataaagaactgaagtgcggatctggcatcttcataactgataacgttcacacatggaccgagcagtacaagtttcaacccgaatcaccaagtaaattggccagcgcaattcagaaggcccatgaggaaggtatctgtggcattaggtccgtcactcggctcgagaatctgatgtggaaacagatcacccccgagttaaaccacatactgtctgaaaatgaggtgaagctaacaatcatgacgggggacattaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggtggaagactacggctttggtgtcttcaccacgaacatctggctcaagctgcgtgagaaacaggacgtattttgtgattctaagttaatgagcgctgccataaaagacaatcgggcagtgcacgccgatatggggtattggattgaatccgctctgaacgacacatggaagatggagaaggcctcattcatcgaggtgaaaagctgccactggcctaagtctcataccctttggtccaatggagtattggaaagtgagatgatcattccaaagagcttcgcaggccccgtctctcagcacaactaccgacctggttatcatactcaaaccgctggcccatggcacctcgggaagctggaaatggattttgacttctgtgagggaacaactgtggttgtgaccgaagattgcggcaacagagggccctccctaaggacaacgaccgcctcaggaaaactgatcactgagtggtgctgtcgcagttgcacactcccgcctctgcggtacagaggcgaggacggttgttggtacgggatggaaattaggccacttaaggagaaggaagagaatttggtcaacagcctggtgaccgcgggacatggccagatagataatttttcgttaggtgttctcggcatggccctgttccttgaagagatgctgcgcactcgagtggggacaaaacacgctatcttgctcgtagcagtctcctttgtgaccctgattacgggaaacatgtctttccgggacctaggccgtgtgatggtcatggttggggccactatgaccgatgacatcggaatgggcgtgacatatctggctctcctggccgcatttaaggtaagacccaccttcgcggccggtcttttgctgaggaaattaactagcaaggagctcatgatggctacaattgggatcgccctgctttcacagagtaccatgcctgaaacaatactggagctaactgatgcactcgctctgggaatgatggtgttgaaaatcgtccgcaatatggaaaagtaccaactggccgtgaccattatggcaatctcctgcgttcccaacgccgtgattttacagaatgcttggaaggtctcttgtacgatcctcgcgacagtgagcgtttccccactgcttctgacctcaagccagcagaaagccgactggatacctttggcactcactattaagggcctgaaccccaccgctatctttctaacaactctgagtcggacctctaaaaagagatcctggccacttaatgaggccatcatggccgtgggcatggtcagcattctcgcttcgtcactgttgaaaaacgacataccgatgacggggcctctggtagcaggaggtttactcacagtgtgctatgttctgaccggcaggtctgccgatcttgaactggagcgagcggctgacgtgaagtgggaggatcaagccgaaatcagtgggtccagccccattttgtctatcactattagcgaggacggatccatgtcaatcaaaaatgaagaggaggaacagacactcaccatactgatccgcactggcctactggtcattagtggtgtgttcccagtaagcatccccattacagcagccgcttggtacctttgggaggtgaagaagcagcgggcaggggtcctctgggatgttccttctccaccccctgtgggaaaagccgaactggaggacggcgcgtatagaatcaagcagaggggcatattggggtactcccaaattggagctggtgtgtataaagaaggcacctttcacacgatgtggcatgtcactcgtggggccgtgttaatgcaccgcggaaagcggatcgagccgtcatgggcagatgttaaaaaggacctgatcagttacggcggtgggtggaagctcgagggagaatggaaagagggcgaagaggtacaggtgctggcccttgaaccaggcaagaaccccagagctgtccagaccaaacctgggattttcaagacaaataccggaacaatcggtgccgtgagcctggatttttccccaggcacttctgggtcgcccatagttgacaggaaaggaaaggtggtcggcttgtacggtaacggggtggtaacccgaagcggagcatatgtctcagctattgcccagacggagaagtccatcgaggataatcctgaaattgaggacgatatcttccggaaaaagcgcctaacaataatggacctgcatccgggcgcgggcaaaactaagagatacctccccgccattgtgagggaagcaatcaaacgggggctgcgaacccttatcttagctccaacaagagttgtggccgctgagatggaagaggcactgcgcggactccctattaggtatcaaacccccgccatccgtgccgagcacactggtcgggaaattgtcgacttgatgtgtcatgctaccttcacaatgagactgctcagtccagtgagggttcctaactacaacctgataatcatggatgaggcgcactttacggaccccgcatctattgccgctcgcggctatatcagcactcgagtggaaatgggggaggccgcaggaatcttcatgaccgccacaccaccgggctccagagatccttttccccagtcaaatgctccaattatggacgaggaacgggagatacccgaaaggtcttggaacagcggtcacgagtgggtcaccgatttcaaggggaagactgtgtggtttgtacctagtatcaaagcgggaaatgacattgccgcatgccttcgcaagaacggcaaaaaggtgatccagctgtcccgtaaaacattcgatagcgaatacgttaagaccagagctaatgactgggattttgtcgtgacgactgacatttctgagatgggcgccaacttcaaggcagagcgggtgatcgatccaaggcgctgtatgaaacccgtcatattgacagacggggaagaacgagtaatcctagccggacctatgccggtgacccattcatccgctgcccaaagacggggtaggattggccgcaatccaaagaacgaaaatgaccagtatatctacatgggggagcccctggaaaacgatgaggactgcgcgcactggaaagaggcaaagatgctcttagataatattaacacccctgaaggaatcatacccagtatgtttgagccagaaagagagaaagttgacgccattgatggcgaatacaggctgcggggtgaggctcgtaagactttcgtggaccttatgcgccgaggggatctgcctgtctggctcgcctatagagtggctgcagagggcatcaattacgccgacaggaaatggtgttttgatggaattaagaacaatcagatcttggaagagaacgttgaagtggagatatggacaaaggagggcgaacggaaaaagctgaaaccccgctggctcgacgctagaatctatagcgatccactggcccttaaggagttcaaagagttcgcagcggggaggaagtcgctaaccctgaacttgattacagagatgggacggttacctacttttatgacgcagaaggcccgaaatgctctggacaacctcgccgtcctgcataccgcagaagctggtggcagagcctacaatcacgcactttctgagctgccggagacactcgaaactttgctgctactgaccctccttgccacagtgaccgggggaatcttcctgtttttaatgtccggcaaaggtattgggaagatgactttgggcatgtgctgcatcataacggctagcattctgctctggtatgcgcaaatccagccccactggatcgccgcatcaattatcctggagttctttcttatagtactgctcattccagaacctgagaaacagcgcacaccccaggataaccaattgacatacgtggttatcgctattctgactgtcgtggccgccaccatggcaaatgaaatgggattcttagagaagaccaagaaggacctaggcctggggagtatcaccactcaggagtctgaatccaacatactcgacatcgatcttaggccagctagcgcctggacactgtatgcggtggctacgacctttgtcactcctatgttgcggcattcaattgagaatagtagcgttaacgtgtccctgacagccatcgcaaatcaggccaccgtactcatgggactgggtaagggctggcccctttctaaaatggacattggggtgccgctcctggctatcggatgttacagccaggtcaacccaattaccttgacagcagccctgttactactggtggcgcactacgctatcataggccctggtctccaagccaaggcaactcgtgaagcccagaaaagagctgccgcagggattatgaagaatcccacggttgatggcatcaccgtgatcgaccttgagccaattccctatgatcctaaattcgaaaagcagctgggacaggtcatgttgctgatactctgcgtaacacaagtgctgatgatgaggactacctgggctctttgtgaggccttaacactggcgaccggcccgatctccactctctgggaggggaaccccggacgcttttggaatacgacaattgccgtttcaatggcaaacatcttccggggctcttacttggctggtgccgggctgctatttagtattatgaagaataccactaacacccgaagaggaacaggcaatatcggtgaaactctgggcgagaaatggaagtcgaggctcaacgcacttgggaaaagcgagttccagatatataagaaatccggaatccaggaggtggaccgcaccctggctaaggagggcattaaaagaggggaaacagatcatcacgccgtctctagaggatcagccaagttgcgttggtttgtggagaggaacatggtcacgccagaaggcaaggtggttgacctgggttgcgggcggggaggctggagctactattgtggtggcctcaaaaatgtgcgcgaggtaaaggggctgaccaaaggaggccctgggcatgaagaacccgtgcctatgtccacttacggatggaacttagtccgacttcaaagtggcgttgatgtgttcttcacaccacccgagaagtgcgacaccctgctctgtgatatcggtgaatctagccctaatccaactattgaggcggggagaacactaagggtcctgaacttggtggaaaattggctgaacaataacacccagttttgcatcaaagtactcaatccctatatgccgtcagtgatagagaagatggaaacgcttcagcggaagtacggaggcgctctggttcgcaaccctttgtccagaaatagtacccacgagatgtactgggtgagcaacgcaacaggcaatattgtctcttccgtgaacatgatctcaaggatgctgatcaatcgattcactatgaaacacaagaaagccacctatgagccagacgtcgatctcgggagcggaacacggaacattggtatagaatcggagatccccaacttagacattatcggcaagcgtattgagaaaatcaagcaggagcatgaaacttcttggcactacgaccaagatcatccttataagacctgggcttaccacgggagttatgagacaaaacagaccggatccgccagctcaatggtgaatggcgttgtaagactgcttactaagccatgggacgtggtccccatggtgacgcagatggcaatgacagataccactccgtttggtcagcaacgcgttttcaaagagaaggtggacaccaggacacaggaacctaaagaggggacgaagaagctgatgaaaataaccgccgaatggctatggaaggagctcggcaaaaagaaaactccccggatgtgtacaagagaggaatttaccaagaaagtccgctccaacgctgcgctgggcgccatcttcactgatgagaataagtggaagtctgcaagggaagctgtggaggacggccgattttgggaattggtagatcgggagagaaacctgcacctcgaggggaaatgcgaaacatgtgtgtacaatatgatgggaaagagggagaagaaacttggtgagttcggcaaagccaaagggagccgcgcaatttggtatatgtggctgggagccagatttttagagttcgaagctctgggctttttgaacgaggaccattggttcagtcggggtaattccctcagcggggttgagggagaaggcctgcacagactaggctacatccttagggaggtcgggaagaaagaaggaggtgccatgtacgcggatgacaccgcaggctgggatacacgcattactctggaggacctcaagaacgaagagatggtgaccaatcatatgaaaggggagcacaagaaactggccgaagctatctttaagttgacgtatcagaacaaggtggtccgagttcagcggccaacccctagaggaacagtgatggacattatatctaggcgcgatcaaagaggctcaggtcaggtagggacttacggactgaataccttcacaaacatggaggcccagctcatccggcaaatggaaggcgagggcattttcaaaagtatccagcatcttactgcaaccgaggaaatcgctgtgcagaattggctggccagggtcgggcgtgagcgattatcccgcatggctattagcggagacgattgcgtggttaagcccatagacgatagatttgcctctgcactgacggcgttgaacgacatgggtaaagtgcggaaggatatccagcaatgggaaccatcgaggggctggaatgactggacacaggtccccttctgctcacaccactttcatgagctcgtgatgaaagatgggcgcgtactggttgtgccttgtagaaaccaggacgaactaattggacgggccaggatcagccagggcgctggttggtcccttaaggagaccgcctgcctggggaagagttatgcacaaatgtggactctcatgtacttccaccgacgtgatctgagattggctgccaacgcaatttgttctgccgtcccaagccattgggtgccgacatcccgcaccacttggtcaatccacgcgaaacacgagtggatgaccacagaagacatgttagctgtgtggaatcgggtctggatacaggagaacccctggatggaagataagacgcctgttgagagttgggaagaggtgccatatctgggaaaaagggaggaccagtggtgcggctctctcatcggccttaccagcagagccacttgggcaaagaatattcagacagccatcaaccaagtacgctccctgattgggaatgaagagtacaccgactatatgccctcaatgaaacggtttaggcgagaagaggaagaggctggagtgctatggtga

SEQ ID NO: 14686 - RNA, 9876 nt, synthetic construct
  misc_feature 1..9876: note = derived and/or modified CDS sequence (opt3) from DENV-2__EU677146__SS-prME
  source 1..9876: mol_type = other RNA
accgtgggcgtcatcgttatgctgattcccacagccatggctttccacctcactacgagaaacggggagcctcatatgatagtgggaaggcaggaaaagggtaaaagccttctgtttaagaccgaggacggcgtaaatatgtgcacattgatggcaatcgatttaggggaactgtgtgaggacactattacctacaaatgcccactactccggcaaaacgaaccggaggatatcgactgttggtgcaattccacatctacctgggtgacttatggaacatgtaccacgactggcgagcaccgccgagaaaagcgttcagtcgccctggtgccccatgttggtatggggcttgagaccagaacagaaacttggatgagtagcgagggagcgtggaaacacgtgcagaggattgagacctggatcctgcggcatcctggcttcacaataatggctgccatcttggcatacaccattggcacgactcactttcagcgcgccctcatcttcattctgctgacagctgtcgcaccatccatgaccatgagatgcatcgggatatctaacagggattttgtggaaggagtatcgggtggctcatgggttgacattgtgctcgagcacgggagctgtgtcactacaatggccaagaataagcccaccttagatttcgaactgatcaaaacggaggctaagcagcctgccacccttcggaaatattgcattgaagcgaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggatcgtgacctgcgcaatgtttacatgcaaaaagaatatggaaggaaaagtcgttctccctgagaacctggaatacaccattgtgataactccacacagcggtgaggagcatgccgtaggcaatgacacggggaagcacggaaaagaaatcaagattacaccgcagtcctcaatcaccgaggctgaacttactggctatggtaccgtgacaatggagtgtagtcccaggaccgggctggatttcaacgaaatggtcttgctccagatggaggacaaagcctggctggtgcaccggcaatggtttttagatctgcctctcccatggcttcccggcgcagacactcagggaagcaattggatacagaaggagacactggttacgttcaagaaccctcatgctaaaaagcaggacgtggtcgtgttgggctctcaagaaggggccatgcacaccgcgctaactggagccacagagattcagatgtcctcaggtaatctgctctttaccggccatctgaaatgccgtcttcgcatggataagctgcagttgaaagggatgagctacagtatgtgtacaggaaagttcaagatcgtaaaagaaatcgcagagactcaacacggcaccattgttatcagagtgcagtatgagggtgacgggtctccatgcaagattcccttcgaaataatggatctcgagaaaaggcatgtcctgggccggttaatcacggtgaacccgattgtcaccgaaaaggactcccctgtgaacatcgaggctgaacccccatttggagatagctacatcattataggcgttgagcctgggcagctgaaactaaattggttcaagaagggatcgtctatcggtcagatgtttgagacaactatgcgaggcgccaaacgcatggctattctcggggacaccgcctgggatttcggatccctgggcggtgtgtttacatcaatcgggaaggcacttcaccaagtattcggcgccatttacggagctgcgtttagtggcgtcagctggactatgaaaatcttgataggggtgatcattacctggatcggaatgaactccagatctacgagcctgtcagttagtctcgtgctggtcggcgtggtaacactttatctgggtgtgatggttcaggcagactccgggtgtgtcgtgagctggaagaataaagaattgaagtgcggatctggcattttcatcaccgataacgtgcacacttggacagagcagtacaagtttcagcccgaatcaccaagtaaactcgccagcgctatacaaaaggcccatgaggaaggtatttgtggcatcaggtccgtcacccggctggagaatttaatgtggaaacagattactcccgagctgaaccacatcctatctgaaaatgaggcaaagctcaccataatgacaggggacatcaaaggaattatgcaggccggcaagcgctcgctgagacctcagccaacggaacttaaatatagctggaagacctgggggaaggctaaaatgttgtccactgagtcacataaccaaacattcctgatcgatggaccggaaaccgccgagtgccccaatacaaacagggcatggaatagtctcgaggttgaagactacggctttggtgtgttctctactaacatttggctgaagttacgtgagaaacaggacgtgttttgtgatagcaagctgatgtccgcggctatcaaagacaatcgggccgtacacgcagatatggggtattggatagaatcagcccttaacgacacctggaagatggagaaggctagcttcattgagatcaaatcttgccactggcctaagtcccatacgttgtggagtaatggagtcctcgaaagcgagatgatcattccaaaaaacttcgccggccccgtgtctcagcacaactaccgacctggttatcatacacagaccgcaggcccatggcacctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtacgggatggaaattaggccattgaaggagaaggaagagaacctggtgaatagcttagttactgccggacatggccaaatagataacttttcgctcggtgtgctgggcatggcgcttttcctggaagagatgttgcgcacacgagtagggaccaaacacgccatcctcctggtcgctgtgtcctttgtgactctaattacaggaaatatgtctttccgggacctgggccgtgtcatggttatggtgggggcaaccatgacggatgacatcggaatgggcgtaacttatctcgccctgcttgctgcctttaaggtgagacccaccttcgcagcgggtttgctgttaaggaaactcacaagcaaggagctgatgatggccaccattgggatcgctcttctgtcacagagtactatacctgaaacaatcctagagctcaccgatgccctggcattgggaatgatggtcctgaaaattgtgcgcaacatggaaaagtaccagttagctgttacaatcatggccatttcctgcgtgcccaatgcagtcatcctccaaaacgcctggaaggtgtcttgtactatactggctgcggttagcgtgtccccacttctgttgacctcaagccagcagaaagccgactggattcctctcgcactgacgatcaagggcctaaatcccacagctatctttctgaccactcttagtcggacctctaaaaagagatcctggccactcaacgaggccgtcatggccgtaggcatggtgagcattctggcttcgtcattgctgaaaaatgacataccgatgacagggcctttagttgcaggaggtctcctgactgtgtgctatgtccttaccggcaggtctgccgatctggaattggagcgagcggctgacgtgaagtgggaggatcaggccgaaatcagtgggtccagccccattctctctatcacgattagcgaggacggatccatgtcaatcaaaaacgaagaggaggaacacacactgaccatactaatccgcactggcctgcttgtaattagtggtgtgttcccagtcagcatccccattacagcagccgcttggtacctctgggaggttaagaagcaacgggcaggggtgctgtgggatgtgccttctccaccccctgtcggaaaagccgaattggaggacggcgcgtatagaatcaagcagaggggcatatttgggtactcccagattggagctggtgtgtataaagaaggcaccttccatactatgtggcacgttacacgtggggccgtattaatgcatcgcggaaagcggatcgagccgtcatgggcagatgtgaaaaaggacctgatcagttacggcggtgggtggaagctcgagggagaatggaaagagggcgaagaggtccaggtgctggcccttgaaccaggcaagaatcccagagctgttcaaaccaaacctgggctgtttaagacgaacactggaaccattggtgccgtgagcttggatttctccccaggcacatctgggtcgcccatcgtcgacaggaaaggaaaggtggtaggcctatacggtaatggggtcgtgacccgaagcggagcatatgtttcagctatagcccagacagagaagtccattgaggataaccctgaaatcgaggacgatattttccggaaaaagcgcctgactatcatggacctccacccgggcgcgggcaaaaccaagagatacctgcccgccatagtgagggaagcaattaaacgggggcttcgaacgttaatcctggctccaacaagagtcgtggccgctgagatggaagaggcactccgcggattgcctatcaggtatcagactcccgccattcgtgccgagcataccggtcgggaaatcgttgacctgatgtgtcacgctacatttaccatgagactcctgagtccagtgagggtccctaactacaatcttattataatggatgaggcgcacttcactgaccccgcatctatcgccgctcgcggctatattagcacccgagtggaaatgggggaggccgcaggaatctttatgacagccacgccaccgggctccagagatcctttcccccagtcaaacgctccaatcatggacgaggaacgggagattcccgaaaggtcttggaatagcggtcatgagtgggtaactgattttaaggggaagaccgtgtggttcgttcctagtataaaagcgggaaacgacatcgccgcatgcctgcgcaagaatggcaaaaaggtcattcaattgtcccgtaaaacatttgatagcgaatacgtgaagaccagagctaacgactgggatttcgtggtcactacagacatctctgagatgggcgccaattttcgggcagagagggtaattgatccacgccgatgtatgaagcccgtgatcctaaccgacggggaagagagagttatactggccggacctatgccggtgacgcactcatccgctgcccagcggaggggtcgcatcggcagaaacccaaaaaatgaaaacgaccagtatatttacatgggggagcccctcgaaaatgatgaggactgcgcgcattggaaggaggcaaaaatgttactggataacatcaatactcctgaaggaattatccccagtatgttcgagccagaaagggagaaggtcgacgccatagatggcgaataccggcttcgtggtgaggctcgcaaaacatttgtggacctgatgcgaagaggggatctccctgtttggttggcctatagggtggctgcagagggcattaactacgccgaccggcgctggtgtttcgatggaatcaagaataaccaaattctggaagagaacgtcgaagtggagatctggaccaaagagggcgaaagaaagaagctcaaacccaggtggctggacgctcggatatatagcgatccacttgccctaaaggagttcaaagaatttgcagcggggcgaaagtcgctgaccttgaatttaatcactgagatgggaagactgcctacattcatgacccagaaagcccgcgacgctctcgataacctggccgtacttcacacagcagaagtgggtggcagggcttacaatcacgccctgtctgagctcccggagactttggaaacgctgctactgctcacccttctggcaacagttactgggggaatttttttattcttgatgtccggcaagggtatcgggaagatgaccctgggcatgtgctgcattatcacagccagcatactcctgtggtatgctcagattcagccccattggatcgcggcctcaatcattcttgagtttttcctgatcgtcctcttgataccagaacctgagaaacaacggaccccccaggacaaccagctgacttacgtggtgattgcaatcttaacggtcgttgctgccaccatggccaatgaaatgggatttctagagaagacaaaaaaggacctgggcctcgggagtattactacccaggagtctgaatccaacatccttgatatagacctgcgtccagcaagcgcttggacattgtatgccgtggcgaccactttcgtaacacctatgctgagacactcaatcgagaatagtagcgtgaacgtctccctcacggctattgccaatcaagcaaccgtgctgatgggacttggtaggggctggcccctctctaaaatggatatcggggttccgctgttggccattggatgttacagccaggtgaacccaatcactctgacagctgcattactactgctcgtcgcccattacgcgattatcggccctggtcttcaggctaaggccacccgcgaagcacagaagcggaccgccgctgggataatgaaaaatcccacagtagacggcattactgtgatcgatctggagccaatcccctatgaccctaagtttgaaaaacaattgggacaggttatgctgctcgtgctgtgcgtcacgcaggtgcttatgatgcgaaccacatgggccttatgtgaggcactgactctcgctaccggcccgatttccacattgtgggaggggaaccccggaagattctggaataccactatagccgtctcaatggcgaacatctttaggggctcttacctggccggtgcagggctactgttcagtattatgaagaatacgacaaacacccgccggggaactggcaatatcggtgaaaccctcggcgagaaatggaagtcgagacttaacgctctggggaagagcgaatttcagatttataaaaagtccggaatccaagaggtggatcgtacattggccaaagagggcataaagaggggggaaactgaccaccatgcagtttctcggggatcagctaaactgcgctggttcgtggagcgaaacatggtaaccccagaaggcaaggtggtcgatctcggttgcgggagaggaggctggagctactattgtggtggcctgaaaaatgttagggaggtgaaggggttaacaaagggaggccctgggcacgaagagcccatccctatgtccacgtacggatggaaccttgtccggctgcagagtggcgtggacgtattctttaccccacccgagaaatgcgatactctcctatgtgacattggtgaatctagccctaatccaacaatcgaggccgggcgcaccctgagagtgttgaacctggttgaaaattggctcaacaataacactcagttctgcattaaggtgcttaatccctatatgccgtcagtcatcgagaaaatggaaacactgcaaaggaagtacggaggcgccttggtgcgaaaccctctgtcccggaatagtacccacgagatgtactgggtcagcaacgcgacgggcaatatagtgtcttccgttaacatgatttcacgtatgctcatcaatagatttaccatgaaacataagaaggctacatatgagccagatgtagacttagggagcggaactcgcaacatcggtattgaaaacgagatacccaatctggacatcattggcaaaaggatcgaaaagattaaacaggagcacgaaacctcgtggcattacgatcaggaccacccttataagacatgggcataccacgggtcttatgagactaaacagaccggaagtgcctccagcatggtgaacggcgtcgtgaagcttctgacaaagccatgggatgttgtgcccatggtcacccaaatggctatgactgacacgacaccgttcggtcagcagcgggtgtttaaagagaaggtagataccagaactcaggaacctaaagaggggaccaagaaactaatgcgcatcacagccgaatggctctggaaggagctgggaaagaaaaagacgcccaggatgtgtacccgagaggaattcactcggaaagtgagatcaaatgcagccttgggcgctatatttacagacgagaacaagtggaaatccgcgagggaagccgttgaggattctcgcttctgggaactggtcgaccgtgagcggaatctccatcttgagggcaagtgcgaaacctgtgtgtacaacatgatggggaaaagagagaagaagctgggagaatttggtaaagcaaagggcagcagggctatctggtatatgtggttaggggcccgcttcctggagtttgaagcattgggattcctcaatgaggatcactggtttagtcgaggcaactccctgagcggtgtggagggggaaggactacataaacttggctacattctgcgggacgtctctaagaaagagggcggggccatgtacgctgatgacactgccggatgggacacaagaatcaccctcgaagatctgaagaatgaggaaatggttacaaaccacatgaagggtgagcataaaaagttggcggaggcaattttcaaactgacttatcaaaataaggtggtaagggtgcagcgcccaacccctagaggcacggtcatggacatcatttcacggaaagatcagagggggagtggacaggtgggcacctacggtctcaacacattcactaatatggaagcccaacttatacgtcagatggagggggaaggaatctttaagtccattcagcgactgaccgttacagaggagatcgctgtgcaaaactggttagcccgcgtcggcagagaacggctgagcaggatggcaatctctggcgacgattgcgtggtaaagcccttggacgatcgcttcgcttcggccctcactgctctgaatgacatggggaaagttagaaaggatattcagcagtgggagccatcacggggatggaacgactggacccaggtgcccttttgcagccaccacttccatgaactagtcatgaaagatggtagggtgcttgtggtcccttgtcgaaaccaagacgagctgataggccgtgccagaatctcccagggggcaggatggagtctcaaggaaacggcgtgcctgggcaaatcttatgcccagatgtggacattgatgtactttcaccgccgggatttaaggctggctgccaatgcaatttgtagcgctgttccatcccattgggtgccgacctcaagaactacatggagtatccacgccaagcacgagtggatgaccactgaggacatgctcgcagtatggaaccgcgtgtggattcaggaaaatccctggatggaggacaagacccctgtcgaatcttgggaggaagtgccatatcttggtaaacgggaggatcaatggtgcgggagcctgatcggactaacatccagggccacgtgggcgaagaacatacagaccgctatcaatcaggttcgatcactgattggcaacgaggaatacactgactatatgcccagcatgaaaagattccggaaggaggaagaggaagccggcgtgctctggtga

SEQ ID NO: 14687 - RNA, 9876 nt, synthetic construct
  misc_feature 1..9876: note = derived and/or modified CDS sequence (opt3) from DENV-2__EU687214__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgacaccgggtgtgtggtttcctggaagaataaagaattgaagtgcggaagcggcatcttcataactgataacgtccacacatggaccgagcagtacaagtttcagcccgaatctccatcaaaactcgctagtgccattcaaaaggcacatgaggaaggtatctgtggcattaggagcgtgactcggctggagaatttaatgtggaaacagatcacccccgagctgaaccacatactatccgaaaatgaggtgaagctcacaatcatgacgggggacattaaaggaatcatgcaggccggcaagcgctctctgagacctcagccaaccgaacttaaatattcgtggaagacttgggggaaggctaaaatgttgagcacagagtcccataaccaaaccttcctgattgatggaccggaaacagccgagtgccccaatactaacagggcatggaattcactcgaggtcgaagactacggctttggtgttttcagtaccaacatctggctgaagttacgtgagaaacaggacgtgttttgtgattctaagctgatgagcgcggctataaaagacaatcgggccgtgcacgcagatatggggtattggattgaatccgcccttaacgacacgtggaagatggagaaggcttcattcatcgagatcaaaagctgccactggcctaagtctcatacattgtggtccaatggagtactcgaaagtgagatgattatcccaaaaaacttcgccggccccgtcagccagcacaactaccgacctggttatcatacccagactgcaggcccatggcacctggggaagctagaaatggattttgacttctgtgagggaaccacagtggttgtgactgaagattgcggcaatagagggccctctctgaggaccacaacggcttccggaaaactcattaccgagtggtgctgtcgctcatgcactctgccgcctcttcggtacagaggcgaggacggttgttggtacgggatggaaataaggccattgaaggagaaggaagagaacctggtcaatagtttagtgacagccggacatggccaaatcgataactttagcctcggtgttctgggcatggcgcttttcctggaagagatgttgcgcacccgagtggggactaaacacgccattctcctggtagctgtctcgtttgtgacactaatcaccggaaatatgtccttccgggacctgggccgtgtgatggtcatggttggggcaacgatgactgatgacattggaatgggcgtgacctatctcgccctgcttgctgcctttaaggtaagacccacattcgcagcgggtttgctgttaaggaaactcacctctaaggagctgatgatggccactatcgggatagctcttctgagccagtcaacaatccctgaaaccattctagagctcacagatgccctggcattgggaatgatggtgctgaaaatcgtccgcaacatggaaaagtaccagttagctgtgactattatggccatcagttgcgttcccaatgcagtgatactccaaaacgcctggaaggtctcctgtaccattctggctgcggtgtctgttagcccacttctgttgacgtcctcacagcagaaagccgactggatccctctcgcactgacaatcaagggcctaaatcccaccgctatttttctgactacccttagccggacaagtaaaaagagatcttggccactcaacgaggccgtgatggccgtcggcatggtatccatactggctagctcgttgctgaaaaatgacatcccgatgactgggcctttagtggcaggaggtctcctgaccgtttgctatgtgcttacgggcaggtcagccgatctggaattggagcgagcggctgacgtcaagtgggaggatcaggccgaaatttctgggagttcccccatcctcagcattacaatctctgaggacggaagcatgtccataaaaaacgaagaggaggaacacaccctgactatcctaattcgcacaggcctgcttgtgatctcaggtgtattcccagtgagtattcccatcaccgcagccgcttggtacctctgggaggtcaagaagcaacgggcaggggttctgtgggatgtgcctagcccaccccctgtgggaaaagccgaattggaggacggcgcgtatagaataaagcagaggggcatttttgggtactctcagatcggagctggtgtctataaagaaggcactttccatacaatgtggcacgtgacccgtggggccgttttaatgcatcgcggaaagcggatcgagccgtcctgggcagatgtaaaaaaggacctgatttcatacggcggtgggtggaagctcgagggagaatggaaagagggcgaagaggtgcaggtcctggcccttgaaccaggcaagaatcccagagctgtgcaaacgaaacctgggctgtttaagactaacaccggaacaatcggtgccgttagtttggatttcagcccaggcacctccgggtctcccatagtggacaggaaaggaaaggtcgtgggcctatacggtaatggggtagtcacacgatcgggagcatatgtgagcgctattgcccagactgagaagtcaatcgaggataaccctgaaattgaggacgatatcttccggaaaaagcgcctgaccataatggacctccacccgggcgcgggcaaaacgaagagatacctgcccgccattgttagggaagcaatcaaacgggggcttcgaacattaatcctggctccaactagagtggtcgccgctgagatggaagaggcactccgcggattgcctattaggtatcagacccccgccatccgtgccgagcatacaggtcgggaaattgtggacctgatgtgtcacgctacctttactatgagactcctgtccccagttagggtgcctaactacaatcttataatcatggatgaggcgcacttcaccgaccccgcaagtattgccgctcgcggctatatctctacacgagtcgaaatgggggaggccgcaggaatctttatgacggccactccaccgggcagcagagatcctttcccccagtccaacgctccaattatggacgaggaacgggagatacccgaaaggtcatggaattctggtcatgagtgggtgaccaactttaaggggaagacagtatggttcgtgcctagcatcaaagcgggaaatgatattgccgcatgcctgcgcaagaacggcaaaaaggttatccaattgagtcgtaaaacctttgactccgaatacgtcaagactagagctaatgattgggacttcgtggtgacaaccgatattagcgagatgggcgccaactttcgggcagagagggtcatcgacccacgccgatgtatgaagcccgtaatactaacggatggggaagagagagtgatcctggccggacctatgccggttactcactcttcagctgcccagcggaggggtcgcattggcagaaatccaaaaaacgaaaatgaccagtatatctacatgggggagcccctcgaaaacgacgaggattgcgcgcattggaaggaggcaaaaatgttactggacaatattaacacacctgaaggaatcataccctccatgttcgagccagaaagggagaaggtggatgccattgacggcgaataccggcttcgtggtgaggctcgcaaaacctttgtcgatctgatgcgaagaggggacctccctgtgtggttggcctatagggttgctgcagagggcatcaattacgccgatcggcgctggtgtttcgacggaattaagaacaaccaaatcctggaagagaatgtggaagtcgagatatggaccaaagagggcgaaagaaagaagctcaaacccaggtggctggatgctcggatctatagtgacccacttgccctaaaggagttcaaagaatttgcagcggggcgaaagagcctgactttgaacttaattacagagatgggaagactgcctaccttcatgacacagaaagcccgcgatgctctcgacaatctggccgtgcttcacactgcagaagtaggtggcagggcttacaaccacgccctgtcggagctcccggagacgttggaaaccctgctactgctcacacttctggcaactgtgaccgggggaatctttttattcttgatgtctggcaagggtattgggaagatgacactgggcatgtgctgcatcataaccgcctccattctcctgtggtatgctcagatccagccccattggatcgcggccagcattatccttgagtttttcctgatagttctcttgattccagaacctgagaaacaacggactccccaggataatcagctgacgtacgtcgtgatcgcaattttaaccgtggtcgctgccacaatggccaacgaaatgggatttctagagaagactaaaaaggacctgggcctcgggtcaatcaccacacaggagagtgaatctaatatacttgacatcgatctgcgtccagcatccgcttggaccttgtatgccgttgcgactacattcgtgacgcctatgctgagacacagcattgagaactcaagtgtaaatgtgagcctcaccgctatcgccaaccaagcaactgtcctgatgggacttggtaggggctggcccctctccaaaatggacattggggtgccgctgttggccatcggatgttactctcaggttaatccaattacactgaccgctgcattactactgctcgtggcccattacgcgatcataggccctggtcttcaggctaaggccacccgcgaagcacagaagcggacagccgctgggattatgaaaaaccccactgtcgatggcatcacggtaatcgacctggagccaattccctatgatcctaagtttgaaaaacaattgggacaggtgatgctgctcgttctgtgcgtgacccaggtccttatgatgcgaacaacttgggccttatgtgaggcactgaccctcgctacaggcccgataagcaccttgtgggaggggaatcccggaagattctggaacactacgatcgccgtgtccatggcgaatatttttaggggctcatacctggccggtgcagggctactgttctctatcatgaagaacacaaccaatactcgccggggaaccggcaacattggtgaaacactcggcgagaaatggaagagtagacttaacgctctggggaagtcggaatttcagatctataaaaagagcggaatacaagaggtcgaccgtactttggccaaagagggcatcaagaggggggaaaccgatcaccatgcagtgtcccggggatctgctaaactgcgctggttcgttgagcgaaatatggtgacaccagaaggcaaggtagtggacctcggttgcgggagaggaggctggtcatactattgtggtggcctgaaaaacgtcagggaggttaaggggttaacgaagggaggccctgggcacgaagagcccattcctatgagcacctacggatggaatcttgtgcggctgcagtccggcgtcgatgtgttctttactccacccgagaaatgcgacacactcctatgtgatatcggtgaaagttctcctaacccaaccattgaggccgggcgcactctgagagtattgaatctggtggaaaactggctcaataacaatacacagttctgcgttaaggtgcttaacccctatatgccgagcgtcatcgagaaaatggaaaccctgcaaaggaagtacggaggcgccttggtgcgaaatcctctgtcacggaactccacgcacgagatgtactgggtcagtaatgcgaccggcaacatagtgagctctgttaatatgatttcccgtatgctcatcaacagatttacaatgaaacataagaaggctacttatgagccagacgtagatttagggtcaggaacccgcaacatcggtattgaaaatgagatacccaacctggacatcattggcaaaaggatcgaaaagattaaacaggagcacgaaacaagctggcattacgaccaggatcacccttataagacttgggcataccacgggtcgtatgagaccaaacagacaggatctgccagttccatggtgaatggcgtcgtgaagcttctgaccaagccatgggacgttgtgcccatggtcactcaaatggctatgacggatacaaccccgttcggtcagcagcgggtgtttaaagagaaggtagacactagaacccaggaacctaaagaggggacaaagaaactaatgcgcatcacggccgaatggctctggaaggagctgggaaagaaaaagacccccaggatgtgtactcgagaggaattcacacggaaagtgagaagcaacgcagccttgggcgctatatttaccgatgagaataagtggaaatcagcgagggaagccgttgaggactcccgcttctgggaactggtcgatcgtgagcggaacctccatcttgagggcaagtgcgaaacttgtgtgtacaatatgatggggaaaagagagaagaagctgggagaatttggtaaagcaaagggctctagggctatctggtatatgtggttaggggcccgcttcctggagtttgaagcattgggattcctcaacgaggaccactggtttagccgaggcaatagtctgtccggtgtggagggggaaggactacataaacttggctacattctgcgggatgtcagcaagaaagagggcggggccatgtacgctgacgatacagccggatgggacaccagaatcacactcgaagacctgaagaacgaggaaatggttactaatcacatgaagggtgagcataaaaagttggcggaggcaattttcaaactgacctatcaaaacaaggtggtaagggtgcagcgcccaacgcctagaggcaccgtcatggatatcatttctcggaaagaccagagggggtcaggacaggtgggcacatacggtctcaatactttcaccaacatggaagcccaacttatacgtcagatggagggggaaggaatctttaagagtattcagcgactgacagttactgaggagatcgctgtgcaaaattggttagcccgcgtcggcagagaacggctgtccaggatggcaatcagcggcgatgactgcgtggtaaagcccttggatgaccgcttcgcttctgccctcattgctctgaacgatatggggaaagttagaaaggacatacagcagtgggagccatcgcggggatggaacgattggacccaggtgcccttttgctcacaccacttccatgaactagtcatgaaagacggtagggtgcttgtggtcccttgtcgaaatcaagatgagctgatcggccgtgccagaattagccagggggcaggatggtccctcaaggaaacggcgtgcctgggcaaaagttatgcccagatgtggacattgatgtactttcaccgccgggacttaaggctggctgccaacgcaatctgttctgctgttccaagccattgggtgccgacctccagaactacatggtcaattcacgccaagcacgagtggatgaccactgaggatatgctcgcagtatggaatcgcgtgtggatccaggaaaacccctggatggaggacaagacccctgtcgaaagttgggaggaagtgccatatcttggtaaacgggaggaccaatggtgcgggtctctgataggactaacaagcagggccacgtgggcgaagaatatccagaccgctattaaccaggttcgatccctgatcggcaatgaggaatacactgattatatgccctcaatgaaaagattccggaaggaggaagaggaagccggcgtgctctggtga

SEQ ID NO: 14688 - RNA, 9876 nt, synthetic construct
  misc_feature 1..9876: note = derived and/or modified CDS sequence (opt3) from DENV-2__EU687215__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgacaccgggtgtgtggtttcctggaagaataaagaattgaagtgcggaagcggcatcttcataactgataacgtccacacatggaccgagcagtacaagtttcagcccgaatctccatcaaaactcgctagtgccattcaaaaggcacatgaggaaggtatctgtggcattaggagcgtgactcggctggagaatttaatgtggaaacagatcacccccgagctgaaccacatactatccgaaaatgaggtgaagctcacaatcatgacgggggacattaaaggaatcatgcaggccggcaagcgctctctgagacctcagccaaccgaacttaaatattcgtggaagacttgggggaaggctaaaatgttgagcacagagtcccataaccaaaccttcctgattgatggaccggaaacagccgagtgccccaatactaacagggcatggaattcactcgaggtcgaagactacggctttggtgttttcagtaccaacatctggctgaagttacgtgagaaacaggacgtgttttgtgattctaagctgatgagcgcggctataaaagacaatcgggccgtgcacgcagatatggggtattggattgaatccgcccttaacgacacgtggaagatggagaaggcttcattcatcgagatcaaaagctgccactggcctaagtctcatacattgtggtccaatggagtactcgaaagtgagatgattatcccaaaaaacttcgccggccccgtcagccagcacaactaccgacctggttatcatacccagactgcaggcccatggcacctggggaagctagaaatggattttgacttctgtgagggaaccacagtggttgtgactgaagattgcggcaatagagggccctctctgaggaccacaacggcttccggaaaactcattaccgagtggtgctgtcgctcatgcactctgccgcctcttcggtacagaggcgaggacggttgttggtacgggatggaaataaggccattgaaggagaaggaagagaacctggtcaatagtttagtgacagccggacatggccaaatcgataactttagcctcggtgttctgggcatggcgcttttcctggaagagatgttgcgcacccgagtggggactaaacacgccattctcctggtagctgtctcgtttgtgacactaatcaccggaaatatgtccttccgggacctgggccgtgtgatggtcatggttggggcaacgatgactgatgacattggaatgggcgtgacctatctcgccctgcttgctgcctttaaggtaagacccacattcgcagcgggtttgctgttaaggaaactcacctctaaggagctgatgatggccactatcgggatagctcttctgagccagtcaacaatccctgaaaccattctagagctcacagatgccctggcattgggaatgatggtgctgaaaatcgtccgcaacatggaaaagtaccagttagctgtgactattatggccatcagttgcgttcccaatgcagtgatactccaaaacgcctggaaggtctcctgtaccattctggctgcggtgtctgttagcccacttctgttgacgtcctcacagcagaaagccgactggatccctctcgcactgacaatcaagggcctaaatcccaccgctatttttctgactacccttagccggacaagtaaaaagagatcttggccactcaacgaggccgtgatggccgtcggcatggtatccatactggctagctcgttgctgaaaaatgacatcccgatgactgggcctttagtggcaggaggtctcctgaccgtttgctatgtgcttacgggcaggtcagccgatctggaattggagcgagcggctgacgtcaagtgggaggatcaggccgaaatttctgggagttcccccatcctcagcattacaatctctgaggacggaagcatgtccataaaaaacgaagaggaggaacacaccctgactatcctaattcgcacaggcctgcttgtgatctcaggtgtattcccagtgagtattcccatcaccgcagccgcttggtacctctgggaggtcaagaagcaacgggcaggggttctgtgggatgtgcctagcccaccccctgtgggaaaagccgaattggaggacggcgcgtatagaataaagcagaggggcatttttgggtactctcagatcggagctggtgtctataaagaaggcactttccatacaatgtggcacgtgacccgtggggccgttttaatgcatcgcggaaagcggatcgagccgtcctgggcagatgtaaaaaaggacctgatttcatacggcggtgggtggaagctcgagggagaatggaaagagggcgaagaggtgcaggtcctggcccttgaaccaggcaagaatcccagagctgtgcaaacgaaacctgggctgtttaagactaaaaccggaacaatcggtgccgttagtttggatttcagcccaggcacctccgggtctcccatagtggacaggaagggaaaggtcgtgggcctatacggtaacggggtagtcacacgatcgggagcatatgtgagcgctattgcccagactgagaaatcaatcgaggataatcctgaaattgaggacgatatcttccggaagaaacgcctgaccataatggacctccacccgggcgcgggcaagacgaaaagatacctgcccgccattgttagggaagcaatcaagcgggggcttcgaacattaatcctggctccaactagagtggtcgccgctgagatggaagaggcactccgcggattgcctattaggtatcagacccccgccatccgtgccgagcatacaggtcgggaaattgtggacctgatgtgtcacgctacctttactatgagactcctgtccccagttagggtgcctaactacaaccttataatcatggatgaggcgcacttcaccgaccccgcaagtattgccgctcgcggctatatctctacacgagtcgaaatgggggaggccgcaggaatctttatgacggccactccaccgggcagcagagatcctttcccccagtccaatgctccaattatggacgaggaacgggagatacccgaaaggtcatggaactctggtcatgagtgggtgaccgattttaaggggaaaacagtatggttcgtgcctagcatcaaggcgggaaatgacattgccgcatgcctgcgcaaaaacggcaagaaagttatccaattgagtcgtaagacctttgattccgaatacgtcaagactagagctaatgactgggatttcgtggtgacaaccgacattagcgagatgggcgccaactttcgggcagagagggtcatcgatccacgccgatgtatgaaacccgtaatactaacggacggggaagagagagtgatcctggccggacctatgccggttactcactcttcagctgcccagcggaggggtcgcattggcagaaatccaaagaacgaaaatgaccagtatatctacatgggggagcccctcgaaaacgatgaggactgcgcgcattggaaagaggcaaagatgttactggataatattaacacacctgaaggaatcataccctccatgttcgagccagaaagggagaaagtggacgccattgatggcgaataccggcttcgtggtgaggctcgcaagacctttgtcgacctgatgcgaagaggggatctccctgtgtggttggcctatagggttgctgcagagggcatcaattacgccgaccggcgctggtgtttcgatggaattaaaaacaatcaaatcctggaagagaacgtggaagtcgagatatggaccaaggagggcgaaagaaagaaactcaagcccaggtggctggacgctcggatctatagtgatccacttgccctaaaagagttcaaggaatttgcagcggggcgaaaaagcctgactttgaacttaattacagagatgggaagactgcctaccttcatgacacagaaggcccgcgacgctctcgataatctggccgtgcttcacactgcagaagtaggtggcagggcttacaaccacgccctgtcggagctcccggagacgttggaaaccctgctactgctcacacttctggcaactgtgaccgggggaatctttttattcttgatgtctggcaagggtattgggaaaatgacactgggcatgtgctgcatcataaccgcctccattctcctgtggtatgctcagatccagccccattggatcgcggccagcattatccttgagtttttcctgatagttctcttgattccagaacctgagaagcaacggactccccaggacaatcagctgacgtacgtcgtgatcgcaattttaaccgtggtcgctgccacaatggccaacgaaatgggatttctagagaaaactaagaaagacctgggcctcgggtcaatcaccacacaggagagtgaatctaatatacttgatatcgacctgcgtccagcatccgcttggaccttgtatgccgttgcgactgctttcgtgacacctatgctgagacacagcattgagaactcaagtgtaaatgtgagcctcacggccatcgcaaaccaagccaccgtcctgatgggacttggtaggggctggcccctctccaagatggatattggggtgccgctgttggctatcggatgttactctcaggttaatccaattactctgacagcagccttactactgctcgtggcgcattacgctatcataggccctggtcttcaggccaaggcaacccgcgaagcccagaaacggaccgctgccgggattatgaagaaccccacagtcgacggcatcactgtaatcgatctggagccaattccctatgaccctaaatttgaaaagcaattgggacaggtgatgctgctcgttctgtgcgtgacgcaggtccttatgatgcgaaccacatgggcattatgtgaggctctgactctcgccaccggcccgataagcacattgtgggaggggaatcccggaagattctggaacaccactatcgcggtgtccatggccaatatttttaggggctcatacctggcaggtgctgggctactgttctctatcatgaaaaacacgacaaatacccgccggggaactggcaacattggtgaaaccctcggcgagaagtggaagagtagacttaatgccctggggaaatcggaatttcagatctataagaaaagcggaatacaagaggtcgatcgtacattggcaaaggagggcatcaaaaggggggaaactgaccaccatgctgtgtcccggggatctgccaagctgcgctggttcgttgagcgaaacatggtgaccccagaaggcaaagtagtggatctcggttgcgggagaggaggctggtcatactattgtggtggcctgaagaacgtcagggaggttaaggggttaacaaaaggaggccctgggcacgaagagcccattcctatgagcacgtacggatggaatcttgtgcggctgcagtccggcgtcgacgtgttctttaccccacccgagaagtgcgatactctcctatgtgacatcggtgaaagttctcctaacccaacaattgaggccgggcgcaccctgagagtattgaatctggtggaaaactggctcaataacaatactcagttctgcgttaaagtgcttaacccctatatgccgagcgtcatcgagaagatggaaacactgcaaaggaaatacggaggcgcgttggtgcgaaatcctctgtcacggaactccacccacgagatgtactgggtcagtaatgctacgggcaacatagtgagctctgttaatatgatttcccgtatgctcatcaacagatttaccatgaagcataagaaagcaacatatgagccagatgtagacttagggtcaggaactcgcaatatcggtattgaaaacgagatacccaacctggacatcattggcaagaggatcgaaaaaattaagcaggagcacgaaaccagctggcattacgatcaggaccacccttataaaacatgggcctaccacgggtcgtatgagactaagcagaccggatctgctagttccatggtgaatggcgtcgtgaagcttctgacaaaaccatgggatgttgtgcccatggtcacccaaatggccatgactgacacgacaccgttcggtcagcagcgggtgtttaaggagaaagtagataccagaactcaggaacctaaggaggggaccaaaaagctaatgcgcatcacagcagaatggctctggaaggagctgggaaaaaagaaaacgcccaggatgtgtacccgagaggaattcactcggaaggtgagaagcaacgccgctttgggcgcgatatttacagacgagaataaatggaagtcagccagggaagcagttgaggattcccgcttctgggaactggtcgaccgtgagcggaacctccatcttgagggcaaatgcgaaacctgtgtgtacaatatgatggggaagagagagaagaaactgggagaatttggtaaggctaaaggctctagggccatctggtatatgtggttaggggcacgcttcctggagtttgaagccttgggattcctcaacgaggatcactggtttagccgaggcaatagtctgtccggtgtggagggggaaggactacataagcttggctacattctgcgggacgtcagcaaaaaggagggcggggctatgtacgccgatgacactgcgggatgggacacaagaatcaccctcgaagatctgaagaacgaggaaatggttacaaatcacatgaaaggtgagcataagaaattggcagaggccattttcaagctgacttatcaaaacaaagtggtaagggtgcagcgcccaacccctagaggcacggtcatggacatcatttctcggaaggatcagagggggtcaggacaggtgggcacctacggtctcaatacattcactaacatggaagctcaacttatacgtcagatggagggggaaggaatctttaagagtattcagcgactgaccgttacagaggagatcgccgtgcaaaattggttagcacgcgtcggcagagaacggctgtccaggatggctatcagcggcgacgattgcgtggtaaaacccttggacgatcgcttcgcctctgctctcactgccctgaacgacatggggaaggttagaaaagatattcagcagtgggagccatcgcggggatggaatgactggacccaggtgcccttttgctcacaccacttccatgaactagtcatgaaggatggtagggtgcttgtggtcccttgtcgaaaccaagacgagctgataggccgtgcaagaatcagccagggggcgggatggtccctcaaagaaacggcctgcctgggcaagagttatgctcagatgtggacattgatgtactttcaccgccgggatttaaggctggccgcaaacgctatttgttctgccgttccaagccattgggtgccgacctccagaactacatggtcaatccacgcaaagcacgagtggatgaccactgaggacatgctcgccgtatggaatcgcgtgtggattcaggaaaacccctggatggaggacaaaacccctgtcgaaagttgggaggaagtgccatatcttggtaagcgggaggatcaatggtgcgggtctctgatcggactaacaagcagggcgacgtgggctaaaaatatacagaccgccatcaaccaggttcgatccctgattggcaatgaggaatacactgactatatgccctcaatgaagagattccggaaagaggaagaggaagcaggcgtgctctggtga

SEQ ID NO: 14689 - RNA, 9876 nt, synthetic construct
  misc_feature 1..9876: note = derived and/or modified CDS sequence (opt3) from DENV-2__EU687216__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccatagtcatcactccacacagcggtgaggagcatgctgttggcaatgacacggggaagcacggaaaagaaattaagatcacaccgcagtcctcaaccactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataagcttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataaccgatttggagaaaaggcatgttctcggccggctgatcacagtgaacccgattgtcactgaaaaggactcccctgtgaacatcgaggccgaacccccatttggagatagctacatcattgtcggcgtggagcctgggcagttaaaactgaattggttcaagaagggatcgtctataggtcaaatgtttgagaccacaatgcgaggcgctaaacgcatggccatcctaggggacactgcatgggatttcggatccctcggcggtgtttttacctcaattgggaaggccctgcaccaggtgttcggcgctatctacggagcggcatttagtggcgtaagctggacgatgaaaattcttatcggggtcataatcacatggattggaatgaactccagatctaccagcttgtcagtgagtctggttctcgtgggcgtcgtgactctgtatcttggtgccatggtacaggctgactccgggtgtatcgtgagctggaagaataaagaactgaagtgcggatctggcattttcatcacagataacgttcacacctggactgagcagtacaagtttcaacccgaatcaccaagtaaattggccagcgcaatacagaaggcccatgaggaaggtatttgtggcatcaggtccgtcacccggctcgagaatctgatgtggaaacagattacacccgagttaaaccacatcctgtctgaaaatgaggtgaagctaacgataatgaccggggacatcaaaggaattatgcaggctggcaagcgctcgctcagacctcaaccaactgaactgaaatatagctggaagacatgggggaaggccaaaatgctttccaccgagtcacataaccagacattcttgatcgatggaccggaaactgcagagtgccccaataccaacagggcgtggaatagtctggaggtggaagactacggctttggtgtcttcacgacaaacatttggctcaagctgcgtgagaaacaggacgttttttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatgatcatcccaaaaaacttcgcaggccccgtcagccagcacaactaccgacctggttatcatacccaaacagctggcccatggcacctcgggaagctggaaatggattttaatttctgtgagggaactaccgtggttgtgacagaagactgcggcaacagagggccctctctaaggacgaccactgcctccggaaaactgattacagagtggtgctgtcgctcatgcaccctcccgcctctgcggtacagaggcgaggatggttgttggtacgggatggaaatcaggccacttaaggagaaggaagagaatttggtcaacagtctggtgactgcgggacatggccagattgacaattttagcttaggtgttctcggcatggccctgttccttgaagagatgctgcgcacacgagtggggaccaaacacgctatattgctcgtagcactgtcgtttgtcacgctaatcactggaaacatgtccttccgggatctgggccgtgtgatggtgatggtcggggccaccatgacagacgatattggaatgggcgttacctatctcgctctgcttgccgcatttaaggtgagacccactttcgcggccggtttgctgttaaggaaactcacatctaaggagctgatgatggctaccatcgggattgcccttctgagccagtcaacactacctgaaactatcctcgagctgaccgacgcattggctctgggaatgatggtattaaaaatagtgcgcaatatggaaaagtaccaactcgccgtcacgatcatggcaattagttgcgtgcccaacgccgttatcctgcagaatgcttggaaggtgtcctgtacaattcttgcggccgtctctgtgagcccactgttgctcacctcctcacagcagaaagcagattggatccctctggctctaactataaagggcctgaaccccaccgccatttttcttacaactctcagccggaccagtaaaaagagatcttggccactgaatgaggccatcatggctgttggcatggtgtccatcttggcaagctcgctgttaaaaaacgacattccgatgacggggcctctcgtcgccggaggtctgcttacagtatgctatgtgctgaccggcaggtcagcggacttggaactcgagcgagctgccgatgttaagtgggaggaccaagcagaaatatctgggagttcccccatcctgagcattactatctctgaggatggaagcatgtccattaaaaatgaagaggaggaacagacactaaccatcctgatacgcactggccttctcgtgatctcaggtgtcttcccagtgagtattcccatcacagccgctgcatggtacctgtgggaggtaaagaagcagcgggccggggtgttgtgggacgtccctagcccaccccctgttggaaaagcggaattagaggatggcgcttatagaattaagcagaggggcatcctggggtactctcaaataggagccggtgtgtataaagaaggcacctttcacacgatgtggcatgtgactcgtggggcagtcctcatgcaccgcggaaagcggattgagccgtcctgggccgacgtgaaaaaggatctgatctcatacggcggtgggtggaagcttgagggagaatggaaagagggcgaagaggttcaggtactggctttggaaccaggcaagaaccccagagccgtgcagaccaaacctgggatcttcaagacaaataccggaacaattggtgcagtcagtctagactttagcccaggcacttccgggtctcccatcgtggataggaaaggaaaggttgtgggcctgtacggtaacggggtcgtgacccgatcgggagcttatgtaagcgccatagcgcagacggagaagtcaattgaggacaaccctgaaatcgaggatgacattttccggaaaaagcgcctcacaatcatggatctgcatccgggcgccggcaaaactaagagataccttcccgcaatagtcagggaagctattaaacgggggttacgaaccctgatcctcgccccaacaagagtggttgctgcagagatggaagaggccttgcgcggactgcctatcaggtatcaaacccccgccattcgtgctgagcacactggtcgggaaatcgtggacctcatgtgtcatgcgaccttcacaatgagactgctttccccagtcagggtgcctaattacaacctgattataatggacgaggcacactttacggatcccgccagtatcgctgcccgcggctatatttctactcgagttgaaatgggggaggcagccggaatcttcatgaccgctacaccaccgggcagcagagacccttttccccagtccaatgcgccaatcatggatgaggaacgggagattcccgaaaggtcatggaactctggtcacgagtgggtgaccgacttcaaggggaagactgtctggtttgtgcctagcataaaagccggaaatgatatcgcagcttgcttgcgcaagaacggcaaaaaggtaattcagctaagtcgtaaaacattcgactccgaatacgtgaagaccagagccaatgattgggactttgttgtcacgactgatatcagcgagatgggcgcaaacttcaaggccgagcgggtgattgacccaaggcgctgtatgaaacccgtgatcctgacagatggggaagagcgagtcatactcgctggacctatgccggtaacccattcttcagccgcgcaaagacggggtaggatcggccgcaatccaaagaacgaaaatgaccagtatatttacatgggggagcccttagaaaacgacgaggattgcgcacactggaaagaggccaagatgctgcttgacaatatcaacacccctgaaggaattatcccctccatgtttgagccagaaagagagaaagtggatgctatagacggcgaatacaggctgcggggtgaggcccgtaagactttcgttgagctcatgcgccgaggggatttgcctgtgtggctggcttataaagtcgcagccgaaggcattaattacgctgacagaaagtggtgttttgatggaatcaagaacaaccagattctcgaggaaaatgtggaggttgagatctggacaaaagaaggcgagaggaagaaactgaagccccggtggcttgacgcccgcatatatagtgatccactagcactgaaagaattcaaggagttcgcggccgggagaaagagcttgaccttaaacctgatcacagaaatgggaaggctccctacttttatgacgcagaaagctcggaatgccctggacaaccttgcagtgctgcataccgctgaggtcggtggccgagcctacaatcacgcactctcggagttgccggaaacactggagactctactgctccttaccctgttagccacagtgaccgggggaattttcttgtttctgatgtctggcaagggtgtagggaaaatgactctcggcatgtgctgcatcattacggcttccatcctgctttggtatgcgcaaatacagccccactggattgccgcaagcatcatcctggaattctttctcattgtgttgctgatcccagagcctgaaaagcagagaaccccccaggataaccaattaacatacgttgtcatagctattctaactgtggtggccgccaccatggcaaatgagatgggattcctggagaaaacaaagaaggacctcggctttgggtcaatcaccactcaggaaagtgagtctaacattcttgatatcgacctgcgcccagcttccgcctggacattgtatgcggtcgctacgaccttcataactcctatgctgaggcatagcatcgaaaattcaagtgttaacgtgagcctcacagccattgcaaatcaggccaccgtactgatgggacttggtaaaggctggcccctctccaagatggacatcggggtgccgctgttggctattggatgttactctcaggtcaacccaatcaccctgacagcagccttactactgctcgtggcgcactacgctattatcggccctggtcttcaagccaaagcaactcgggaggcccagaagcgtgctgccgcagggataatgaaaaatcccacggttgatggcattaccgtgatcgacctggaaccaatcccctatgatcctaagtttgagaagcagttgggacaggtcatgctgctcattctgtgcgtaacacaagtgcttatgatgagaactacctgggctttatgtgaggccctgacactcgcgaccggcccgataagcactttgtgggaagggaaccccggaaggttctggaatacgacaatcgccgtttccatggcaaacatttttcgcggctcatacctggctggtgccgggctactgttctctatcatgaaaaataccactaacacccggcgaggaacaggcaacgtgggtgagactctcggcgaaaagtggaaaagtagacttaatgcactggggaagtcggagtttcagatttataaaaagagcggaatccaggaggtcgacaggaccttggctaaagaaggcataaagcgcggggagacagatcatcacgccgtgtcccggggatctgccaagctgagatggttcgtcgaacgtaacatggtgacgccagagggcaaagttgtggacctcggttgcgggaggggaggctggtcatactattgtggtggcctgaagaatgtacgggaagtgaaagggttaaccaagggaggccctgggcatgaggagcccatccctatgagcacttacggatggaaccttgtccgcctgcaatccggcgttgatgtgttctttacaccacccgaaaaatgcgacaccctcctatgtgatattggtgagagttctcctaatccaactatcgaagcggggcgaacactgagagtcttgaacctggtggagaattggctcaacaataacacccagttctgcattaaggtacttaatccctatatgccgagcgtgatcgaaaagatggagacgctgcagaggaaatacggaggcgctttggttcggaaccctctgtcacgcaattccacccacgagatgtactgggtgagtaacgcaacaggcaatatagtcagctctgtgaacatgatttccagaatgctcatcaacaggtttactatgaagcacaaaaaggccacctatgaaccagacgtcgatttagggtcaggaacacgaaatatcggtattgagagcgaaatacccaacctggacatcattggcaaacggatcgagaagattaagcaggaacatgagacttcgtggcactacgatcaagaccatccttataaaacctgggcttaccacgggtcttatgagacaaagcagaccggaagtgcctccagcatggtgaatggcgttgtacgtcttctgactaaaccatgggacgtggtccccatggtgacgcagatggcaatgacagataccactccgttcggtcagcaaagagtttttaaggaaaaagtggacacccgcacacaggagcctaaggaagggacgaagaaactaatgaagatcaccgccgagtggctctggaaagagctgggaaaggaaaaaactcccaggatgtgtacacgggaggaattcaccagaaaggtccgctcaaacgctgcgttgggcgccatatttactgatgagaataaatggaagtccgcaagggaagctgtggaggacggccgattctgggagctggtagatcgggaaagaaacctccaccttgaggggaagtgcgaaacatgtgtgtacaatatgatgggaaaaagggagaagaaactgggtgaatttggcaaggccaaagggtctcgcgcaatctggtatatgtggttaggagcccgtttcctggagtttgaggctttgggcttcctcaacgaagaccattggtttagccggggtaatagtctgtccggggttgagggagaaggcctacacagacttggctacattctgagggaggtcgggaagaaggaaggaggtgccatgtacgcggatgacaccgcaggctgggatacacgcatcactctcgaggacctgaaaaacgaggaaatggtgaccaatcatatgaagggggagcacaaaaagttggccgaagctattttcaaactgacgtatcagaacaaggtggtccgagttcagcggccaacccctagaggaacagtgatggatatcattagcaggaaggaccaacgcggctctggtcaggtagggacttacggactcaataccttcacaaacatggaggcccagcttataagacaaatggagggcgaaggcatctttaaatcaattcagcatctgactgcaaccgaggaaatcgctgtgcagaattggttagcccgggtcgggagggagcgtctgagtcgaatggctatctccggagacgattgcgtggttaagcccattgacgatcgcttcgccagcgcattgacggcgctcaacgacatgggtaaagtgagaaaggatatacagcaatgggaaccatctcggggctggaacgactggacacaggtccccttttgctcgcaccacttccatgagctggtgatgaaagatgggagggtactagttgtgccttgtcgcaatcaggacgagcttatcggaagagcccggatttcacagggcgctggttggagcctgaaggaaaccgcctgcctcgggaagtcctatgcacaaatgtggactctgatgtactttcacaggcgagatttgcgtttagctgccaacgcaatctgtagtgccgtcccatctcattgggtgccgacaagcagaaccacttggtccattcacgcgaaacacgagtggatgaccacagaagacatgctggctgtgtggaatcgcgtctggatccaggagaacccctggatggaagataagacgcctgttgagtcatgggaggaagtgccatatctcggaaaacgggaggaccagtggtgcggcagtcttataggcctgacctctagggccacttgggcaaagaatatccagacagccattaaccaagtaagaagcctaatcgggaatgaagagtacaccgattatatgccctccatgaaacgcttccggagggaagaggaggaagctggagtgctgtggtga

SEQ ID NO: 14690 - RNA, 9876 nt, synthetic construct
  misc_feature 1..9876: note = derived and/or modified CDS sequence (opt3) from DENV-2__EU726770__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgacaccgggtgtgtggtttcctggaagaataaagaattgaagtgcggaagcggcatcttcataactgataacgtccacacatggaccgagcagtacaagtttcagcccgaatctccatcaaaactcgctagtgccattcaaaaggcacatgaggaaggtatctgtggcattaggagcgtgactcggctggagaatttaatgtggaaacagatcacccccgagctgaaccacatactatccgaaaatgaggtgaagctcacaatcatgacgggggacattaaaggaatcatgcaggccggcaagcgctctctgagacctcagccaaccgaacttaaatattcgtggaagacttgggggaaggctaaaatgttgagcacagagtcccataaccaaaccttcctgattgatggaccggaaacagccgagtgccccaatactaacagggcatggaattcactcgaggtcgaagactacggctttggtgttttcagtaccaacatctggctgaagttacgtgagaaacaggacgtgttttgtgattctaagctgatgagcgcggctataaaagacaatcgggccgtgcacgcagatatggggtattggattgaatccgcccttaacgacacgtggaagatggagaaggcttcattcatcgagatcaaaagctgccactggcctaagtctcatacattgtggtccaatggagtactcgaaagtgagatgattatcccaaaaaacttcgccggccccgtcagccagcacaactaccgacctggttatcatacccagactgcaggcccatggcacctggggaagctagaaatggattttgacttctgtgagggaaccacagtggttgtgactgaagattgcggcaatagagggccctctctgaggaccacaacggcttccggaaaactcattaccgagtggtgctgtcgctcatgcactctgccgcctcttcggtacagaggcgaggacggttgttggtacgggatggaaataaggccattgaaggagaaggaagagaacctggtcaatagtttagtgacagccggacatggccaaatcgataactttagcctcggtgttctgggcatggcgcttttcctggaagagatgttgcgcacccgagtggggactaaacacgccattctcctggtagctgtctcgtttgtgacactaatcaccggaaatatgtccttccgggacctgggccgtgtgatggtcatggttggggcaacgatgactgatgacattggaatgggcgtgacctatctcgccctgcttgctgcctttaaggtaagacccacattcgcagcgggtttgctgttaaggaaactcacctctaaggagctgatgatggccactatcgggatagctcttctgagccagtcaacaatccctgaaaccattctagagctcacagatgccctggcattgggaatgatggtgctgaaaatcgtccgcaacatggaaaagtaccagttagctgtgactattatggccatcagttgcgttcccaatgcagtgatactccaaaacgcctggaaggtctcctgtaccattctggctgcggtgtctgttagcccacttctgttgacgtcctcacagcagaaagccgactggatccctctcgcactgacaatcaagggcctaaatcccaccgctatttttctgactacccttagccggacaagtaaaaagagatcttggccactcaacgaggccgtgatggccgtcggcatggtatccatactggctagctcgttgctgaaaaatgacatcccgatgactgggcctttagtggcaggaggtctcctgaccgtttgctatgtgcttacgggcaggtcagccgatctggaattggagcgagcggctgacgtcaagtgggaggatcaggccgaaatttctgggagttcccccatcctcagcattacaatctctgaggacggaagcatgtccataaaaaacgaagaggaggaacacaccctgactatcctaattcgcacaggcctgcttgtgatctcaggtgtattcccagtgagtattcccatcaccgcagccgcttggtacctctgggaggtcaagaagcaacgggcaggggttctgtgggatgtgcctagcccaccccctgtgggaaaagccgaattggaggacggcgcgtatagaataaagcagaggggcatttttgggtactctcagatcggagctggtgtctataaagaaggcactttccatacaatgtggcacgtgacccgtggggccgttttaatgcatcgcggaaagcggatcgagccgtcctgggcagatgtaaaaaaggacctgatttcatacggcggtgggtggaagctcgagggagaatggaaagagggcgaagaggtgcaggtcctggcccttgaaccaggcaagaatcccagagctgtgcaaacgaaacctgggctgtttaagactaacaccggaacaatcggtgccgttagtttggatttcagcccaggcacctccgggtctcccatagtggacaggaaaggaaaggtcgtgggcctatacggtaatggggtagtcacacgatcgggagcatatgtgagcgctattgcccagactgagaagtcaatcgaggataaccctgaaattgaggacgatatcttccggaaaaagcgcctgaccataatggacctccacccgggcgcgggcaaaacgaagagatacctgcccgccattgttagggaagcaatcaaacgggggcttcgaacattaatcctggctccaactagagtggtcgccgctgagatggaagaggcactccgcggattgcctattaggtatcagacccccgccatccgtgccgagcatacaggtcgggaaattgtggacctgatgtgtcacgctacctttactatgagactcctgtccccagttagggtgcctaactacaatcttataatcatggatgaggcgcacttcaccgaccccgcaagtattgccgctcgcggctatatctctacacgagtcgaaatgggggaggccgcaggaatctttatgacggccactccaccgggcagcagagatcctttcccccagtccaacgctccaattatggacgaggaacgggagatacccgaaaggtcatggaattctggtcatgagtgggtgaccgattttaaggggaagacagtatggttcgtgcctagcatcaaagcgggaaacgacattgccgcatgcctgcgcaagaatggcaaaaaggttatccaattgagtcgtaaaacctttgattccgaatacgtcaagactagagctaacgactgggatttcgtggtgacaaccgacattagcgagatgggcgccaattttcgggcagagagggtcatcgatccacgccgatgtatgaagcccgtaatactaacggacggggaagagagagtgatcctggccggacctatgccggttactcactcttcagctgcccagcggaggggtcgcattggcagaaacccaaaaaatgaaaacgaccagtatatctacatgggggagcccctcgaaaatgatgaggactgcgcgcattggaaggaggcaaaaatgttactggataacattaatacacctgaaggaatcataccctccatgttcgagccagaaagggagaaggtggacgccattgatggcgaataccggcttcgtggtgaggctcgcaaaacctttgtcgacctgatgcgaagaggggatctccctgtgtggttggcctatagggttgctgcagagggcatcaactacgccgaccggcgctggtgtttcgatggaattaagaataaccaaatcctggaagagaacgtggaagtcgagatatggaccaaagagggcgaaagaaagaagctcaaacccaggtggctggacgctcggatctatagtgatccacttgccctaaaggagttcaaagaatttgcagcggggcgaaagagcctgactttgaatttaattacagagatgggaagactgcctaccttcatgacacagaaagcccgcgacgctctcgataacctggccgtgcttcacactgcagaagtaggtggcagggcttacaatcacgccctgtcggagctcccggagacgttggaaaccctgctactgctcacacttctggcaactgtgaccgggggaatctttttattcttgatgtctggcaagggtattgggaagatgacactgggcatgtgctgcatcataaccgcctccattctcctgtggtatgctcagatccagccccattggatcgcggccagcattatccttgagtttttcctgatagttctcttgattccagaacctgagaaacaacggactccccaggacaaccagctgacgtacgtcgtgatcgcaattttaaccgtggtcgctgccacaatggccaatgaaatgggatttctagagaagactaaaaaggacctgggcctcgggtcaatcaccacacaggagagtgaatctaacatacttgatatcgacctgcgtccagcatccgcttggaccttgtatgccgttgcgactacattcgtgacgcctatgctgagacacagcattgagaattcaagtgtaaacgtgagcctcaccgctatcgccaatcaagcaactgtcctgatgggacttggtaggggctggcccctctccaaaatggatattggggtgccgctgttggccatcggatgttactctcaggttaacccaattacactgaccgctgcattactactgctcgtggcccattacgcgatcataggccctggtcttcaggctaaggccacccgcgaagcacagaagcggacagccgctgggattatgaaaaatcccactgtcgacggcatcacggtaatcgatctggagccaattccctatgaccctaagtttgaaaaacaattgggacaggtgatgctgctcgttctgtgcgtgacccaggtccttatgatgcgaacaacttgggccttatgtgaggcactgaccctcgctacaggcccgataagcaccttgtgggaggggaaccccggaagattctggaatactacgatcgccgtgtccatggcgaacatttttaggggctcatacctggccggtgcagggctactgttctctatcatgaagaatacaaccaacactcgccggggaaccggcaatattggtgaaacactcggcgagaaatggaagagtagacttaacgctctggggaagtcggaatttcagatctataaaaagagcggaatacaagaggtcgatcgtactttggccaaagagggcatcaagaggggggaaaccgaccaccatgcagtgtcccggggatctgctaaactgcgctggttcgttgagcgaaacatggtgacaccagaaggcaaggtagtggatctcggttgcgggagaggaggctggtcatactattgtggtggcctgaaaaatgtcagggaggttaaggggttaacgaagggaggccctgggcacgaagagcccattcctatgagcacctacggatggaaccttgtgcggctgcagtccggcgtcgacgtgttctttactccacccgagaaatgcgatacactcctatgtgacatcggtgaaagttctcctaatccaaccattgaggccgggcgcactctgagagtattgaacctggtggaaaattggctcaacaataacacacagttctgcgttaaggtgcttaatccctatatgccgagcgtcatcgagaaaatggaaaccctgcaaaggaagtacggaggcgccttggtgcgaaaccctctgtcacggaattccacgcacgagatgtactgggtcagtaacgcgaccggcaatatagtgagctctgttaacatgatttcccgtatgctcatcaatagatttacaatgaaacataagaaggctacttatgagccagatgtagacttagggtcaggaacccgcaacatcggtattgaaaacgagatacccaatctggacatcattggcaaaaggatcgaaaagattaaacaggagcacgaaacaagctggcattacgatcaggaccacccttataagacttgggcataccacgggtcgtatgagaccaaacagacaggatctgccagttccatggtgaacggcgtcgtgaagcttctgaccaagccatgggatgttgtgcccatggtcactcaaatggctatgacggacacaaccccgttcggtcagcagcgggtgtttaaagagaaggtagatactagaacccaggaacctaaagaggggacaaagaaactaatgcgcatcacggccgaatggctctggaaggagctgggaaagaaaaagacccccaggatgtgtactcgagaggaattcacacggaaagtgagaagcaatgcagccttgggcgctatatttaccgacgagaacaagtggaaatcagcgagggaagccgttgaggattcccgcttctgggaactggtcgaccgtgagcggaatctccatcttgagggcaagtgcgaaacttgtgtgtacaacatgatggggaaaagagagaagaagctgggagaatttggtaaagcaaagggctctagggctatctggtatatgtggttaggggcccgcttcctggagtttgaagcattgggattcctcaatgaggatcactggtttagccgaggcaacagtctgtccggtgtggagggggaaggactacataaacttggctacattctgcgggacgtcagcaagaaagagggcgggacaatgtacgccgatgacaccgctggatgggacacaagaatcactctcgaagatctgaagaatgaggaaatggttaccaaccacatgaagggtgagcataaaaagttggccgaggcgattttcaaactgacgtatcaaaataaggtggtaagggtgcagcgcccaacccctagaggcacagtcatggacatcatttctcggaaagatcagagggggtcaggacaggtgggcacttacggtctcaacaccttcacaaatatggaagcacaacttatacgtcagatggagggggaaggaatctttaagagtattcagcgactgactgttaccgaggagatcgccgtgcaaaactggttagctcgcgtcggcagagaacggctgtccaggatggccatcagcggcgacgattgcgtggtaaagcccttggacgatcgcttcgcatctgctctcacggccctgaatgacatggggaaagttagaaaggatattcagcagtgggagccatcgcggggatggaacgactggacacaggtgcccttttgctcacaccacttccatgaactagtcatgaaagatggtagggtgcttgtggtcccttgtcgaaaccaagacgagctgataggccgtgctagaatcagccagggggccggatggtccctcaaggaaaccgcatgcctgggcaaaagttatgcgcagatgtggactttgatgtactttcaccgccgggatttaaggctggccgctaatgccatttgttctgcagttccaagccattgggtgccgacatccagaaccacttggtcaatccacgctaagcacgagtggatgaccacagaggacatgctcgccgtatggaaccgcgtgtggattcaggaaaatccctggatggaggacaagacgcctgtcgaaagttgggaggaagtgccatatcttggtaaacgggaggatcaatggtgcgggtctctgatcggactaaccagcagggcaacttgggccaagaacatacagacagcgatcaatcaggttcgatccctgattggcaacgaggaatacaccgactatatgccctcaatgaaaagattccggaaggaggaagaggaagctggcgtgctctggtga

SEQ ID NO: 14691 - RNA, 9876 nt, synthetic construct
  misc_feature 1..9876: note = derived and/or modified CDS sequence (opt3) from DENV-2__EU781135__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgacaccgggtgtgtggtttcctggaagaataaagaattgaagtgcggaagcggcatcttcataactgataacgtccacacatggaccgagcagtacaagtttcagcccgaatctccatcaaaactcgctagtgccattcaaaaggcacatgaggaaggtatctgtggcattaggagcgtgactcggctggagaatttaatgtggaaacagatcacccccgagctgaaccacatactatccgaaaatgaggtgaagctcacaatcatgacgggggacattaaaggaatcatgcaggccggcaagcgctctctgagacctcagccaaccgaacttaaatattcgtggaagacttgggggaaggctaaaatgttgagcacagagtcccataaccaaaccttcctgattgatggaccggaaacagccgagtgccccaatactaacagggcatggaattcactcgaggtcgaagactacggctttggtgttttcagtaccaacatctggctgaagttacgtgagaaacaggacgtgttttgtgattctaagctgatgagcgcggctataaaagacaatcgggccgtgcacgcagatatggggtattggattgaatccgcccttaacgacacgtggaagatggagaaggcttcattcatcgagatcaaaagctgccactggcctaagtctcatacattgtggtccaatggagtactcgaaagtgagatgattatcccaaaaaacttcgccggccccgtcagccagcacaactaccgacctggttatcatacccagactgcaggcccatggcacctggggaagctagaaatggattttgacttctgtgagggaaccacagtggttgtgactgaagattgcggcaatagagggccctctctgaggaccacaacggcttccggaaaactcattaccgagtggtgctgtcgctcatgcactctgccgcctcttcggtacagaggcgaggacggttgttggtacgggatggaaataaggccattgaaggagaaggaagagaacctggtcaatagtttagtgacagccggacatggccaaatcgataactttagcctcggtgttctgggcatggcgcttttcctggaagagatgttgcgcacccgagtggggactaaacacgccattctcctggtagctgtctcgtttgtgacactaatcaccggaaatatgtccttccgggacctgggccgtgtgatggtcatggttggggcaacgatgactgatgacattggaatgggcgtgacctatctcgccctgcttgctgcctttaaggtaagacccacattcgcagcgggtttgctgttaaggaaactcacctctaaggagctgatgatggccactatcgggatagctcttctgagccagtcaacaatccctgaaaccattctagagctcacagatgccctggcattgggaatgatggtgctgaaaatcgtccgcaacatggaaaagtaccagttagctgtgactattatggccatcagttgcgttcccaatgcagtgatactccaaaacgcctggaaggtctcctgtaccattctggctgcggtgtctgttagcccacttctgttgacgtcctcacagcagaaagccgactggatccctctcgcactgacaatcaagggcctaaatcccaccgctatttttctgactacccttagccggacaagtaaaaagagatcttggccactcaacgaggccataatggccgtgggcatggtctccatcctggctagctcgttgctgaaaaatgacattccgatgactgggcctttagtagcaggaggtctcctgaccgtgtgctatgttcttacgggcaggtcagccgatctggaattggagcgagcggctgacgtgaagtgggaggatcaggccgaaatctctgggagttcccccattctcagcatcacaatatctgaggacggaagcatgtccatcaaaaacgaagaggaggaacacaccctgactattctaatccgcacaggcctgcttgtcatttcaggtgtgttcccagtaagtatccccataaccgcagccgcttggtacctctgggaggtgaagaagcaacgggcaggggtcctgtgggatgttcctagcccaccccctgtgggaaaagccgaattggaggacggcgcgtatagaattaagcagaggggcatctttgggtactctcagatcggagctggtgtgtataaagaaggcactttccatacaatgtggcacgtcacccgtggggccgtgttaatgcatcgcggaaagcggattgagccgtcctgggcagatgttaaaaaggacctgatctcatacggcggtgggtggaagctcgagggagaatggaaagagggcgaagaggtacaggtgctggcccttgaaccaggcaagaatcccagagctgtccaaacgaaacctgggctgtttaagactaacaccggaacaataggtgccgtgagtttggatttcagcccaggcacctccgggtctcccattgttgacaggaaaggaaaggtggtcggcctatacggtaatggggtggtaacacgatcgggagcatatgtcagcgctatcgcccagactgagaagtcaattgaggataaccctgaaatcgaggacgatatattccggaaaaagcgcctgaccattatggacctccacccgggcgcgggcaaaacgaagagatacctgcccgccatcgtgagggaagcaatcaaacgggggcttcgaacattaattctggctccaactagagttgtggccgctgagatggaagaggcactccgcggattgcctatcaggtatcagacccccgccattcgtgccgagcatacaggtcgggaaatagtcgacctgatgtgtcacgctacctttactatgagactcctgtccccagtgagggttcctaactacaatcttatcattatggatgaggcgcacttcaccgaccccgcaagtatcgccgctcgcggctatatctctacacgagtggaaatgggggaggccgcaggaatttttatgacggccactccaccgggcagcagagatcctttcccccagtccaacgctccaataatggacgaggaacgggagatccccgaaaggtcatggaattctggtcatgagtgggtcaccgattttaaggggaagacagtgtggttcgtacctagcattaaagcgggaaacgacatcgccgcatgcctgcgcaagaatggcaaaaaggtgattcaattgagtcgtaaaacctttgattccgaatacgttaagactagagctaacgactgggatttcgtcgtgacaaccgacatcagcgagatgggcgccaattttcgggcagagagggtgatagatccacgccgatgtatgaagcccgtcatcctaacggacggggaagagagagtaattctggccggacctatgccggtgactcactcttcagctgcccagcggaggggtcgcatcggcagaaacccaaaaaatgaaaacgaccagtatatttacatgggggagcccctcgaaaatgatgaggactgcgcgcattggaaggaggcaaaaatgttactggataacatcaatacacctgaaggaataattccctccatgttcgagccagaaagggagaaggttgacgccatcgatggcgaataccggcttcgtggtgaggctcgcaaaacctttgtggacctgatgcgaagaggggatctccctgtctggttggcctatagggtggctgcagagggcattaactacgccgaccggcgctggtgtttcgatggaatcaagaataaccaaatactggaagagaacgttgaagtggagatctggaccaaagagggcgaaagaaagaagctcaaacccaggtggctggacgctcggatttatagtgatccacttgccctaaaggagttcaaagaatttgcagcggggcgaaagagcctgactttgaatttaatcacagagatgggaagactgcctaccttcatgacacagaaagcccgcgacgctctcgataacctggccgtccttcacactgcagaagtgggtggcagggcttacaatcacgccctgtcggagctcccggagacgttggaaaccctgctactgctcacacttctggcaactgtaaccgggggaatttttttattcttgatgtctggcaagggtatcgggaagatgacactgggcatgtgctgcataattaccgcctccatcctcctgtggtatgctcagatccagccccattggattgcggccagcatcatacttgagtttttcctgattgtgctcttgatcccagaacctgagaaacaacggactccccaggacaaccagctgacgtacgttgtcattgcaatcttaaccgtggtggctgccacaatggccaatgaaatgggatttctagagaagactaaaaaggacctgggcctcgggtcaataaccacacaggagagtgaatctaacatccttgatattgacctgcgtccagcatccgcttggaccttgtatgccgtcgcgactacattcgttacgcctatgctgagacacagcatcgagaattcaagtgtgaacgtaagcctcaccgctattgccaatcaagcaactgtgctgatgggacttggtaggggctggcccctctccaaaatggatatcggggtcccgctgttggccattggatgttactctcaggtgaacccaatcacactgaccgctgcattactactgctcgttgcccattacgcgataattggccctggtcttcaggctaaggccacccgcgaagcacagaagcggacagccgctgggatcatgaaaaatcccactgtggacggcatcacggtcattgatctggagccaataccctatgaccctaagtttgaaaaacaattgggacaggtaatgctgctcgtgctgtgcgttacccaggtgcttatgatgcgaacaacttgggccttatgtgaggcactgaccctcgctacaggcccgatcagcaccttgtgggaggggaaccccggaagattctggaatactacgattgccgtctccatggcgaacatctttaggggctcatacctggccggtgcagggctactgttctctattatgaagaatacaaccaacactcgccggggaaccggcaatatcggtgaaacactcggcgagaaatggaagagtagacttaacgctctggggaagtcggaatttcagatatataaaaagagcggaatccaagaggtggatcgtactttggccaaagagggcattaagaggggggaaaccgaccaccatgcagtctcccggggatctgctaaactgcgctggttcgtggagcgaaacatggttacaccagaaggcaaggtggtagatctcggttgcgggagaggaggctggtcatactattgtggtggcctgaaaaatgtgagggaggtcaaggggttaacgaagggaggccctgggcacgaagagcccatccctatgagcacctacggatggaaccttgttcggctgcagtccggcgtggacgtcttctttactccacccgagaaatgcgatacactcctatgtgacattggtgaaagttctcctaatccaaccatcgaggccgggcgcactctgagagtgttgaacctggtagaaaattggctcaacaataacacacagttctgcgtgaaggttcttaatccctatatgccgagcgtgatagagaaaatggaaaccctgcaaaggaagtacggaggcgccttggtccgaaaccctctgtcacggaattccacgcacgagatgtactgggtgagtaacgcgaccggcaatattgtcagctctgtgaacatgatctcccgtatgctcatcaatagatttacaatgaaacataagaaggctacttatgagccagatgttgacttagggtcaggaacccgcaacattggtatagaaaacgagatccccaatctggacattatcggcaaaaggattgaaaagatcaaacaggagcacgaaacaagctggcattacgatcaggaccacccttataagacttgggcataccacgggtcgtatgagaccaaacagacaggatctgccagttccatggtaaacggcgtggtcaagcttctgaccaagccatgggatgtggttcccatggtgactcaaatggctatgacggacacaaccccgttcggtcagcagcgggtctttaaagagaaggtggatactagaacccaggaacctaaagaggggacaaagaaactaatgcgcataacggccgaatggctctggaaggagctgggaaagaaaaagacccccaggatgtgtactcgagaggaattcacacggaaagtaagaagcaatgcagccttgggcgctatctttaccgacgagaacaagtggaaatcagcgagggaagccgtggaggattcccgcttctgggaactggttgaccgtgagcggaatctccatcttgagggcaagtgcgaaacttgtgtctacaacatgatggggaaaagagagaagaagctgggagaatttggtaaagcaaagggctctagggctatttggtatatgtggttaggggcccgcttcctggagtttgaagcattgggattcctcaatgaggatcactggtttagccgaggcaacagtctgtccggtgtggagggggaaggactacataaacttggctacatcctgcgggacgtgagcaagaaagagggcggggccatgtacgctgatgacacagccggatgggacaccagaattacactcgaagatctgaagaatgaggaaatggtcactaaccacatgaagggtgagcataaaaagttggcggaggcaatcttcaaactgacctatcaaaataaggttgtgagggtacagcgcccaacgcctagaggcaccgtgatggacattatatctcggaaagatcagagggggtcaggacaggtcggcacatacggtctcaacactttcaccaatatggaagcccaacttatccgtcagatggagggggaaggaatttttaagagtatccagcgactgacagtgactgaggagatcgctgttcaaaactggttagcccgcgtgggcagagaacggctgtccaggatggcaattagcggcgacgattgcgtcgtgaagcccttggacgatcgcttcgcttctgccctcaccgctctgaatgacatggggaaagtaagaaaggatatacagcagtgggagccatcgcggggatggaacgactggacgcaggttcccttttgctcacaccacttccatgaactagtgatgaaagatggtagggtccttgtggtgccttgtcgaaaccaagacgagctgatcggccgtgccagaattagccagggggcaggatggtccctcaaggaaacagcgtgcctgggcaaaagttatgcccagatgtggaccttgatgtactttcaccgccgggatttaaggctggctgccaatgcaatctgttctgctgtcccaagccattgggttccgacttccagaacaacctggtcaattcacgccaagcacgagtggatgactaccgaggacatgctcgcagtgtggaaccgcgtatggatccaggaaaatccctggatggaggacaagacacctgtggaaagttgggaggaagtcccatatcttggtaaacgggaggatcaatggtgcgggtctctgataggactaacgagcagggccacctgggcgaagaacatccagactgctattaatcaggtgcgatccctgatcggcaacgaggaatacacagactatatgccctcaatgaaaagattccggaaggaggaagaggaagccggcgttctctggtga

SEQ ID NO: 14692 - RNA, 9876 nt, synthetic construct
  misc_feature 1..9876: note = derived and/or modified CDS sequence (opt3) from DENV-2__EU687222__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgagatcaaatcttgccactggcctaagtcccatacgttgtggagtaatggagtactcgaaagcgagatgattatcccaaaaaacttcgccggccccgtctctcagcacaactaccgacctggttatcatacacagaccgcaggcccatggcacctggggaagctagaaatggattttgacttctgtgagggaactaccgtggttgtgacagaagattgcggcaatagagggccctccctgaggactaccacagcttcaggaaaactcattacggagtggtgctgtcgcagttgcaccctgccgcctcttcggtacagaggcgaggacggttgttggtacgggatggaaataaggccattgaaggagaaggaagagaacctggtcaatagcttagtgactgccggacatggccaaatcgataacttttcgctcggtgttctgggcatggcgcttttcctggaagagatgttgcgcacacgagtggggaccaaacacgccattctcctggtagctgtctcctttgtgactctaatcacaggaaatatgtctttccgggacctgggccgtgtgatggtcatggttggggcaaccatgacggatgacattggaatgggcgtgacttatctcgccctgcttgctgcctttaaggtaagacccaccttcgcagcgggtttgctgttaaggaaactcacaagcaaggagctgatgatggccaccatcgggatagctcttctgtcacagagtactatccctgaaacaattctagagctcaccgatgccctggcattgggaatgatggtgctgaaaatcgtccgcaacatggaaaagtaccagttagctgtgacaattatggccatctcctgcgttcccaatgcagtgatactccaaaacgcctggaaggtctcttgtactattctggctgcggtgagcgtttccccacttctgttgacctcaagccagcagaaagccgactggatccctctcgcactgacgatcaagggcctaaatcccacagctatttttctgaccactcttagtcggacctctaaaaagagatcctggccactcaacgaggccgtgatggccgtcggcatggtaagcatactggcttcgtcattgctgaaaaatgacatcccgatgacagggcctttagtggcaggaggtctcctgactgtttgctatgtgcttaccggcaggtctgccgatctggaattggagcgagcggctgacgtcaagtgggaggatcaggccgaaattagtgggtccagccccatcctctctattacgatcagcgaggacggatccatgtcaataaaaaacgaagaggaggaacacacactgaccatcctaattcgcactggcctgcttgtgatcagtggtgtattcccagtgagcattcccatcacagcagccgcttggtacctctgggaggtcaagaagcaacgggcaggggttctgtgggatgtgccttctccaccccctgtgggaaaagccgaattggaggacggcgcgtatagaataaagcagaggggcatttttgggtactcccagatcggagctggtgtctataaagaaggcaccttccatactatgtggcacgtgacacgtggggccgttttaatgcatcgcggaaagcggatcgagccgtcatgggcagatgtaaaaaaggacctgattagttacggcggtgggtggaagctcgagggagaatggaaagagggcgaagaggtgcaggtcctggcccttgaaccaggcaagaatcccagagctgtgcaaaccaaacctgggctgtttaagacgaacactggaaccatcggtgccgttagcttggatttctccccaggcacatctgggtcgcccatagtggacaggaaaggaaaggtcgtgggcctatacggtaatggggtagtcacccgaagcggagcatatgtgtcagctattgcccagacagagaagtccatcgaggataaccctgaaattgaggacgatatcttccggaaaaagcgcctgactataatggacctccacccgggcgcgggcaaaaccaagagatacctgcccgccattgttagggaagcaatcaaacgggggcttcgaacgttaatcctggctccaacaagagtggtcgccgctgagatggaagaggcactccgcggattgcctattaggtatcagactcccgccatccgtgccgagcataccggtcgggaaattgtggacctgatgtgtcacgctacatttaccatgagactcctgagtccagttagggtgcctaactacaatcttataatcatggatgaggcgcacttcactgaccccgcatctattgccgctcgcggctatatcagcacccgagtcgaaatgggggaggccgcaggaatctttatgacagccacgccaccgggctccagagatcctttcccccagtcaaacgctccaattatggacgaggaacgggagatacccgaaaggtcttggaatagcggtcatgagtgggtgactgattttaaggggaagaccgtatggttcgtgcctagtatcaaagcgggaaacgacattgccgcatgcctgcgcaagaatggcaaaaaggttatccaattgtcccgtaaaacatttgatagcgaatacgtcaagaccagagctaacgactgggatttcgtggtgactacagacatttctgagatgggcgccaattttcgggcagagagggtcatcgatccacgccgatgtatgaagcccgtaatactaaccgacggggaagagagagtgatcctggccggacctatgccggttacgcactcatccgctgcccagcggaggggtcgcattggcagaaacccaaaaaatgaaaacgaccagtatatctacatgggggagcccctcgaaaatgatgaggactgcgcgcattggaaggaggcaaaaatgttactggataacattaatactcctgaaggaatcatacccagtatgttcgagccagaaagggagaaggtggacgccattgatggcgaataccggcttcgtggtgaggctcgcaaaacatttgtcgacctgatgcgaagaggggatctccctgtgtggttggcctatagggttgctgcagagggcatcaactacgccgaccggcgctggtgtttcgatggaattaagaataaccaaatcctggaagagaacgtggaagtcgagatatggaccaaagagggcgaaagaaagaagctcaaacccaggtggctggacgctcggatctatagcgatccacttgccctaaaggagttcaaagaatttgcagcggggcgaaagtcgctgaccttgaatttaattactgagatgggaagactgcctacattcatgacccagaaagcccgcgacgctctcgataacctggccgtgcttcacacagcagaagtaggtggcagggcttacaatcacgccctgtctgagctcccggagactttggaaacgctgctactgctcacccttctggcaacagtgactgggggaatctttttattcttgatgtccggcaagggtattgggaagatgaccctgggcatgtgctgcatcataacagccagcattctcctgtggtatgctcagatccagccccattggatcgcggcctcaattatccttgagtttttcctgatagttctcttgattccagaacctgagaaacaacggaccccccaggacaaccagctgacttacgtcgtgatcgcaattttaacggtggtcgctgccaccatggccaatgaaatgggatttctagagaagacaaaaaaggacctgggcctcgggagtatcactacccaggagtctgaatccaacatacttgatatcgacctgcgtccagcaagcgcttggacattgtatgccgttgcgaccactttcgtgacacctatgctgagacactcaattgagaatagtagcgtaaacgtgtccctcacggctatcgccaatcaagcaaccgtcctgatgggacttggtaggggctggcccctctctaaaatggatattggggtgccgctgttggccatcggatgttacagccaggttaacccaattactctgacagctgcattactactgctcgtggcccattacgcgatcataggccctggtcttcaggctaaggccacccgcgaagcacagaagcggaccgccgctgggattatgaaaaatcccacagtcgacggcatcactgtaatcgatctggagccaattccctatgaccctaagtttgaaaaacaattgggacaggtgatgctgctcgttctgtgcgtgacgcaggtccttatgatgcgaaccacatgggccttatgtgaggcactgactctcgctaccggcccgatatccacattgtgggaggggaaccccggaagattctggaataccactatcgccgtgtcaatggcgaacatttttaggggctcttacctggccggtgcagggctactgttcagtatcatgaagaatacgacaaacacccgccggggaactggcaatattggtgaaaccctcggcgagaaatggaagtcgagacttaacgctctggggaagagcgaatttcagatctataaaaagtccggaatacaagaggtcgatcgtacattggccaaagagggcatcaagaggggggaaactgaccaccatgcagtgtctcggggatcagctaaactgcgctggttcgttgagcgaaacatggtgaccccagaaggcaaggtagtggatctcggttgcgggagaggaggctggagctactattgtggtggcctgaaaaatgtcagggaggttaaggggttaacaaagggaggccctgggcacgaagagcccattcctatgtccacgtacggatggaaccttgtgcggctgcagagtggcgtcgacgtgttctttaccccacccgagaaatgcgatactctcctatgtgacatcggtgaatctagccctaatccaacaattgaggccgggcgcaccctgagagtattgaacctggtggaaaattggctcaacaataacactcagttctgcatcaaggttcttaatccctatatgccgtcagtgatagagaaaatggaaacactgcaaaggaagtacggaggcgccttggtccgaaaccctctgtcccggaatagtacccacgagatgtactgggtgagcaacgcgacgggcaatattgtctcttccgtgaacatgatctcacgtatgctcatcaatagatttaccatgaaacataagaaggctacatatgagccagatgttgacttagggagcggaactcgcaacattggtatagaaaacgagatccccaatctggacattatcggcaaaaggattgaaaagatcaaacaggagcacgaaacctcgtggcattacgatcaggaccacccttataagacatgggcataccacgggtcttatgagactaaacagaccggaagtgcctccagcatggtaaacggcgtggtcaagcttctgacaaagccatgggatgtggttcccatggtgacccaaatggctatgactgacacgacaccgttcggtcagcagcgggtctttaaagagaaggtggataccagaactcaggaacctaaagaggggaccaagaaactaatgcgcataacagccgaatggctctggaaggagctgggaaagaaaaagacgcccaggatgtgtacccgagaggaattcactcggaaagtaagatcaaatgcagccttgggcgctatctttacagacgagaacaagtggaaatccgcgagggaagccgtggaggattctcgcttctgggaactggttgaccgtgagcggaatctccatcttgagggcaagtgcgaaacctgtgtctacaacatgatggggaaaagagagaagaagctgggagaatttggtaaagcaaagggcagcagggctatttggtatatgtggttaggggcccgcttcctggagtttgaagcattgggattcctcaatgaggatcactggtttagtcgaggcaactccctgagcggtgtggagggggaaggactacataaacttggctacatcctgcgggacgtgtctaagaaagagggcggggccatgtacgctgatgacactgccggatgggacacaagaattaccctcgaagatctgaagaatgaggaaatggtcacaaaccacatgaagggtgagcataaaaagttggcggaggcaatcttcaaactgacttatcaaaataaggttgtgagggtacagcgcccaacccctagaggcacggtgatggacattatatcacggaaagatcagagggggagtggacaggtcggcacctacggtctcaacacattcactaatatggaagcccaacttatccgtcagatggagggggaaggaatttttaagtccatccagcgactgaccgtgacagaggagatcgctgttcaaaactggttagcccgcgtgggcagagaacggctgagcaggatggcaatttctggcgacgattgcgtcgtgaagcccttggacgatcgcttcgcttcggccctcactgctctgaatgacatggggaaagtaagaaaggatatacagcagtgggagccatcacggggatggaacgactggacccaggttcccttttgcagccaccacttccatgaactagtgatgaaagatggtagggtccttgtggtgccttgtcgaaaccaagacgagctgatcggccgtgccagaatttcccagggggcaggatggagtctcaaggaaacggcgtgcctgggcaaatcttatgcccagatgtggacattgatgtactttcaccgccgggatttaaggctggctgccaatgcaatctgtagcgctgtcccatcccattgggttccgacctcaagaactacatggagtattcacgccaagcacgagtggatgaccactgaggacatgctcgcagtgtggaaccgcgtatggatccaggaaaatccctggatggaggacaagacccctgtggaatcttgggaggaagtcccatatcttggtaaacgggaggatcaatggtgcgggagcctgataggactaacatccagggccacgtgggcgaagaacatccagaccgctattaatcaggtgcgatcactgatcggcaacgaggaatacactgactatatgcccagcatgaaaagattccggaaggaggaagaggaagccggcgttctctggtga

SEQ ID NO: 14693 - RNA, 9876 nt, synthetic construct
  misc_feature 1..9876: note = derived and/or modified CDS sequence (opt3) from DENV-2__EU687223__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccggaaaggactcccctgtgaacatcgaagccgagcccccatttggcgatagctacattataatcggggtcgaacctggacagctgaaactaaattggttcaagaagggttcgtctattggccagatgtttgagacaactatgcgaggggctaaacgcatggccatcctcggagacaccgcatgggatttcggctccctgggtggggtgtttacatcaattggcaaggcccttcaccaagttttcggagctatctacggcgcggcatttagtggggtgagctggactatgaaaatattgatcggagtaattatcacctggattggcatgaactccagatctacgagcctgtcagtcagtctcgtgctggttggtgtggtcacactttatctgggggtgatggtacaggccgactccggatgtgtggttagctggaagaataaagagttgaagtgcggctctggtatcttcataaccgataacgtccacacttggacagaacagtacaagtttcagcccgagtcaccaagtaaactcgctagcgccattcaaaaggcacatgaagagggcatctgtgggattaggtccgtgacccggctggaaaatttaatgtggaaacagatcactcccgagctgaaccacatactatctgagaatgaagtgaagctcaccatcatgacaggagacattaaaggcatcatgcaggccgggaagcgctcgctgagacctcagccaacggagcttaaatatagctggaagacctggggaaaggctaaaatgttgtccactgaatcacataaccaaacattcctgattgatggcccggagaccgccgaatgccccaatacaaacagggcatggaatagtctcgaggtcgaggactacggttttggggttttctctactaacatctggctgaagttacgtgaaaaacaggacgtgttttgtgatagcaagctgatgtccgcggctataaaagacaatcgggccgtgcacgcagatatgggatattggattgagtcagcccttaacgacacctggaagatggaaaaggctagcttcatcgagatcaaatcttgccactggcctaagtcccatacgttgtggagtaatggcgtactcgagagcgaaatgattatcccaaaaaacttcgccggtcccgtctctcagcacaactaccgacctggctatcatacacagaccgcagggccatggcacctgggaaagctagagatggattttgacttctgtgaaggcactaccgtggttgtgacagaggattgcgggaatagaggaccctccctgaggactaccacagcttcaggcaaactcattacggaatggtgctgtcgcagttgcaccctgccgcctcttcggtacagaggtgaggacgggtgttggtacggaatggagataaggccattgaaggaaaaggaggaaaacctggtcaatagcttagtgactgccggccatggtcaaatcgataacttttcgctcggcgttctggggatggcgcttttcctggaggaaatgttgcgcacacgagtgggaaccaaacacgccattctcctggtagctgtctcctttgtgactctaatcacaggcaatatgtctttccgggacctggggcgtgtgatggtcatggttggagcaaccatgacggatgacattggcatgggtgtgacttatctcgccctgcttgctgcctttaaggtaagacccaccttcgcagcggggttgctgttaaggaaactcacaagcaaggagctgatgatggccaccatcggaatagctcttctgtcacagagtactatccctgagacaattctagaactcaccgatgccctggcattgggcatgatggtgctgaaaatcgtccgcaacatggagaagtaccagttagctgtgacaattatggccatctcctgcgttcccaatgcagtgatactccaaaacgcctggaaggtctcttgtactattctggctgcggtgagcgtttccccacttctgttgacctcaagccagcagaaagccgactggatccctctcgcactgacgatcaagggcctaaatcccacagctatttttctgaccactcttagtcggacctctaaaaagagatcctggccactcaacgaagccgtgatggccgtcgggatggtaagcatactggcttcgtcattgctgaaaaatgacatcccgatgacaggacctttagtggcaggtggcctcctgactgtttgctatgtgcttaccgggaggtctgccgatctggagttggaacgagcggctgacgtcaagtgggaggatcaggccgagattagtggatccagccccatcctctctattacgatcagcgaagacggctccatgtcaataaaaaacgaggaagaggagcacacactgaccatcctaattcgcactggtctgcttgtgatcagtggggcattcccagtaagcattcccatcacagccgctgcatggtacctctgggaagtgaagaagcaacgggccggagtcctgtgggatgttccttctccaccccctgtgggcaaagcggagttggaagacggcgcttatagaataaagcagagggggatttttggatactcccagatcggtgccggcgtgtataaagaggggaccttccatactatgtggcacgtcacacgtggagcagtgttaatgcatcgcggcaagcggatcgaaccgtcatgggccgatgttaaaaaggacctgattagttacggtgggggatggaagctcgagggcgagtggaaagaaggcgaggaagtacaggtgctggctcttgagccagggaagaatcccagagccgtccaaaccaaacctggactgtttaagacgaacactggtaccatcggcgcagtgagcttggatttctccccagggacatctggatcgcccatagttgacaggaaaggcaaggtggtcggtctatacgggaatggagtggtaacccgaagcggcgcttatgtctcagccattgcgcagacagaaaagtccatcgaggataaccctgagattgaagacgatatcttccggaaaaagcgcctgactataatggacctccacccgggcgccgggaaaaccaagagatacctgcccgcaattgtgagggaggctatcaaacggggacttcgaacgttaatcctggccccaacaagagttgtggctgcagaaatggaggaagccctccgcggtttgcctattaggtatcagactcccgccatccgtgctgagcataccggccgggagattgtcgacctgatgtgtcacgcgacatttaccatgagactcctgagtccagtgagggttcctaactacaatcttataatcatggatgaagcacacttcactgaccccgcctctattgctgcccgcgggtatatcagcacccgagtggagatgggagaagcagccggcatctttatgacagctacgccaccgggttccagagatcctttcccccagtcaaacgcgccaattatggacgaggagcgggaaatacccgagaggtcttggaatagcgggcatgaatgggtcactgattttaagggaaagaccgtgtggttcgtacctagtatcaaagccggcaacgacattgcagcttgcctgcgcaagaatggcaaaaaggtgatccaattgtcccgtaaaacatttgatagcgagtacgttaagaccagagccaacgactgggatttcgtcgtgactacagacatttctgaaatgggggcaaattttcgggccgagagggtgatcgatccacgccgatgtatgaagcccgtcatactaaccgacggagaggaaagagtaatcctggctggtcctatgccggtgacgcactcatccgccgcgcagcggaggggccgcattgggagaaacccaaaaaatgagaacgaccagtatatctacatgggagaacccctcgagaatgatgaagactgcgcacattggaaggaggccaaaatgttactggataacattaatactcctgagggcatcatacccagtatgttcgaaccagagagggaaaaggttgacgctattgatggtgagtaccggcttcgtggggaagcccgcaaaacatttgtggacctgatgcgaagaggcgatctccctgtctggttggcttatagggtggcagccgagggaatcaactacgctgaccggcgctggtgtttcgatggcattaagaataaccaaatcctggaggaaaacgttgaggtggaaatatggaccaaagagggggagagaaagaagctcaaacccaggtggctggacgcccggatctatagcgatccacttgcactaaaggaattcaaagagtttgcggccggacgaaagtcgctgaccttgaatttaattactgaaatgggtagactgcctacattcatgacccagaaagctcgcgacgccctcgataacctggcagtccttcacacagctgaggtgggcgggagggcctacaatcacgcactgtctgaactcccggagactttggagacgctgctactgctcacccttctggccacagtaactggaggcatctttttattcttgatgtccggtaaggggattggcaagatgaccctgggaatgtgctgcatcataacagctagcattctcctgtggtatgcgcagatccagccccattggatcgccgcatcaattatccttgaatttttcctgatagtgctcttgattccagagcctgaaaaacaacggaccccccaggacaaccagctgacttacgttgtcatcgctattttaacggtggtggccgccaccatggcaaatgagatgggctttctagaaaagacaaaaaaggacctggggctcggaagtatcactacccaggagtctgagtccaacatacttgatatcgacctgcgtccagctagcgcctggacattgtatgcggtcgctaccactttcgttacacctatgctgagacactcaattgaaaatagtagcgtgaacgtatccctcacggccatcgcaaatcaagccaccgtgctgatgggtcttggcagggggtggcccctctctaaaatggatattggagtcccgctgttggctatcggctgttacagccaggtgaacccaattactctgacagcagccttactactgctcgttgcgcattacgctatcataggtcctgggcttcaggccaaggcaacccgcgaggcccagaagcggaccgctgccggcattatgaaaaatcccacagtggacggaatcactgtcatcgatctggaaccaattccctatgaccctaagtttgagaaacaattgggccaggtaatgctgctcgtgctgtgcgttacgcaggtgcttatgatgcgaaccacatgggcattatgtgaagctctgactctcgccaccgggccgatatccacattgtgggagggaaaccccggcagattctggaataccactatcgcggtctcaatggccaacatttttaggggttcttacctggcaggggctggactactgttcagtatcatgaagaatacgacaaacacccgccggggcactggtaatattggcgagaccctcggggaaaaatggaagtcgagacttaacgccctgggaaagagcgagtttcagatctataaaaagtccggcatacaagaagtggatcgtacattggcaaaagaggggatcaagaggggagagactgaccaccatgctgtctctcggggctcagccaaactgcgctggttcgtggaacgaaacatggttaccccagagggtaaggtggtagatctcgggtgcggaagaggcggttggagctactattgtggcgggctgaaaaatgtgagggaagtcaagggattaacaaagggcgggcctggacacgaggaacccattcctatgtccacgtacggctggaaccttgttcggctgcagagtggtgtggacgtcttctttaccccacccgagaaatgcgatactctcctatgtgacatcggggagtctagccctaatccaacaattgaagccggacgcaccctgagagtgttgaacctggtagagaattggctcaacaataacactcagttctgcatcaaggtgcttaatccctatatgccgtcagttatagaaaaaatggagacactgcaaaggaagtacggcggcgcgttggtgcgaaaccctctgtcccggaatagtacccacgaaatgtactgggtcagcaacgctacggggaatattgtgtcttccgtcaacatgatctcacgtatgctcatcaatagatttaccatgaaacataagaaggcaacatatgagccagatgtggacttaggaagcggtactcgcaacattggcatagagaacgaaatccccaatctggacattatcgggaaaaggattgagaagatcaaacaggaacacgagacctcgtggcattacgatcaggaccacccttataagacatgggcctaccacggatcttatgaaactaaacagaccggcagtgcttccagcatggttaacggtgtagtgaagcttctgacaaagccatgggatgtcgtgcccatggttacccaaatggccatgactgacacgacaccgttcgggcagcagcgggtgtttaaagagaaggtcgataccagaactcaggagcctaaagaaggaaccaagaaactaatgcgcataacagcagagtggctctggaaggaactgggcaagaaaaagacgcccaggatgtgtacccgagaggagttcactcggaaagtgagatcaaatgccgctttgggcgcgatctttacagacgaaaacaagtggaaatccgccagggaggcagtagaagattctcgcttctgggagctggtggaccgtgaacggaatctccatcttgaggggaagtgcgagacctgtgtttacaacatgatgggaaaaagagaaaagaagctgggtgagtttggcaaagctaaggggagcagggccatttggtatatgtggttaggagcacgcttcctggaatttgaggccttgggcttcctcaatgaagatcactggtttagtcgaggtaactccctgagcggggtcgagggagagggcctacataaacttggctacatcctgcgggacgtgtctaagaaagaagggggagctatgtacgccgatgacactgcgggttgggacacaagaattaccctcgaggatctgaagaatgaagagatggtgacaaaccacatgaagggcgaacataaaaagttggcagaggccatcttcaaactgacttatcaaaataaggtcgttagggtgcagcgcccaacccctagagggacggtaatggacattatatcacggaaagatcagaggggaagtggccaggtgggtacctacgggctcaacacattcactaatatggaggctcaacttatccgtcagatggaaggagagggcatttttaagtccatccagcgactgaccgtcacagaagagatcgccgtgcaaaactggttagcacgcgttggcagagagcggctgagcaggatggctatttctggggacgattgcgtggtcaagcccttggacgatcgcttcgcctcggctctcactgccctgaatgacatgggaaaagtgagaaaggatatacagcagtgggaaccatcacggggttggaacgactggacccaggtacccttttgcagccaccacttccatgagctagttatgaaagatggcagggtgcttgtcgtgccttgtcgaaaccaagacgaactgatcgggcgtgcaagaatttcccagggagcgggctggagtctcaaggagacggcctgcctgggtaaatcttatgctcagatgtggacattgatgtactttcaccgccgggatttaaggctggccgcaaatgctatctgtagcgccgtgccatcccattgggtcccgacctcaagaactacatggagtattcacgcaaagcacgaatggatgaccactgaggacatgctcgccgtttggaaccgcgtgtggatccaggagaatccctggatggaagacaagacccctgtagagtcttgggaagaggtgccatatcttgggaaacgggaagatcaatggtgcggaagcctgataggcctaacatccagggcgacgtgggctaagaacatccagaccgccattaatcaggtccgatcactgatcggcaacgaggagtacactgactatatgcccagcatgaaaagattccggaaggaagaggaagaggcaggggtgctctggtga

SEQ ID NO: 14694 - RNA, 9876 nt, synthetic construct
  misc_feature 1..9876: note = derived and/or modified CDS sequence (opt3) from DENV-2__EU687227__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgagatcaaatcttgccactggcctaagtcccatacgttgtggagtaatggagtactcgaaagcgagatgattatcccaaaaaacttcgccggccccgtctctcagcacaactaccgacctggttatcatacacagaccgcaggcccatggcacctggggaagctagaaatggattttgacttctgtgagggaactaccgtggttgtgacagaagattgcggcaatagagggccctccctgaggactaccacagcttcaggaaaactcattacggagtggtgctgtcgcagttgcaccctgccgcctcttcggtacagaggcgaggacggttgttggtacgggatggaaataaggccattgaaggagaaggaagagaacctggtcaatagcttagtgactgccggacatggccaaatcgataacttttcgctcggtgttctgggcatggcgcttttcctggaagagatgttgcgcacacgagtggggaccaaacacgccattctcctggtagctgtctcctttgtgactctaatcacaggaaatatgtctttccgggacctgggccgtgtgatggtcatggttggggcaaccatgacggatgacattggaatgggcgtgacttatctcgccctgcttgctgcctttaaggtaagacccaccttcgcagcgggtttgctgttaaggaaactcacaagcaaggagctgatgatggccaccatcgggatagctcttctgtcacagagtactatccctgaaacaattctagagctcaccgatgccctggcattgggaatgatggtgctgaaaatcgtccgcaacatggaaaagtaccagttagctgtgacaattatggccatctcctgcgttcccaatgcagtgatactccaaaacgcctggaaggtctcttgtactattctggctgcggtgagcgtttccccacttctgttgacctcaagccagcagaaagccgactggatccctctcgcactgacgatcaagggcctaaatcccacagctatttttctgaccactcttagtcggacctctaaaaagagatcctggccactcaacgaggccgtgatggccgtcggcatggtaagcatactggcttcgtcattgctgaaaaatgacatcccgatgacagggcctttagtggcaggaggtctcctgactgtttgctatgtgcttaccggcaggtctgccgatctggaattggagcgagcggctgacgtcaagtgggaggatcaggccgaaattagtgggtccagccccatcctctctattacgatcagcgaggacggatccatgtcaataaaaaacgaagaggaggaacacacactgaccatcctaattcgcactggcctgcttgtgatcagtggtgtattcccagtgagcattcccatcacagcagccgcttggtacctctgggaggtcaagaagcaacgggcaggggttctgtgggatgtgccttctccaccccctgtgggaaaagccgaattggaggacggcgcgtatagaataaagcagaggggcatttttgggtactcccagatcggagctggtgtctataaagaaggcaccttccatactatgtggcacgtgacacgtggggccgttttaatgcatcgcggaaagcggatcgagccgtcatgggcagatgtaaaaaaggacctgattagttacggcggtgggtggaagctcgagggagaatggaaagagggcgaagaggtgcaggtcctggcccttgaaccaggcaagaatcccagagctgtgcaaaccaaacctgggctgtttaagacgaacactggaaccatcggtgccgttagcttggatttctccccaggcacatctgggtcgcccatagtggacaggaaaggaaaggtcgtgggcctatacggtaatggggtagtcacccgaagcggagcatatgtgtcagctattgcccagacagagaagtccatcgaggataaccctgaaattgaggacgatatcttccggaaaaagcgcctgactataatggacctccacccgggcgcgggcaaaaccaagagatacctgcccgccattgttagggaagcaatcaaacgggggcttcgaacgttaatcctggctccaacaagagtggtcgccgctgagatggaagaggcactccgcggattgcctattaggtatcagactcccgccatccgtgccgagcataccggtcgggaaattgtggacctgatgtgtcacgctacatttaccatgagactcctgagtccagttagggtgcctaactacaatcttataatcatggatgaggcgcacttcactgaccccgcatctattgccgctcgcggctatatcagcacccgagtcgaaatgggggaggccgcaggaatctttatgacagccacgccaccgggctccagagatcctttcccccagtcaaacgctccaattatggacgaggaacgggagatacccgaaaggtcttggaatagcggtcatgagtgggtgactgattttaaggggaagaccgtatggttcgtgcctagtatcaaagcgggaaacgacattgccgcatgcctgcgcaagaatggcaaaaaggttatccaattgtcccgtaaaacatttgatagcgaatacgtcaagaccagagctaacgactgggatttcgtggtgactacagacatttctgagatgggcgccaattttcgggcagagagggtcatcgatccacgccgatgtatgaagcccgtaatactaaccgacggggaagagagagtgatcctggccggacctatgccggttacgcactcatccgctgcccagcggaggggtcgcattggcagaaacccaaaaaatgaaaacgaccagtatatctacatgggggagcccctcgaaaatgatgaggactgcgcgcattggaaggaggcaaaaatgttactggataacattaatactcctgaaggaatcatacccagtatgttcgagccagaaagggagaaggtggacgccattgatggcgaataccggcttcgtggtgaggctcgcaaaacatttgtcgacctgatgcgaagaggggatctccctgtgtggttggcctatagggttgctgcagagggcatcaactacgccgaccggcgctggtgtttcgatggaattaagaataaccaaatcctggaagagaacgtggaagtcgagatatggaccaaagagggcgaaagaaagaagctcaaacccaggtggctggacgctcggatctatagcgatccacttgccctaaaggagttcaaagaatttgcagcggggcgaaagtcgctgaccttgaatttaattactgagatgggaagactgcctacattcatgacccagaaagcccgcgacgctctcgataacctggccgtgcttcacacagcagaagtaggtggcagggcttacaatcacgccctgtctgagctcccggagactttggaaacgctgctactgctcacccttctggcaacagtgactgggggaatctttttattcttgatgtccggcaagggtattgggaagatgaccctgggcatgtgctgcatcataacagccagcattctcctgtggtatgctcagatccagccccattggatcgcggcctcaattatccttgagtttttcctgatagttctcttgattccagaacctgagaaacaacggaccccccaggacaaccagctgacttacgtcgtgatcgcaattttaacggtggtcgctgccaccatggccaatgaaatgggatttctagagaagacaaaaaaggacctgggcctcgggagtatcactacccaggagtctgaatccaacatacttgatatcgacctgcgtccagcaagcgcttggacattgtatgccgttgcgaccactttcgtgacacctatgctgagacactcaattgagaatagtagcgtaaacgtgtccctcacggctatcgccaatcaagcaaccgtcctgatgggacttggtaggggctggcccctctctaaaatggatattggggtgccgctgttggccatcggatgttacagccaggttaacccaattactctgacagctgcattactactgctcgtggcccattacgcgatcataggccctggtcttcaggctaaggccacccgcgaagcacagaagcggaccgccgctgggattatgaaaaatcccacagtcgacggcatcactgtaatcgatctggagccaattccctatgaccctaagtttgaaaaacaattgggacaggtgatgctgctcgttctgtgcgtgacgcaggtccttatgatgcgaaccacatgggccttatgtgaggcactgactctcgctaccggcccgatatccacattgtgggaggggaaccccggaagattctggaataccactatcgccgtgtcaatggcgaacatttttaggggctcttacctggccggtgcagggctactgttcagtatcatgaagaatacgacaaacacccgccggggaactggcaatattggtgaaaccctcggcgagaaatggaagtcgagacttaacgctctggggaagagcgaatttcagatctataaaaagtccggaatacaagaggtcgatcgtacattggccaaagagggcatcaagaggggggaaactgaccaccatgcagtgtctcggggatcagctaaactgcgctggttcgttgagcgaaacatggtgaccccagaaggcaaggtagtggatctcggttgcgggagaggaggctggagctactattgtggtggcctgaaaaatgtcagggaggttaaggggttaacaaagggaggccctgggcacgaagagcccattcctatgtccacgtacggatggaaccttgtgcggctgcagagtggcgtcgacgtgttctttaccccacccgagaaatgcgatactctcctatgtgacatcggtgaatctagccctaatccaacaattgaggccgggcgcaccctgagagtattgaacctggtggaaaattggctcaacaataacactcagttctgcatcaaggttcttaatccctatatgccgtcagtgatagagaaaatggaaacactgcaaaggaagtacggaggcgccttggtccgaaaccctctgtcccggaatagtacccacgagatgtactgggtgagcaacgcgacgggcaatattgtctcttccgtgaacatgatctcacgtatgctcatcaatagatttaccatgaaacataagaaggctacatatgagccagatgttgacttagggagcggaactcgcaacattggtatagaaaacgagatccccaatctggacattatcggcaaaaggattgaaaagatcaaacaggagcacgaaacctcgtggcattacgatcaggaccacccttataagacatgggcataccacgggtcttatgagactaaacagaccggaagtgcctccagcatggtaaacggcgtggtcaagcttctgacaaagccatgggatgtggttcccatggtgacccaaatggctatgactgacacgacaccgttcggtcagcagcgggtctttaaagagaaggtggataccagaactcaggaacctaaagaggggaccaagaaactaatgcgcataacagccgaatggctctggaaggagctgggaaagaaaaagacgcccaggatgtgtacccgagaggaattcactcggaaagtaagatcaaatgcagccttgggcgctatctttacagacgagaacaagtggaaatccgcgagggaagccgtggaggattctcgcttctgggaactggttgaccgtgagcggaatctccatcttgagggcaagtgcgaaacctgtgtctacaacatgatggggaaaagagagaagaagctgggagaatttggtaaagcaaagggcagcagggctatttggtatatgtggttaggggcccgcttcctggagtttgaagcattgggattcctcaatgaggatcactggtttagtcgaggcaactccctgagcggtgtggagggggaaggactacataaacttggctacatcctgcgggacgtgtctaagaaagagggcggggccatgtacgctgatgacactgccggatgggacacaagaattaccctcgaagatctgaagaatgaggaaatggtcacaaaccaaatgaagggtgagcacaaaaagttggcggaggcaatcttcaaactgacttatcagaataaggttgtgagggtacagcgcccaacccctagaggcacggtgatggacattatatcacggaaagatcagagggggagtggacaagtcggcacctacggtctcaacacattcactaatatggaagcccagcttatccgtcagatggagggggaaggaatttttaagtccatccaacgactgaccgtgacagaggagatcgctgttcagaactggttagcccgcgtgggcagagaacggctgagcaggatggcaatttctggcgacgattgcgtcgtgaagcccttggacgatcgcttcgcttcggccctcactgctctgaatgacatggggaaagtaagaaaggatatacagcagtgggagccatcacggggatggaacgactggacccaagttcccttttgcagccatcacttccacgaactagtgatgaaagatggtagggtccttgtggtgccttgtcgaaaccaggacgagctgatcggccgtgccagaatttcccagggggcaggatggagtctcaaggaaacggcgtgcctgggcaaatcttatgcccagatgtggacattgatgtactttcatcgccgggatttaaggctggctgccaatgcaatctgtagcgctgtcccatcccactgggttccgacctcaagaactacatggagtattcatgccaagcacgagtggatgaccactgaggacatgctcgcagtgtggaaccgcgtatggatccaagaaaatccctggatggaggacaagacccctgtggaatcttgggaggaagtcccatatcttggtaaacgggaggatcagtggtgcgggagcctgataggactaacatccagggccacgtgggcgaagaacatccagaccgctattaatcaggtgcgatcactgatcggcaacgaggaatacactgactatatgcccagcatgaaaagattccggaaggaggaagaggaagccggcgttctctggtga

SEQ ID NO: 14695 - RNA, 9876 nt, synthetic construct
  misc_feature 1..9876: note = derived and/or modified CDS sequence (opt3) from DENV-2__EU687228__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaacgaaattaaaatcacaccgcagtcctcaataaccgaggccgaacttactggctatggtaccgtgacaatggagtgtagtcccaggaccgggctggatttcaatgaaatggtattgctccagatggaggacaaggcatggctggtgcaccggcaatggtttttagatctgcctctcccatggcttcccggcgctgacactcagggaagcaactggattcagaaagagacactggtcacgttcaagaatcctcatgccaagaaacaggacgtggttgtgttgggctctcaagaaggggcgatgcacaccgccctaactggagcaacagagatccagatgtcctcaggtaacctgctctttaccggccatctgaagtgccgtcttcgcatggataaactgcagttgaaggggatgagctacagtatgtgtacaggaaaattcaagatcgtcaaggaaattgctgagactcaacacggcaccatcgtgattagagtacagtatgagggtgacgggtctccatgcaaaatacccttcgaaatcatggatctcgagaagaggcatgttctgggccggttaattacggtgaacccgatcgtcaccgaaaaagactcccctgtgaatatcgaggccgaacccccatttggagatagctacattataatcggcgtcgagcctgggcagctgaagctaaactggttcaaaaagggatcgtctattggtcagatgtttgagacaactatgcgaggcgctaagcgcatggccatcctcggggacaccgcatgggatttcggatccctgggcggtgtgtttacatcaattgggaaagcccttcaccaagttttcggcgctatctacggagcggcatttagtggcgtgagctggactatgaagatattgatcggggtaattatcacctggattggaatgaattccagatctacgagcctgtcagtcagtctcgtgctggttggcgtggtcacactttatctgggtgtgatggtacaggccgactccgggtgtgtggttagctggaaaaacaaggaattgaaatgcggatctggcatcttcataaccgataatgtccacacttggacagagcagtacaagtttcagcccgaatcaccaagtaagctcgctagcgccattcaaaaagcacatgaggaaggtatctgtggcattaggtccgtgacccggctggagaacttaatgtggaagcagatcactcccgagctgaatcacatactatctgaaaacgaggtgaaactcaccatcatgacaggggacattaagggaatcatgcaggccggcaaacgctcgctgagacctcagccaacggaacttaagtatagctggaaaacctgggggaaggctaagatgttgtccactgagtcacataatcaaacattcctgattgatggaccggaaaccgccgagtgccccaacacaaatagggcatggaacagtctcgaggtcgaagactacggctttggtgttttctctactaatatctggctgaaattacgtgagaagcaggacgtgttttgtgatagcaaactgatgtccgcggctataaaggacaaccgggccgtgcacgcagatatggggtattggattgaatcagcccttaatgacacctggaaaatggagaaggctagcttcatcgagatcaagtcttgccactggcctaaatcccatacgttgtggagtaacggagtactcgaaagcgagatgattatcccaaagaacttcgccggccccgtctctcagcacaattaccgacctggttatcatacacagaccgcaggcccatggcacctggggaaactagaaatggattttgacttctgtgagggaactaccgtggttgtgacagaagattgcggcaacagagggccctccctgaggactaccacagcttcaggaaagctcattacggagtggtgctgtcgcagttgcaccctgccgcctcttcggtacagaggcgaggacggttgttggtacgggatggaaataaggccattgaaagagaaggaagagaatctggtcaacagcttagtgactgccggacatggccaaatcgataatttttcgctcggtgttctgggcatggcgcttttcctggaagagatgttgcgcacacgagtggggaccaagcacgccattctcctggtagctgtctcctttgtgactctaatcacaggaaacatgtctttccgggacctgggccgtgtgatggtcatggttggggcaaccatgacggatgacattggaatgggcgtgacttatctcgccctgcttgctgcctttaaagtaagacccaccttcgcagcgggtttgctgttaaggaagctcacaagcaaagagctgatgatggccaccatcgggatagctcttctgtcacagagtactatccctgaaacaattctagagctcaccgatgccctggcattgggaatgatggtgctgaagatcgtccgcaatatggaaaaataccagttagctgtgacaattatggccatctcctgcgttcccaacgcagtgatactccaaaatgcctggaaggtctcttgtactattctggctgcggtgagcgtttccccacttctgttgacctcaagccagcagaaggccgactggatccctctcgcactgacgatcaaaggcctaaaccccacagctatttttctgaccactcttagtcggacctctaagaaaagatcctggccactcaatgaggccgtgatggccgtcggcatggtaagcatactggcttcgtcattgctgaagaacgacatcccgatgacagggcctttagtggcaggaggtctcctgactgtttgctatgtgcttaccggcaggtctgccgatctggaattggagcgagcggctgacgtcaaatgggaggatcaggccgaaattagtgggtccagccccatcctctctattacgatcagcgaggacggatccatgtcaataaagaatgaagaggaggaacacacactgaccatcctaattcgcactggcctgcttgtgatcagtggtgtattcccagtgagcattcccatcacagcagccgcttggtacctctgggaggtcaaaaagcaacgggcaggggttctgtgggatgtgccttctccaccccctgtgggaaaggccgaattggaggacggcgcgtatagaataaaacagaggggcatttttgggtactcccagatcggagctggtgtctataaggaaggcaccttccatactatgtggcacgtgacacgtggggccgttttaatgcatcgcggaaaacggatcgagccgtcatgggcagatgtaaagaaagacctgattagttacggcggtgggtggaagctcgagggagaatggaaggagggcgaagaggtgcaggtcctggcccttgaaccaggcaaaaaccccagagctgtgcaaaccaagcctgggctgtttaaaacgaatactggaaccatcggtgccgttagcttggatttctccccaggcacatctgggtcgcccatagtggacaggaagggaaaagtcgtgggcctatacggtaacggggtagtcacccgaagcggagcatatgtgtcagctattgcccagacagagaagtccatcgaggataaccctgaaattgaggacgatatcttccggaagaaacgcctgactataatggacctccacccgggcgcgggcaagaccaaaagatacctgcccgccattgttagggaagcaatcaagcgggggcttcgaacgttaatcctggctccaacaagagtggtcgccgctgagatggaagaggcactccgcggattgcctattaggtatcagactcccgccatccgtgccgagcataccggtcgggaaattgtggacctgatgtgtcacgctacatttaccatgagactcctgagtccagttagggtgcctaattacaaccttataatcatggatgaggcgcacttcactgaccccgcatctattgccgctcgcggctatatcagcacccgagtcgaaatgggggaggccgcaggaatctttatgacagccacgccaccgggctccagagatcctttcccccagtcaaatgctccaattatggacgaggaacgggagatacccgaaaggtcttggaacagcggtcatgagtgggtgactgattttaaagggaagaccgtatggttcgtgcctagtatcaaggcgggaaatgacattgccgcatgcctgcgcaaaaacggcaagaaagttatccaattgtcccgtaagacatttgatagcgaatacgtcaaaaccagagctaatgactgggatttcgtggtgactacagacatttctgagatgggcgccaactttcgggcagagagggtcatcgatccacgccgatgtatgaagcccgtaatactaaccgacggggaagagagagtgatcctggccggacctatgccggttacgcactcatccgctgcccagcggaggggtcgcattggcagaaatccaaagaacgaaaatgaccagtatatctacatgggggagcccctcgaaaacgatgaggactgcgcgcattggaaagaggcaaagatgttactggataatattaacactcctgaaggaatcatacccagtatgttcgagccagaaagggagaaagtggacgccattgatggcgaataccggcttcgtggtgaggctcgcaagacatttgtcgacctgatgcgaagaggggatctccctgtgtggttggcctatagggttgctgcagagggcatcaattacgccgaccggcgctggtgtttcgatggaattaaaaacaaccaaatcctggaagagaatgtggaagtcgagatatggaccaaggagggcgaaagaaaaaagctcaagcccaggtggctggacgctcggatctatagcgatccacttgccctaaaagagttcaaggaatttgcagcggggcgaaaatcgctgaccttgaacttaattactgagatgggaagactgcctacattcatgacccagaaggcccgcgacgctctcgataatctggccgtgcttcacacagcagaagtaggtggcagggcttacaaccacgccctgtctgagctcccggagactttggaaacgctgctactgctcacccttctggcaacagtgactgggggaatctttttattcttgatgtccggcaaaggtattgggaagatgaccctgggcatgtgctgcatcataacagccagcattctcctgtggtatgctcagatccagccccattggatcgcggcctcaattatccttgagtttttcctgatagttctcttgattccagaacctgagaagcaacggaccccccaggacaatcagctgacttacgtcgtgatcgcaattttaacggtggtcgctgccaccatggccaacgaaatgggatttctagagaaaacaaagaaagacctgggcctcgggagtatcactacccaggagtctgaatccaatatacttgatatcgacctgcgtccagcaagcgcttggacattgtatgccgttgcgaccactttcgtgacacctatgctgagacactcaattgagaacagtagcgtaaatgtgtccctcacggctatcgccaaccaagcaaccgtcctgatgggacttggtaggggctggcccctctctaagatggatattggggtgccgctgttggccatcggatgttacagccaggttaatccaattactctgacagctgcattactactgctcgtggcccattacgcgatcataggccctggtcttcaggctaaagccacccgcgaagcacagaagcggaccgccgctgggattatgaagaaccccacagtcgacggcatcactgtaatcgatctggagccaattccctatgaccctaaatttgaaaagcaattgggacaggtgatgctgctcgttctgtgcgtgacgcaggtccttatgatgcgaaccacatgggccttatgtgaggcactgactctcgctaccggcccgatatccacattgtgggaggggaatcccggaagattctggaacaccactatcgccgtgtcaatggcgaatatttttaggggctcttacctggccggtgcagggctactgttcagtatcatgaaaaacacgacaaatacccgccggggaactggcaacattggtgaaaccctcggcgagaagtggaaatcgagacttaacgctctggggaagagcgaatttcagatctataagaaatccggaatacaagaggtcgatcgtacattggccaaggagggcatcaaaaggggggaaactgaccaccatgcagtgtctcggggatcagctaagctgcgctggttcgttgagcgaaatatggtgaccccagaaggcaaagtagtggatctcggttgcgggagaggaggctggagctactattgtggtggcctgaagaacgtcagggaggttaaagggttaacaaagggaggccctgggcacgaagagcccattcctatgtccacgtacggatggaatcttgtgcggctgcagagtggcgtcgacgtgttctttaccccacccgagaagtgcgatactctcctatgtgacatcggtgaatctagccctaacccaacaattgaggccgggcgcaccctgagagtattgaatctggtggaaaactggctcaataacaatactcagttctgcatcaaagttcttaacccctatatgccgtcagtgatagagaagatggaaacactgcaaaggaaatacggaggcgccttggtccgaaatcctctgtcccggaacagtacccacgagatgtactgggtgagcaatgcgacgggcaacattgtctcttccgtgaatatgatctcacgtatgctcatcaacagatttaccatgaagcataaaaaggctacatatgagccagatgttgacttagggagcggaactcgcaacattggtatagaaaatgagatccccaacctggacattatcggcaagaggattgaaaaaatcaagcaggagcacgaaacctcgtggcattacgatcaggaccacccttataaaacatgggcataccacgggtcttatgagactaagcagaccggaagtgcctccagcatggtaaatggcgtggtcaaacttctgacaaagccatgggatgtggttcccatggtgacccaaatggctatgactgacacgacaccgttcggtcagcagcgggtctttaaggagaaagtggataccagaactcaggaacctaaggaggggaccaaaaagctaatgcgcataacagccgaatggctctggaaagagctgggaaagaagaaaacgcccaggatgtgtacccgagaggaattcactcggaaggtaagatcaaacgcagccttgggcgctatctttacagacgagaataaatggaagtccgcgagggaagccgtggaggattctcgcttctgggaactggttgaccgtgagcggaacctccatcttgagggcaaatgcgaaacctgtgtctacaatatgatggggaagagagagaaaaagctgggagaatttggtaaggcaaaaggcagcagggctatttggtatatgtggttaggggcccgcttcctggagtttgaagcattgggattcctcaacgaggatcactggtttagtcgaggcaattccctgagcggtgtggagggggaaggactacataagcttggctacatcctgcgggacgtgtctaaaaaggagggcggggccatgtacgctgatgacactgccggatgggacacaagaattaccctcgaagatctgaaaaacgaggaaatggtcacaaatcacatgaagggtgagcataagaaattggcggaggcaatcttcaagctgacttatcaaaacaaagttgtgagggtacagcgcccaacccctagaggcacggtgatggacattatatcacggaaggatcagagggggagtggacaggtcggcacctacggtctcaatacattcactaacatggaagcccaacttatccgtcagatggagggggaaggaatttttaaatccatccagcgactgaccgtgacagaggagatcgctgttcaaaattggttagcccgcgtgggcagagaacggctgagcaggatggcaatttctggcgacgattgcgtcgtgaagcccttggacgatcgcttcgcttcggccctcactgctctgaacgacatggggaaggtaagaaaagatatacagcagtgggagccatcacggggatggaacgactggacccaggttcccttttgcagccaccacttccatgaactagtgatgaaggatggtagggtccttgtggtgccttgtcgaaatcaagacgagctgatcggccgtgccagaatttcccagggggcaggatggagtctcaaagaaacggcgtgcctgggcaagtcttatgcccagatgtggacattgatgtactttcaccgccgggatttaaggctggctgccaacgcaatctgtagcgctgtcccatcccattgggttccgacctcaagaactacatggagtattcacgccaaacacgagtggatgaccactgaggacatgctcgcagtgtggaatcgcgtatggatccaggaaaacccctggatggaggacaagacccctgtggaatcttgggaggaagtcccatatcttggtaagcgggaggatcaatggtgcgggagcctgataggactaacatccagggccacgtgggcgaaaaatatccagaccgctattaaccaggtgcgatcactgatcggcaatgaggaatacactgactatatgcccagcatgaagagattccggaaagaggaagaggaagccggcgttctctggtga

SEQ ID NO: 14696 - RNA, 9876 nt, synthetic construct
  misc_feature 1..9876: note = derived and/or modified CDS sequence (opt3) from DENV-2__EU687230__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagaggcacgtctctgagcgtctcactcgtgctggttggtgtggtcacactttatctgggggtgatggtacaggccgacagtggatgtgtggtttcctggaagaataaagaattgaagtgcggcagcggtatcttcataaccgataacgtccacacttggacagagcagtacaagtttcagcccgaatctccatcaaaactcgctagtgccattcaaaaggcacatgaggaaggcatctgtgggattaggagcgtgacccggctggagaatttaatgtggaaacagatcactcccgagctgaaccacatactatccgaaaatgaggtgaagctcaccatcatgacaggagacattaaaggcatcatgcaggccgggaagcgctctctgagacctcagccaacggaacttaaatattcgtggaagacctggggaaaggctaaaatgttgagcactgagtcccataaccaaacattcctgattgatggcccggaaaccgccgagtgccccaatacaaacagggcatggaattcactcgaggtcgaagactacggttttggggttttcagtactaacatctggctgaagttacgtgagaaacaggacgtgttttgtgattctaagctgatgagcgcggctataaaagacaatcgggccgtgcacgcagatatgggatattggattgaatccgcccttaacgacacctggaagatggagaaggcttcattcatcgagatcaaaagctgccactggcctaagtctcatacgttgtggtccaatggcgtactcgaaagtgagatgattatcccaaaaaacttcgccggtcccgtcagccagcacaactaccgacctggctatcatacacagaccgcagggccatggcacctgggaaagctagaaatggattttgacttctgtgagggcactaccgtggttgtgacagaagattgcgggaatagaggaccctctctgaggactaccacagcttccggcaaactcattacggagtggtgctgtcgctcatgcaccctgccgcctcttcggtacagaggtgaggacgggtgttggtacggaatggaaataaggccattgaaggagaaggaagagaacctggtcaatagtttagtgactgccggccatggtcaaatcgataactttagcctcggcgttctggggatggcgcttttcctggaagagatgttgcgcacacgagtgggaaccaaacacgccattctcctggtagctgtctcgtttgtgactctaatcacaggcaatatgtccttccgggacctggggcgtgtgatggtcatggttggagcaaccatgacggatgacattggcatgggtgtgacttatctcgccctgcttgctgcctttaaggtaagacccaccttcgcagcggggttgctgttaaggaaactcacatctaaggagctgatgatggccaccatcggaatagctcttctgagccagtcaactatccctgaaacaattctagagctcaccgatgccctggcattgggcatgatggtgctgaaaatcgtccgcaacatggaaaagtaccagttagctgtgacaattatggccatcagttgcgttcccaatgcagtgatactccaaaacgcctggaaggtctcctgtactattctggctgcggtgtctgttagcccacttctgttgacctcctcacagcagaaagccgactggatccctctcgcactgacgatcaagggcctaaatcccacagctatttttctgaccactcttagccggaccagtaaaaagagatcttggccactcaacgaggccgtgatggccgtcgggatggtatccatactggctagctcgttgctgaaaaatgacatcccgatgacaggacctttagtggcaggtggcctcctgactgtttgctatgtgcttaccgggaggtcagccgatctggaattggagcgagcggctgacgtcaagtgggaggatcaggccgaaatttctggaagttcccccatcctcagcattacgatctctgaggacggcagcatgtccataaaaaacgaagaggaggaacacacactgaccatcctaattcgcactggtctgcttgtgatctcaggggtattcccagtgagtattcccatcacagcagccgcttggtacctctgggaggtcaagaagcaacgggcaggagttctgtgggatgtgcctagcccaccccctgtgggcaaagccgaattggaggacggcgcgtatagaataaagcagagggggatttttggatactctcagatcggtgctggcgtctataaagaagggaccttccatactatgtggcacgtgacacgtggagccgttttaatgcatcgcggcaagcggatcgagccgtcctgggcagatgtaaaaaaggacctgatttcatacggtgggggatggaagctcgagggcgaatggaaagagggcgaagaggtgcaggtcctggcccttgaaccagggaagaatcccagagctgtgcaaaccaaacctggactgtttaagacgaacactggtaccatcggcgccgttagtttggatttcagcccagggacatccggatctcccatagtggacaggaaaggcaaggtcgtgggtctatacgggaatggagtagtcacccgatcgggcgcatatgtgagcgctattgcccagacagagaagtcaatcgaggataaccctgaaattgaggacgatatcttccggaaaaagcgcctgactataatggacctccacccgggcgcggggaaaaccaagagatacctgcccgccattgttagggaagcaatcaaacggggacttcgaacgttaatcctggctccaacaagagtggtcgccgctgagatggaagaggcactccgcggtttgcctattaggtatcagactcccgccatccgtgccgagcataccggccgggaaattgtggacctgatgtgtcacgctacatttaccatgagactcctgtccccagttagggtgcctaactacaatcttataatcatggatgaggcgcacttcactgaccccgcaagtattgccgctcgcgggtatatctctacccgagtcgaaatgggagaggccgcaggcatctttatgacagccacgccaccgggtagcagagatcctttcccccagtccaacgctccaattatggacgaggaacgggagatacccgaaaggtcatggaattctgggcatgagtgggtgactgattttaagggaaagaccgtatggttcgtgcctagcatcaaagcgggcaacgacattgccgcatgcctgcgcaagaatggcaaaaaggttatccaattgagtcgtaaaacatttgattccgaatacgtcaagaccagagctaacgactgggatttcgtggtgactacagacattagcgagatgggggccaattttcgggcagagagggtcatcgatccacgccgatgtatgaagcccgtaatactaaccgacggagaagagagagtgatcctggccggtcctatgccggttacgcactcttcagctgcccagcggaggggccgcattgggagaaacccaaaaaatgaaaacgaccagtatatctacatgggagagcccctcgaaaatgatgaggactgcgcgcattggaaggaggcaaaaatgttactggataacattaatactcctgaaggcatcataccctccatgttcgagccagaaagggagaaggtggacgccattgatggtgaataccggcttcgtggggaggctcgcaaaacatttgtcgacctgatgcgaagaggcgatctccctgtgtggttggcctatagggttgctgcagagggaatcaactacgccgaccggcgctggtgtttcgatggcattaagaataaccaaatcctggaagagaacgtggaagtcgagatatggaccaaagagggggaaagaaagaagctcaaacccaggtggctggacgctcggatctatagtgatccacttgccctaaaggagttcaaagaatttgcagcgggacgaaagagcctgaccttgaatttaattactgagatgggtagactgcctacattcatgacccagaaagcccgcgacgctctcgataacctggccgtgcttcacacagcagaagtaggcgggagggcttacaatcacgccctgtcggagctcccggagactttggaaacgctgctactgctcacccttctggcaacagtgactggaggcatctttttattcttgatgtctggtaaggggattggcaagatgaccctgggaatgtgctgcatcataacagcctccattctcctgtggtatgctcagatccagccccattggatcgcggccagcattatccttgagtttttcctgatagttctcttgattccagaacctgagaaacaacggaccccccaggacaaccagctgacttacgtcgtgatcgcaattttaacggtggtcgctgccaccatggccaatgaaatgggctttctagagaagacaaaaaaggacctggggctcggatcaatcactacccaggagagtgaatctaacatacttgatatcgacctgcgtccagcatccgcttggacattgtatgccgttgcgaccactttcgtgacacctatgctgagacacagcattgagaattcaagtgtaaacgtgagcctcacggctatcgccaatcaagcaaccgtcctgatgggtcttggcagggggtggcccctctccaaaatggatattggagtgccgctgttggccatcggctgttactctcaggttaacccaattactctgacagctgcattactactgctcgtggcccattacgcgatcataggtcctgggcttcaggctaaggccacccgcgaagcacagaagcggaccgccgctggcattatgaaaaatcccacagtcgacggaatcactgtaatcgatctggagccaattccctatgaccctaagtttgaaaaacaattgggccaggtgatgctgctcgttctgtgcgtgacgcaggtccttatgatgcgaaccacatgggccttatgtgaggcactgactctcgctaccgggccgataagcacattgtgggagggaaaccccggcagattctggaataccactatcgccgtgtccatggcgaacatttttaggggttcatacctggccggggcaggactactgttctctatcatgaagaatacgacaaacacccgccggggcactggtaatattggcgaaaccctcggggagaaatggaagagtagacttaacgctctgggaaagtcggaatttcagatctataaaaagagcggcatacaagaggtcgatcgtacattggccaaagaggggatcaagaggggagaaactgaccaccatgcagtgtcccggggctctgctaaactgcgctggttcgttgagcgaaacatggtgaccccagaaggtaaggtagtggatctcgggtgcggaagaggcggttggtcatactattgtggcgggctgaaaaatgtcagggaggttaagggattaacaaagggcgggcctggacacgaagagcccattcctatgagcacgtacggctggaaccttgtgcggctgcagtccggtgtcgacgtgttctttaccccacccgagaaatgcgatactctcctatgtgacatcggggaaagttctcctaatccaacaattgaggccggacgcaccctgagagtattgaacctggtggaaaattggctcaacaataacactcagttctgcatcaaggttcttaatccctatatgccgagcgtgatagagaaaatggaaacactgcaaaggaagtacggcggcgccttggtccgaaaccctctgtcacggaattccacccacgagatgtactgggtgagtaacgcgacggggaatattgtcagctctgtgaacatgatctcccgtatgctcatcaatagatttaccatgaaacataagaaggctacatatgagccagatgttgacttaggatcaggtactcgcaacattggcatagaaaacgagatccccaatctggacattatcgggaaaaggattgaaaagatcaaacaggagcacgaaaccagctggcattacgatcaggaccacccttataagacatgggcataccacggatcgtatgagactaaacagaccggctctgccagttccatggtaaacggtgtggtcaagcttctgacaaagccatgggatgtggttcccatggtgacccaaatggctatgactgacacgacaccgttcgggcagcagcgggtctttaaagagaaggtggataccagaactcaggaacctaaagagggaaccaagaaactaatgcgcataacagccgaatggctctggaaggagctgggcaagaaaaagacgcccaggatgtgtacccgagaggaattcactcggaaagtaagaagcaatgcagccttgggcgctatctttacagacgagaacaagtggaaatcagcgagggaagccgtggaggattcccgcttctgggaactggttgaccgtgagcggaatctccatcttgaggggaagtgcgaaacctgtgtctacaacatgatgggaaaaagagagaagaagctgggtgaatttggcaaagcaaaggggtctagggctatttggtatatgtggttaggagcccgcttcctggagtttgaagcattgggcttcctcaatgaggatcactggtttagccgaggtaacagtctgtccggggtggagggagaaggcctacataaacttggctacatcctgcgggacgtgagcaagaaagaggggggagccatgtacgctgatgacactgccggttgggacacaagaattaccctcgaagatctgaagaatgaggaaatggtcacaaaccacatgaagggcgagcataaaaagttggcggaggcaatcttcaaactgacttatcaaaataaggttgtgagggtacagcgcccaacccctagagggacggtgatggacattatatctcggaaagatcagaggggatcaggccaggtcggtacctacgggctcaacacattcactaatatggaagcccaacttatccgtcagatggagggagaaggcatttttaagagtatccagcgactgaccgtgacagaggagatcgctgttcaaaactggttagcccgcgtgggcagagaacggctgtccaggatggcaattagcggggacgattgcgtcgtgaagcccttggacgatcgcttcgcttctgccctcactgctctgaatgacatgggaaaagtaagaaaggatatacagcagtgggagccatcgcggggttggaacgactggacccaggttcccttttgctcacaccacttccatgaactagtgatgaaagatggcagggtccttgtggtgccttgtcgaaaccaagacgagctgatcgggcgtgccagaattagccagggagcaggctggtccctcaaggaaacggcgtgcctgggtaaaagttatgcccagatgtggacattgatgtactttcaccgccgggatttaaggctggctgccaatgcaatctgttctgctgtcccaagccattgggttccgacctccagaactacatggtcaattcacgccaagcacgagtggatgaccactgaggacatgctcgcagtgtggaaccgcgtatggatccaggaaaatccctggatggaggacaagacccctgtggaaagttgggaggaagtcccatatcttgggaaacgggaggatcaatggtgcggatctctgataggcctaacaagcagggccacgtgggcgaagaacatccagaccgctattaatcaggtgcgatccctgatcggcaacgaggaatacactgactatatgccctcaatgaaaagattccggaaggaggaagaggaagccggggttctctggtga

SEQ ID NO: 14697 - RNA, 9876 nt, synthetic construct
  misc_feature 1..9876: note = derived and/or modified CDS sequence (opt3) from DENV-2__EU687231__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgagatcaaatcttgccactggcctaagtcccatacgttgtggagtaatggagtactcgaaagcgagatgattatcccaaaaaacttcgccggccccgtctctcagcacaactaccgacctggttatcatacacagaccgcaggcccatggcacctggggaagctagaaatggattttgacttctgtgagggaactaccgtggttgtgacagaagattgcggcaatagagggccctccctgaggactaccacagcttcaggaaaactcattacggagtggtgctgtcgcagttgcaccctgccgcctcttcggtacagaggcgaggacggttgttggtacgggatggaaataaggccattgaaggagaaggaagagaacctggtcaatagcttagtgactgccggacatggccaaatcgataacttttcgctcggtgttctgggcatggcgcttttcctggaagagatgttgcgcacacgagtggggaccaaacacgccattctcctggtagctgtctcctttgtgactctaatcacaggaaatatgtctttccgggacctgggccgtgtgatggtcatggttggggcaaccatgacggatgacattggaatgggcgtgacttatctcgccctgcttgctgcctttaaggtaagacccaccttcgcagcgggtttgctgttaaggaaactcacaagcaaggagctgatgatggccaccatcgggatagctcttctgtcacagagtactatccctgaaacaattctagagctcaccgatgccctggcattgggaatgatggtgctgaaaatcgtccgcaacatggaaaagtaccagttagctgtgacaattatggccatctcctgcgttcccaatgcagtgatactccaaaacgcctggaaggtctcttgtactattctggctgcggtgagcgtttccccacttctgttgacctcaagccagcagaaagccgactggatccctctcgcactgacgatcaagggcctaaatcccacagctatttttctgaccactcttagtcggacctctaaaaagagatcctggccactcaacgaggccgtgatggccgtcggcatggtaagcatactggcttcgtcattgctgaaaaatgacatcccgatgacagggcctttagtggcaggaggtctcctgactgtttgctatgtgcttaccggcaggtctgccgatctggaattggagcgagcggctgacgtcaagtgggaggatcaggccgaaattagtgggtccagccccatcctctctattacgatcagcgaggacggatccatgtcaataaaaaacgaagaggaggaacacacactgaccatcctaattcgcactggcctgcttgtgatcagtggtgtattcccagtgagcattcccatcacagcagccgcttggtacctctgggaggtcaagaagcaacgggcaggggttctgtgggatgtgccttctccaccccctgtgggaaaagccgaattggaggacggcgcgtatagaataaagcagaggggcatttttgggtactcccagatcggagctggtgtctataaagaaggcaccttccatactatgtggcacgtgacacgtggggccgttttaatgcatcgcggaaagcggatcgagccgtcatgggcagatgtaaaaaaggacctgattagttacggcggtgggtggaagctcgagggagaatggaaagagggcgaagaggtgcaggtcctggcccttgaaccaggcaagaatcccagagctgtgcaaaccaaacctgggctgtttaagacgaacactggaaccatcggtgccgttagcttggatttctccccaggcacatctgggtcgcccatagtggacaggaaaggaaaggtcgtgggcctatacggtaatggggtagtcacccgaagcggagcatatgtgtcagctattgcccagacagagaagtccatcgaggataaccctgaaattgaggacgatatcttccggaaaaagcgcctgactataatggacctccacccgggcgcgggcaaaaccaagagatacctgcccgccattgttagggaagcaatcaaacgggggcttcgaacgttaatcctggctccaacaagagtggtcgccgctgagatggaagaggcactccgcggattgcctattaggtatcagactcccgccatccgtgccgagcataccggtcgggaaattgtggacctgatgtgtcacgctacatttaccatgagactcctgagtccagttagggtgcctaactacaatcttataatcatggatgaggcgcacttcactgaccccgcatctattgccgctcgcggctatatcagcacccgagtcgaaatgggggaggccgcaggaatctttatgacagccacgccaccgggctccagagatcctttcccccagtcaaacgctccaattatggacgaggaacgggagatacccgaaaggtcttggaatagcggtcatgagtgggtgactgattttaaggggaagaccgtatggttcgtgcctagtatcaaagcgggaaacgacattgccgcatgcctgcgcaagaatggcaaaaaggttatccaattgtcccgtaaaacatttgatagcgaatacgtcaagaccagagctaacgactgggatttcgtggtgactacagacatttctgagatgggcgccaattttcgggcagagagggtcatcgatccacgccgatgtatgaagcccgtaatactaaccgacggggaagagagagtgatcctggccggacctatgccggttacgcactcatccgctgcccagcggaggggtcgcattggcagaaacccaaaaaatgaaaacgaccagtatatctacatgggggagcccctcgaaaatgatgaggactgcgcgcattggaaggaggcaaaaatgttactggataacattaatactcctgaaggaatcatacccagtatgttcgagccagaaagggagaaggtggacgccattgatggcgaataccggcttcgtggtgaggctcgcaaaacatttgtcgacctgatgcgaagaggggatctccctgtgtggttggcctatagggttgctgcagagggcatcaactacgccgaccggcgctggtgtttcgatggaattaagaataaccaaatcctggaagagaacgtggaagtcgagatatggaccaaagagggcgaaagaaagaagctcaaacccaggtggctggacgctcggatctatagcgatccacttgccctaaaggagttcaaagaatttgcagcggggcgaaagtcgctgaccttgaatttaattactgagatgggaagactgcctacattcatgacccagaaagcccgcgacgctctcgataacctggccgtgcttcacacagcagaagtaggtggcagggcttacaatcacgccctgtctgagctcccggagactttggaaacgctgctactgctcacccttctggcaacagtgactgggggaatctttttattcttgatgtccggcaagggtattgggaagatgaccctgggcatgtgctgcatcataacagccagcattctcctgtggtatgctcagatccagccccattggatcgcggcctcaattatccttgagtttttcctgatagttctcttgattccagaacctgagaaacaacggaccccccaggacaaccagctgacttacgtcgtgatcgcaattttaacggtggtcgctgccaccatggccaatgaaatgggatttctagagaagacaaaaaaggacctgggcctcgggagtatcactacccaggagtctgaatccaacatacttgatatcgacctgcgtccagcaagcgcttggacattgtatgccgttgcgaccactttcgtgacacctatgctgagacactcaattgagaatagtagcgtaaacgtgtccctcacggctatcgccaatcaagcaaccgtcctgatgggacttggtaggggctggcccctctctaaaatggatattggggtgccgctgttggccatcggatgttacagccaggttaacccaattactctgacagctgcattactactgctcgtggcccattacgcgatcataggccctggtcttcaggctaaggccacccgcgaagcacagaagcggaccgccgctgggattatgaaaaatcccacagtcgacggcatcactgtaatcgatctggagccaattccctatgaccctaagtttgaaaaacaattgggacaggtgatgctgctcgttctgtgcgtgacgcaggtccttatgatgcgaaccacatgggccttatgtgaggcactgactctcgctaccggcccgatatccacattgtgggaggggaaccccggaagattctggaataccactatcgccgtgtcaatggcgaacatttttaggggctcttacctggccggtgcagggctactgttcagtatcatgaagaatacgacaaacacccgccggggaactggcaatattggtgaaaccctcggcgagaaatggaagtcgagacttaacgctctggggaagagcgaatttcagatctataaaaagtccggaatacaagaggtcgatcgtacattggccaaagagggcatcaagaggggggaaactgaccaccatgcagtgtctcggggatcagctaaactgcgctggttcgttgagcgaaacatggtgaccccagaaggcaaggtagtggatctcggttgcgggagaggaggctggagctactattgtggtggcctgaaaaatgtcagggaggttaaggggttaacaaagggaggccctgggcacgaagagcccattcctatgtccacgtacggatggaaccttgtgcggctgcagagtggcgtcgacgtgttctttaccccacccgagaaatgcgatactctcctatgtgacatcggtgaatctagccctaatccaacaattgaggccgggcgcaccctgagagtattgaacctggtggaaaattggctcaacaataacactcagttctgcatcaaggttcttaatccctatatgccgtcagtgatagagaaaatggaaacactgcaaaggaagtacggaggcgccttggtccgaaaccctctgtcccggaatagtacccacgagatgtactgggtgagcaacgcgacgggcaatattgtctcttccgtgaacatgatctcacgtatgctcatcaatagatttaccatgaaacataagaaggctacatatgagccagatgttgacttagggagcggaactcgcaacattggtatagaaaacgagatccccaatctggacattatcggcaaaaggattgaaaacatcaagcaggagcacgaaacctcgtggcattacgatcaggaccacccttataaaacatgggcataccacgggtcttatgagactaagcagaccggaagtgcctccagcatggtaaatggcgtggtcaaacttctgacaaagccatgggatgtggttcccatggtgacccaaatggctatgactgacacgacaccgttcggtcagcagcgggtctttaaggagaaagtggataccagaactcaggaacctaaggaggggaccaaaaagctaatgcgcataacagccgaatggctctggaaagagctgggaaagaagaaaacgcccaggatgtgtacccgagaggaattcactcggaaggtaagatcaaacgcagccttgggcgctatctttacagacgagaataaatggaagtccgcgagggaagccgtggaggattctcgcttctgggaactggttgaccgtgagcggaacctccatcttgagggcaaatgcgaaacctgtgtctacaatatgatggggaagagagagaaaaagctgggagaatttggtaaggcaaaaggcagcagggctatttggtatatgtggttaggggcccgcttcctggagtttgaagcattgggattcctcaacgaggatcactggtttagtcgaggcaattccctgagcggtgtggagggggaaggactacataagcttggctacatcctgcgggacgtgtctaaaaaggagggcggggccatgtacgctgatgacactgccggatgggacacaagaattaccctcgaagatctgaaaaacgaggaaatggtcacaaatcacatgaagggtgagcataagaaattggcggaggcaatcttcaagctgacttatcaaaacaaagttgtgagggtacagcgcccaacccctagaggcacggtgatggacattatatcacggaaggatcagagggggagtggacaggtcggcacctacggtctcaatacattcactaacatggaagcccaacttatccgtcagatggagggggaaggaatttttaaatccatccagcgactgaccgtgacagaggagatcgctgttcaaaattggttagcccgcgtgggcagagaacggctgagcaggatggcaatttctggcgacgattgcgtcgtgaagcccttggacgatcgcttcgcttcggccctcactgctctgaacgacatggggaaggtaagaaaagatatacagcagtgggagccatcacggggatggaacgactggacccaggttcccttttgcagccaccacttccatgaactagtgatgaaggatggtagggtccttgtggtgccttgtcgaaatcaagacgagctgatcggccgtgccagaatttcccagggggcaggatggagtctcaaagaaacggcgtgcctgggcaagtcttatgcccagatgtggacattgatgtactttcaccgccgggatttaaggctggctgccaacgcaatctgtagcgctgtcccatcccattgggttccgacctcaagaactacatggagtattcacgccaaacacgagtggatgaccactgaggacatgctcgcagtgtggaatcgcgtatggatccaggaaaacccctggatggaggacaagacccctgtggaatcttgggaggaagtcccatatcttggtaagcgggaggatcaatggtgcgggagcctgataggactaacatccagggccacgtgggcgaaaaatatccagaccgctattaaccaggtgcgatcactgatcggcaatgaggaatacactgactatatgcccagcatgaagagattccggaaagaggaagaggaagccggcgttctctggtga

SEQ ID NO: 14698 - RNA, 9876 nt, synthetic construct
  misc_feature 1..9876: note = derived and/or modified CDS sequence (opt3) from DENV-2__EU687199__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatgatggatctcgagaaaaggcatgttctgggccggttaatcacggtgaacccgattgtcaccgaaaaggactcccctgtgaacatcgaggccgaacccccatttggagatagctacatcattataggcgtcgagcctgggcagctgaaactaaattggttcaagaagggatcgtctatcggtcagatgtttgagacaactatgcgaggcgctaaacgcatggccattctcggggacaccgcatgggatttcggatccctgggcggtgtgtttacatcaatcgggaaggcccttcaccaagttttcggcgctatttacggagcggcatttagtggcgtgagctggactatgaaaatcttgataggggtaatcattacctggatcggaatgaactccagatctacgagcctgtcagtcagtctcgtgctggttggcgtggtcacactttatctgggtgtgatggtacaggccgacaccgggtgtgtggtttcctggaagaataaagaattgaagtgcggaagcggcattttcatcactgataacgtccacacatggaccgagcagtacaagtttcagcccgaatctccatcaaaactcgctagtgccatacaaaaggcacatgaggaaggtatttgtggcatcaggagcgtgactcggctggagaatttaatgtggaaacagattacccccgagctgaaccacatcctatccgaaaatgaggtgaagctcacaataatgacgggggacatcaaaggaattatgcaggccggcaagcgctctctgagacctcagccaaccgaacttaaatattcgtggaagacttgggggaaggctaaaatgttgagcacagagtcccataaccaaaccttcctgatcgatggaccggaaacagccgagtgccccaatactaacagggcatggaattcactcgaggtcgaagactacggctttggtgttttcagtaccaacatttggctgaagttacgtgagaaacaggacgtgttttgtgattctaagctgatgagcgcggctatcaaagacaatcgggccgtgcacgcagatatggggtattggatagaatccgcccttaacgacacgtggaagatggagaaggcttcattcattgagatcaaaagctgccactggcctaagtctcatacattgtggtccaatggagtactcgaaagtgagatgatcattccaaaaaacttcgccggccccgtcagccagcacaactaccgacctggttatcatacccagactgcaggcccatggcacctggggaagctagaaatggattttgacttctgtgagggaaccacagtggttgtgactgaagattgcggcaatagagggccctctctgaggaccacaacggcttccggaaaactcatcaccgagtggtgctgtcgctcatgcactctgccgcctcttcggtacagaggcgaggacggttgttggtacgggatggaaattaggccattgaaggagaaggaagagaacctggtcaatagtttagtgacagccggacatggccaaatagataactttagcctcggtgttctgggcatggcgcttttcctggaagagatgttgcgcacccgagtggggactaaacacgccatcctcctggtagctgtctcgtttgtgacactaattaccggaaatatgtccttccgggacctgggccgtgtgatggtcatggttggggcaacgatgactgatgacatcggaatgggcgtgacctatctcgccctgcttgctgcctttaaggtaagacccacattcgcagcgggtttgctgttaaggaaactcacctctaaggagctgatgatggccactattgggatcgctcttctgagccagtcaacaatacctgaaaccatcctagagctcacagatgccctggcattgggaatgatggtgctgaaaattgtccgcaacatggaaaagtaccagttagctgtgactatcatggccattagttgcgttcccaatgcagtgatcctccaaaacgcctggaaggtctcctgtaccatactggctgcggtgtctgttagcccacttctgttgacgtcctcacagcagaaagccgactggattcctctcgcactgacaatcaagggcctaaatcccaccgctatctttctgactacccttagccggacaagtaaaaagagatcttggccactcaacgaggccgtgatggccgtcggcatggtatccattctggctagctcgttgctgaaaaatgacataccgatgactgggcctttagtggcaggaggtctcctgaccgtttgctatgtgcttacgggcaggtcagccgatctggaattggagcgagcggctgacgtcaagtgggaggatcaggccgaaatctctgggagttcccccattctcagcatcacaatttctgaggacggaagcatgtccatcaaaaacgaagaggaggaacacaccctgactatactaatccgcacaggcctgcttgtgatttcaggtgtattcccagtgagtatccccattaccgcagccgcttggtacctctgggaggtcaagaagcaacgggcaggggttctgtgggatgtgcctagcccaccccctgtgggaaaagccgaattggaggacggcgcgtatagaatcaagcagaggggcatatttgggtactctcagattggagctggtgtctataaagaaggcactttccatacaatgtggcacgtgacccgtggggccgttttaatgcatcgcggaaagcggatcgagccgtcctgggcagatgtaaaaaaggacctgatctcatacggcggtgggtggaagctcgagggagaatggaaagagggcgaagaggtgcaggtcctggcccttgaaccaggcaagaatcccagagctgtgcaaacgaaacctgggctgtttaagactaacaccggaacaattggtgccgttagtttggatttcagcccaggcacctccgggtctcccatcgtggacaggaaaggaaaggtcgtgggcctatacggtaatggggtagtcacacgatcgggagcatatgtgagcgctatagcccagactgagaagtcaattgaggataaccctgaaatcgaggacgatattttccggaaaaagcgcctgaccatcatggacctccacccgggcgcgggcaaaacgaagagatacctgcccgccatagttagggaagcaattaaacgggggcttcgaacattaatcctggctccaactagagtggtcgccgctgagatggaagaggcactccgcggattgcctatcaggtatcagacccccgccattcgtgccgagcatacaggtcgggaaatcgtggacctgatgtgtcacgctacctttactatgagactcctgtccccagttagggtgcctaactacaatcttattataatggatgaggcgcacttcaccgaccccgcaagtatcgccgctcgcggctatatttctacacgagtcgaaatgggggaggccgcaggaatctttatgacggccactccaccgggcagcagagatcctttcccccagtccaacgctccaatcatggacgaggaacgggagattcccgaaaggtcatggaattctggtcatgagtgggtgaccgattttaaggggaagacagtatggttcgtgcctagcataaaagcgggaaacgacatcgccgcatgcctgcgcaagaatggcaaaaaggttattcaattgagtcgtaaaacctttgattccgaatacgtcaagactagagctaacgactgggatttcgtggtgacaaccgacatcagcgagatgggcgccaattttcgggcagagagggtcattgatccacgccgatgtatgaagcccgtaatcctaacggacggggaagagagagtgatactggccggacctatgccggttactcactcttcagctgcccagcggaggggtcgcatcggcagaaacccaaaaaatgaaaacgaccagtatatttacatgggggagcccctcgaaaatgatgaggactgcgcgcattggaaggaggcaaaaatgttactggataacatcaatacacctgaaggaattatcccctccatgttcgagccagaaagggagaaggtggacgccatagatggcgaataccggcttcgtggtgaggctcgcaaaacctttgtcgacctgatgcgaagaggggatctccctgtgtggttggcctatagggttgctgcagagggcattaactacgccgaccggcgctggtgtttcgatggaatcaagaataaccaaattctggaagagaacgtggaagtcgagatctggaccaaagagggcgaaagaaagaagctcaaacccaggtggctggacgctcggatatatagtgatccacttgccctaaaggagttcaaagaatttgcagcggggcgaaagagcctgactttgaatttaatcacagagatgggaagactgcctaccttcatgacacagaaagcccgcgacgctctcgataacctggccgtgcttcacactgcagaagtaggtggcagggcttacaatcacgccctgtcggagctcccggagacgttggaaaccctgctactgctcacacttctggcaactgtgaccgggggaatttttttattcttgatgtctggcaagggtatcgggaagatgacactgggcatgtgctgcattatcaccgcctccatactcctgtggtatgctcagattcagccccattggatcgcggccagcatcattcttgagtttttcctgatcgttctcttgataccagaacctgagaaacaacggactccccaggacaaccagctgacgtacgtcgtgattgcaatcttaaccgtggtcgctgccacaatggccaatgaaatgggatttctagagaagactaaaaaggacctgggcctcgggtcaattaccacacaggagagtgaatctaacatccttgatatagacctgcgtccagcatccgcttggaccttgtatgccgttgcgactacattcgtgacgcctatgctgagacacagcatcgagaattcaagtgtaaacgtgagcctcaccgctattgccaatcaagcaactgtcctgatgggacttggtaggggctggcccctctccaaaatggatatcggggtgccgctgttggccattggatgttactctcaggttaacccaatcacactgaccgctgcattactactgctcgtggcccattacgcgattatcggccctggtcttcaggctaaggccacccgcgaagcacagaagcggacagccgctgggataatgaaaaatcccactgtcgacggcattacggtaatcgatctggagccaatcccctatgaccctaagtttgaaaaacaattgggacaggtgatgctgctcgttctgtgcgtgacccaggtccttatgatgcgaacaacttgggccttatgtgaggcactgaccctcgctacaggcccgattagcaccttgtgggaggggaaccccggaagattctggaatactacgatagccgtgtccatggcgaacatctttaggggctcatacctggccggtgcagggctactgttctctattatgaagaatacaaccaacactcgccggggaaccggcaatatcggtgaaacactcggcgagaaatggaagagtagacttaacgctctggggaagtcggaatttcagatttataaaaagagcggaatccaagaggtcgatcgtactttggccaaagagggcataaagaggggggaaaccgaccaccatgcagtgtcccggggatctgctaaactgcgctggttcgttgagcgaaacatggtgacaccagaaggcaaggtagtggatctcggttgcgggagaggaggctggtcatactattgtggtggcctgaaaaatgtcagggaggttaaggggttaacgaagggaggccctgggcacgaagagcccatccctatgagcacctacggatggaaccttgtgcggctgcagtccggcgtcgacgtgttctttactccacccgagaaatgcgatacactcctatgtgacattggtgaaagttctcctaatccaaccatcgaggccgggcgcactctgagagtattgaacctggtggaaaattggctcaacaataacacacagttctgcgttaaggtgcttaatccctatatgccgagcgtcattgagaaaatggaaaccctgcaaaggaagtacggaggcgccttggtgcgaaaccctctgtcacggaattccacgcacgagatgtactgggtcagtaacgcgaccggcaatatcgtgagctctgttaacatgatatcccgtatgctcattaatagatttacaatgaaacataagaaggctacttatgagccagatgtagacttagggtcaggaacccgcaacatcggtatcgaaaacgagattcccaatctggacataatcggcaaaaggattgaaaagatcaaacaggagcacgaaacaagctggcattacgatcaggaccacccttataagacttgggcataccacgggtcgtatgagaccaaacagacaggatctgccagttccatggtgaacggcgtcgtgaagcttctgaccaagccatgggatgttgtgcccatggtcactcaaatggctatgacggacacaaccccgttcggtcagcagcgggtgtttaaagagaaggtagatactagaacccaggaacctaaagaggggacaaagaaactaatgcgcattacggccgaatggctctggaaggagctgggaaagaaaaagacccccaggatgtgtactcgagaggaattcacacggaaagtgagaagcaatgcagccttgggcgctatctttaccgacgagaacaagtggaaatcagcgagggaagccgttgaggattcccgcttctgggaactggtcgaccgtgagcggaatctccatcttgagggcaagtgcgaaacttgtgtgtacaacatgatggggaaaagagagaagaagctgggagaatttggtaaagcaaagggctctagggctatatggtatatgtggttaggggcccgcttcctggagtttgaagcattgggattcctcaatgaggatcactggtttagccgaggcaacagtctgtccggtgtggagggggaaggactacataaacttggctacatcctgcgggacgtcagcaagaaagagggcggggccatgtacgctgatgacacagccggatgggacaccagaattacactcgaagatctgaagaatgaggaaatggttactaaccacatgaagggtgagcataaaaagttggcggaggcaatcttcaaactgacctatcaaaataaggtggtaagggtgcagcgcccaacgcctagaggcaccgtcatggacattatctctcggaaagatcagagggggtcaggacaggtgggcacatacggtctcaacactttcaccaatatggaagcccaacttattcgtcagatggagggggaaggaatatttaagagtatccagcgactgacagttactgaggagattgctgtgcaaaactggttagcccgcgtcggcagagaacggctgtccaggatggcaatcagcggcgacgattgcgtggtaaagcccttggacgatcgcttcgcttctgccctcaccgctctgaatgacatggggaaagttagaaaggatatccagcagtgggagccatcgcggggatggaacgactggacgcaggtgcccttttgctcacaccacttccatgaactagtcatgaaagatggtagggtgcttgtggtcccttgtcgaaaccaagacgagctgattggccgtgccagaataagccagggggcaggatggtccctcaaggaaacagcgtgcctgggcaaaagttatgcccagatgtggaccttgatgtactttcaccgccgggatttaaggctggctgccaatgcaatctgttctgctgttccaagccattgggtgccgacttccagaacaacctggtcaattcacgccaagcacgagtggatgactaccgaggacatgctcgcagtatggaaccgcgtgtggatccaggaaaatccctggatggaggacaagacacctgtcgaaagttgggaggaagtgccatatcttggtaaacgggaggatcaatggtgcgggtctctgattggactaacgagcagggccacctgggcgaagaacatccagactgctataaatcaggttcgatccctgatcggcaacgaggaatacacagactatatgccctcaatgaaaagattccggaaggaggaagaggaagccggcgtgctctggtga

SEQ ID NO: 14699 - RNA, 9876 nt, synthetic construct
  misc_feature 1..9876: note = derived and/or modified CDS sequence (opt3) from DENV-2__EU687235__SS-prME
  source 1..9876: mol_type = other RNA
accgccggcgtgataattatgctgataccaacggctatggctttccacctcactacgcggaacggggaacctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagacagtcgctgtccaactcaaggagagccctccctgaatgaggaacaggataaacgatttatctgcaagcattctatggtggacagaggctggggtaacgggtgtggactgttcggcaagggcgggattgtaacctgcgccatgtttacatgcaaaaagaatatggagggaaaagtggtgctccctgaaaacctggagtacaccatagtcatcactccacacagcggtgaagaacatgctgttggcaatgatacggggaagcacggaaaagagattaagatcacaccgcagtcctcaataaccgaagccgagcttactggctatggtaccgtgacaatggaatgtagtcccaggaccgggctggacttcaacgagatggtattgctccagatggaagataaagcatggctggtgcaccggcaatggtttttagacctgcctctcccatggcttcccggcgctgacactcagggaagcaattggattcagaaggagacactggtcacgttcaagaaccctcatgccaaaaagcaggatgtggttgtgttgggctctcaagagggggcgatgcacaccgccctaactggagcaacagaaatccagatgtcctcaggtaatctgctctttaccggccatctgaaatgccgtcttcgcatggacaagctgcagttgaaagggatgagctacagtatgtgtacaggaaagttcaagatcgtcaaagagattgctgaaactcaacacggcaccatcgtgattagagtacagtatgagggtgatgggtctccatgcaagatacccttcgagatcatggacctcgagaaaaggcatgttctgggccggttaattacggtgaacccgatcgtcaccgagaaggattcccctgtgaacatcgaagccgagcccccatttggagacagctacattataatcggcgtcgaacctgggcagctgaaactaaattggttcaagaagggatcgtctattggtcagatgtttgagacaactatgcgaggcgctaaacgcatggccatcctcggggataccgcatgggacttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgataccgggtgtgtggtttcctggaagaataaagagttgaagtgcggaagcggcatcttcataactgacaacgtccacacatggaccgaacagtacaagtttcagcccgagtctccatcaaaactcgctagtgccattcaaaaggcacatgaagagggtatctgtggcattaggagcgtgactcggctggaaaatttaatgtggaaacagatcacccccgagctgaaccacatactatccgagaatgaagtgaagctcacaatcatgacgggggatattaaaggaatcatgcaggccggcaagcgctctctgagacctcagccaaccgagcttaaatattcgtggaagacttgggggaaggctaaaatgttgagcacagaatcccataaccaaaccttcctgattgacggaccggagacagccgaatgccccaatactaacagggcatggaactcactcgaggtcgaggactacggctttggtgttttcagtaccaacatctggctgaagttacgtgaaaaacaggatgtgttttgtgactctaagctgatgagcgcggctataaaagataatcgggccgtgcacgcagacatggggtattggattgagtccgcccttaacgatacgtggaagatggaaaaggcttcattcatcgagatcaaaagctgccactggcctaagtctcatacattgtggtccaatggagtactcgagagtgaaatgattatccccaaaaatttcgccggccccgtcagccagcacaactaccgacctggttatcatacccagactgcaggcccatggcacctggggaagctagagatggactttgatttctgtgaaggaaccacagtggttgtgactgaggactgcggcaatagagggccctctctgaggaccacaacggcttccggaaaactcattaccgaatggtgctgtcgctcatgcactctgccgcctcttcggtacagaggcgaggatggttgttggtacgggatggagataaggccattgaaggaaaaggaggaaaacctggtcaatagtttagtgacagccggacatggccaaatcgacaactttagcctcggtgttctgggcatggcgcttttcctggaggaaatgttgcgcacccgagtggggactaaacacgccattctcctggtagctgtctcgtttgtgacactaatcaccggaaatatgtccttccgggatctgggccgtgtgatggtcatggttggggcaacgatgactgacgatattggaatgggcgtgacctatctcgccctgcttgctgcctttaaggtaagacccacattcgcagcgggtttgctgttaaggaaactcacctctaaggagctgatgatggccactatcgggatagcacttctgagccagtcaacaatccctgagaccattctagaactcacagacgccctggcattgggaatgatggtgctgaaaatcgtccgcaacatggagaagtaccagttagctgtgactattatggccatcagttgcgttcccaatgcagtgatactccaaaacgcctggaaggtctcctgtaccattctggctgcggtgtctgttagcccacttctgttgacgtcctcacagcagaaagccgactggatccctctcgcactgacaatcaagggcctaaatcccaccgctatttttctgactacccttagccggacaagtaaaaagagatcttggccactcaacgaagccgtgatggccgtcggcatggtatccatactggctagctcgttgctgaaaaatgatatcccgatgactgggcctttagtggcaggaggtctcctgaccgtttgctatgtgcttacgggcaggtcagccgacctggagttggaacgagcggctgatgtcaagtgggaggaccaggccgagatttctgggagttcccccatcctcagcattacaatctctgaagatggaagcatgtccatcaaaaatgaggaagaggagcacaccctgactatcctaattcgcacaggcctgcttgtgatctcaggtgtattcccagtgagtattcccatcaccgcagccgcttggtacctctgggaagtcaagaagcaacgggcaggggttctgtgggacgtgcctagcccacccttggtgggaaaagccgagttagaagatggcgcgtatagaataaagcagaggggcatttttgggtactctcagatcggagctggtgtctataaagagggcactttccatacaatgtggcacgtgacccgtggggccgttctgatgcatcgcggaaagcggatcgaaccttcctgggcagacgtcaaaaaggatctcatttcatacggcggtgggtggaagctggagggagagtggaaagaaggcgaggaagtgcaggtccttgccctggagccgggcaagaatccaagagctgtgcaaacgaaacccgggttgtttaagactaacaccggaacaatcggtgccgttagtctagacttcagccctggcacctccgggtctccaatagtggataggaaaggaaaggtcgtgggcctgtacggtaatggggtagtcacacgatcgggagcatatgtgagcgctattgcccagactgaaaagtcaatcgaggacaaccccgagattgaagatgacatcttccggaaaaagcgcctcaccataatggacctgcaccctggcgcgggcaaaacgaagagataccttccggccattgttagggaggcaatcaaacgggggttacgaacactgatcctcgctcccactagagtggtcgccgctgaaatggaggaagcattgcgcggactgccaattaggtatcagacccctgccatccgtgccgagcatacaggtcgggagattgtggatctcatgtgtcacgctacctttactatgagactgctttcccccgttagggtgccaaactacaatctgataatcatggacgaagcgcacttcaccgatcctgcaagtattgccgctcgcggctatatctctacacgagtcgagatgggggaagccgcaggaatctttatgacggccactcccccaggcagcagagacccgttccctcagtccaacgctcccattatggatgaggagcgggaaataccagagaggtcatggaactctggtcatgaatgggtgaccgactttaaggggaagacagtatggttcgtgcccagcatcaaagcgggaaacgatattgccgcatgcttgcgcaagaatggcaaaaaggttatccaactaagtcgtaaaacctttgactccgagtacgtcaagactagagctaacgattgggacttcgtggtgacaaccgatattagcgaaatgggcgccaattttcgggcagagagggtcatcgaccctcgccgatgtatgaagccagtaatactgacggacggggaggaaagagtgatcctcgccggacccatgcctgttactcactcttcagctgcccagcggaggggtcgcattggcagaaacccgaaaaatgagaacgatcagtatatctacatgggggaaccattagagaatgacgaagattgcgcgcattggaaggaggcaaaaatgctgcttgacaacattaatacacccgagggaatcataccttccatgttcgaacccgagagggaaaaggtggatgccattgacggcgagtaccggctgcgtggtgaagctcgcaaaacctttgtcgatctcatgcgaagaggggacttgccagtgtggctggcctatagggttgctgcagagggcatcaactacgccgatcggcgctggtgtttcgacggaattaagaataaccaaatcctcgaggaaaacgtggaggtcgaaatatggaccaaagagggcgagagaaagaagctgaaacctaggtggcttgatgctcggatctatagtgaccccctagccctgaaggagttcaaagagtttgcagcggggcgaaagagcttgactttaaatctgattacagaaatgggaagactcccaaccttcatgacacagaaagcccgcgatgctctggacaaccttgccgtgctgcacactgcagaggtaggtggcagggcttacaatcacgccctctcggaattgcctgagacgctggagaccctactgctccttacactgttagcaactgtgaccgggggaatctttttgttcctgatgtctggcaagggtattgggaagatgacactcggcatgtgctgcatcataaccgcctccattctgctttggtatgctcagatccagccgcattggatcgcggccagcattatcctggaatttttcctcatagttttgctgattcccgagccagaaaaacaacggactcctcaggacaaccagttaacgtacgtcgtgatcgcaattctaaccgtggtcgctgccacaatggccaatgagatgggatttctggaaaagactaaaaaggatctcggccttgggtcaatcaccacacaggagagtgagtctaacatactggacatcgatttgcgtcccgcatccgcttggaccctgtatgccgttgcgactacattcgtgacgccaatgctcagacacagcattgaaaattcaagtgtaaacgtgagcctgaccgctatcgccaatcaagcaactgtccttatgggactcggtaggggctggcctctgtccaaaatggacattggggtgcccttgctggccatcggatgttactctcaggttaacccgattacattaaccgctgcactactgctccttgtggcccattacgcgatcataggcccaggtctgcaggctaaggccacccgcgaggcacagaagcggacagccgctgggattatgaaaaatcctactgtcgatggcatcacggtaatcgacttggaacccattccatatgatcccaagtttgagaaacaactgggacaggtgatgctcctggttctttgcgtgacccaggtcttaatgatgcgaacaacttgggccctgtgtgaagcactcaccttggctacaggccctataagcaccctgtgggaggggaacccgggaagattctggaatactacgatcgccgtgtccatggcgaacatttttaggggctcatacctagccggtgcagggctactcttctctatcatgaagaatacaaccaacactcgccggggaaccggcaatattggtgagacacttggcgaaaaatggaagagtagactgaacgctttggggaagtcggagtttcagatctataaaaagagcggaatacaagaagtcgaccgtactctggccaaagagggcatcaagaggggagaaaccgatcaccatgcagtgtcccgggggtctgctaaactccgctggttcgttgaacgaaacatggtgacacccgagggcaaggtagtggacctgggttgcgggagaggaggctggtcatactattgtggtggccttaaaaatgtcagggaagttaaggggctaacgaagggaggcccagggcacgaggaacctattcccatgagcacctacggatggaacctggtgcggctccagtccggcgtcgatgtgttctttactcctccagagaaatgcgacacactactgtgtgatatcggtgagagttctcccaatcctaccattgaagccgggcgcactttgagagtactgaacctcgtggagaattggcttaacaataacacacagttctgcgttaaggtgctgaatccatatatgcccagcgtcatcgagaaaatggagaccttgcaaaggaagtacggaggcgccctggtgcgaaacccgctctcaagaaattccacgcacgaaatgtactgggtcagtaacgcgaccggcaatatagtgagctctgttaacatgatttcccgtatgttaatcaatagatttacaatgaaacataagaaggctacttatgagcctgacgtagacctggggtcaggaacccgcaacatcggtattgagaacgaaataccaaatcttgatatcattggcaaaaggatcgagaagattaaacaggaacacgagacaagctggcattacgaccaggatcacccctataagacttgggcataccacgggtcgtatgaaaccaaacagacaggatctgccagttccatggtgaacggcgtcgtgaagctgctaaccaagccttgggacgttgtgccaatggtcactcaaatggctatgacggatacaacccccttcggtcagcagcgggtgtttaaagagaaggtagacactagaacccaggagccgaaagaagggacaaagaaactcatgcgcatcacggccgagtggctgtggaaggaattgggaaagaaaaagacccctaggatgtgtactcgagaggagttcacacggaaagtgagaagcaatgcagccctgggcgctatatttaccgatgaaaacaagtggaaatcagcgagggaggccgttgaagactcccgcttctgggagctcgtcgatcgtgaacggaatcttcatctggagggcaagtgcgagacttgtgtgtacaacatgatggggaaaagagaaaagaagttaggagagtttggtaaagcaaagggctctagggctatctggtatatgtggctgggggcccgcttcttggaatttgaggcactcggattcctgaatgaagaccactggtttagccgaggcaacagtctatccggtgtggagggggagggacttcataaactgggctacattctccgggatgtcagcaagaaagaaggcggggccatgtacgctgacgacacagccggatgggataccagaatcacactggaggacttgaagaatgaagagatggttactaaccacatgaagggtgaacataaaaagctggcggaggcaattttcaaactcacctatcaaaataaggtggtaagggtgcagcgccccacgccaagaggcaccgtcatggatatcatttctcggaaagaccagagggggtcaggacaggtgggcacatacggtcttaacactttcaccaatatggaggcccaactgatacgtcagatggaaggggagggaatctttaagagtattcagcgattaacagttactgaagagatcgctgtgcaaaactggctggcccgcgtcggcagagagcggttgtccaggatggcaatcagcggcgatgactgcgtggtaaagcctctcgatgaccgcttcgcttctgccctgaccgctctaaatgatatggggaaagttagaaaggacattcagcagtgggaaccctcgcggggatggaacgattggacacaggtgccattttgctcacaccacttccatgagcttgtcatgaaagacggtagggtgctggtggtcccctgtcgaaaccaagatgaactcataggccgtgccagaatcagccagggggcaggatggtccctgaaggagacagcgtgcttgggcaaaagttatgcccagatgtggaccttaatgtactttcaccgccgggacctgaggctcgctgccaatgcaatttgttctgctgttcctagccattgggtgccaacttccagaacaacctggtcaatccacgccaagcacgaatggatgactaccgaggacatgcttgcagtatggaaccgcgtgtggattcaggagaatccgtggatggaagataagacacccgtcgagagttgggaagaggtgccttatctgggtaaacgggaagaccaatggtgcgggtctctaatcggactgacgagcagggccacctgggcgaagaacatacagactgctatcaatcaggttcgatccctcattggcaacgaggagtacacagattatatgccatcaatgaaaagattccggaaggaagaggaagaggccggcgtgttgtggtga

SEQ ID NO: 14700 - RNA, 9876 nt, synthetic construct
  misc_feature 1..9876: note = derived and/or modified CDS sequence (opt3) from DENV-2__EU687236__SS-prME
  source 1..9876: mol_type = other RNA
accgccggagtgatcattatgctgatacccaccgctatggctttccacctcactacgaggaatggggagcctcatatgatcgtcggaaggcaggaaaagggtaaaagccttctgtttaagaccgaggacggcgttaatatgtgcacgttgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtcgcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttatctgcaagcattctatggtggatagaggctggggtaacgggtgtggactattcggcaagggcgggattgtaacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgacaccgggtgtgtggtttcctggaagaataaagaattgaagtgcggaagcggcatcttcataactgataacgtccacacatggaccgagcagtacaagtttcagcccgaatctccatcaaaactcgctagtgccattcaaaaggcacatgaggaaggtatctgtggcattaggagcgtgactcggctggagaatttaatgtggaaacagatcacccccgagctgaaccacatactatccgaaaatgaggtgaagctcacaatcatgacgggggacattaaaggaatcatgcaggccggcaagcgctctctgagacctcagccaaccgaacttaaatattcgtggaagacttgggggaaggctaaaatgttgagcacagagtcccataaccaaaccttcctgattgatggaccggaaacagccgagtgccccaatactaacagggcatggaactcactcgaggtcgaagactacggctttggtgttttcagtaccaacatctggctgaagttacgtgagaaacaggacgtgttttgtgattctaagctgatgagcgcggctataaaagacaatcgggccgtgcacgcagatatggggtattggattgaatccgcccttaacgacacgtggaagatggagaaggcttcattcatcgagatcaaaagctgccactggcctaagtctcatacattgtggtccaatggagtactcgaaagtgagatgattatccccaagaatttcgccggccccgtcagccagcacaactaccgacctggttatcatacccagactgcaggcccatggcacctggggaagctagaaatggattttgacttctgtgagggaaccacagtggttgtgactgaagattgcggcaatagagggccctctctgaggaccacaacggcttccggaaaactcattaccgagtggtgctgtcgctcatgcactctgccgcctcttcggtacagaggcgaggacggttgttggtacgggatggaaataaggccattgaaggagaaggaagagaacctggtcaatagtttagtgacagccggacatggccaaatcgataactttagcctcggtgttctgggcatggcgcttttcctggaagagatgttgcgcacccgagtggggactaaacacgccattctcctggtagctgtctcgtttgtgacactaatcaccggaaatatgtccttccgggacctgggccgtgtgatggtcatggttggggcaacgatgactgatgacattggaatgggcgtgacctatctcgccctgcttgctgcctttaaggtaagacccacattcgcagcgggtttgctgttaaggaaactcacctctaaggagctgatgatggccactatcgggatagcacttctgagccagtcaacaatccctgaaaccattctagagctcacagatgccctggcattgggaatgatggtgctgaaaatcgtccgcaacatggaaaagtaccagttagctgtgactattatggccatcagttgcgttcccaatgcagtgatactccaaaacgcctggaaggtctcctgtaccattctggctgcggtgtctgttagcccacttctgttgacgtcctcacagcagaaagccgactggatccctctcgcactgacaatcaagggcctaaatcccaccgctatttttctgactacccttagccggacaagtaaaaagagatcttggccactcaacgaggccgtgatggccgtcggcatggtatccatactggctagctcgttgctgaaaaatgacatcccgatgactgggcctttagtggcaggaggtctcctgaccgtttgctatgtgcttacgggcaggtcagccgatctggaattggagaaggcggctgacgtcaaatgggaggatcaggccgaaatttctgggagttcccccatcctcagcattacaatctctgaggacggaagcatgtccataaagaacgaagaggaggaacacaccctgactatcctaattcgaacaggcctgcttgtgatctcaggtgtattcccagtgagtattcccatcaccgcagccgcttggtacctctgggaggtcaagaaacaacgcgcaggggttctgtgggatgtgcctagcccaccccctgtgggaaaggccgaattggaggacggcgcgtatcggataaaacagagaggcatttttgggtactctcagatcggagctggtgtctataaggaaggcactttccatacaatgtggcacgtgaccagaggggccgttttaatgcatcgtggaaaacgcatcgagccgtcctgggcagatgtaaagaaggacctgatttcatacggcggtgggtggaaactcgagggagaatggaaggagggcgaagaggtgcaggtcctggcccttgaaccaggcaaaaatccccgggctgtgcaaacgaagcctgggctgtttaaaactaacaccggaacaatcggtgccgttagtttggatttcagcccaggcacctccgggtctcccatagtggacagaaagggaaaggtcgtgggcctatacggtaatggggtagtcacaaggtcgggagcatatgtgagcgctattgcccagactgagaaatcaatcgaggataaccctgaaattgaggacgatatcttccgaaagaaacggctgaccataatggacctccacccgggcgcgggcaagacgaaacgctacctgcccgccattgttagagaagcaatcaagagggggcttcggacattaatcctggctccaactcgagtggtcgccgctgagatggaagaggcactcagaggattgcctattcgctatcagacccccgccatcagggccgagcatacaggtcgtgaaattgtggacctgatgtgtcacgctacctttactatgcggctcctgtccccagttagagtgcctaactacaatcttataatcatggatgaggcgcacttcaccgaccccgcaagtattgccgctaggggctatatctctacacgcgtcgaaatgggggaggccgcaggaatctttatgacggccactccaccgggcagccgagatcctttcccccagtccaacgctccaattatggacgaggaaagagagatacccgaacggtcatggaactctggtcatgagtgggtgaccgattttaaggggaaaacagtatggttcgtgcctagcatcaaggcgggaaacgacattgccgcatgcctgaggaaaaatggcaagaaagttatccaattgagtcgcaagacctttgattccgaatacgtcaagactcgtgctaacgactgggatttcgtggtgacaaccgacattagcgagatgggcgccaattttagagcagagcgggtcatcgatccaaggcgctgtatgaaacccgtaatactaacggacggggaagaacgagtgatcctggccggacctatgccggttactcactcttcagctgcccagagacggggtaggattggccgcaacccaaagaatgaaaacgaccagtatatctacatgggggagcccctcgaaaatgatgaggactgcgcgcattggaaagaggcaaagatgttactggataacattaatacacctgaaggaatcataccctccatgttcgagccagaaagagagaaagtggacgccattgatggcgaatacaggcttcggggtgaggctcgtaagacctttgtcgacctgatgcgccgaggggatctccctgtgtggttggcctatagagttgctgcagagggcatcaactacgccgacaggcggtggtgtttcgatggaattaaaaataaccaaatcctggaagagaacgtggaagtcgagatatggaccaaggagggcgaacgcaagaaactcaagcccagatggctggacgctaggatctatagtgatccacttgccctaaaagagttcaaggaatttgcagcggggcggaaaagcctgactttgaatttaattacagagatgggacgactgcctaccttcatgacacagaaggccagagacgctctcgataacctggccgtgcttcacactgcagaagtaggtggccgcgcttacaatcacgccctgtcggagctcccggagacgttggaaaccctgctactgctcacacttctggcaactgtgaccgggggaatctttttattcttgatgtctggcaagggtattgggaaaatgacactgggcatgtgctgcatcataaccgcctccattctcctgtggtatgctcagatccagccccattggatcgcggccagcattatccttgagtttttcctgatagttctcttgattccagaacctgagaagcaaaggactccccaggacaaccagctgacgtacgtcgtgatcgcaattttaaccgtggtcgctgccacaatggccaatgaaatgggatttctagagaaaactaagaaagacctgggcctcgggtcaatcaccacacaggagagtgaatctaacatacttgatatcgacctgcggccagcatccgcttggaccttgtatgccgttgcgactacattcgtgacgcctatgctgcgtcacagcattgaaaattcaagtgtaaacgtgagcctcaccgctatcgccaatcaagcaactgtcctgatgggacttggtagaggctggcccctctccaagatggatattggggtgccgctgttggccatcggatgttactctcaggttaacccaattacactgaccgctgcattactactgctcgtggcccattacgcgatcataggccctggtcttcaggctaaggccaccagggaagcacagaaacgcacagccgctgggattatgaagaatcccactgtcgacggcatcacggtaatcgatctggagccaattccctatgaccctaaatttgaaaagcaattgggacaggtgatgctgctcgttctgtgcgtgacccaggtccttatgatgcggacaacttgggccttatgtgaggcactgaccctcgctacaggcccgataagcaccttgtgggaggggaaccccggacgattctggaatactacgatcgccgtgtccatggcgaacatttttagaggctcatacctggccggtgcagggctactgttctctatcatgaaaaatacaaccaacactaggcgcggaaccggcaatattggtgaaacactcggcgagaagtggaagagtcggcttaacgctctggggaaatcggaatttcagatctataagaaaagcggaatacaagaggtcgatagaactttggccaaggagggcatcaaacgtggggaaaccgaccaccatgcagtgtccaggggatctgctaagctgcggtggttcgttgagcgcaacatggtgacaccagaaggcaaagtagtggatctcggttgcgggcgaggaggctggtcatactattgtggtggcctgaagaatgtcagagaggttaaggggttaacgaaaggaggccctgggcacgaagaaccaattcctatgagcacctacggatggaaccttgtgaggctgcagtccggcgtcgacgtgttctttactccacccgagaagtgcgatacactcctatgtgacatcggtgaaagttctcctaatccaaccattgaggccgggcggactctgcgcgtattgaacctggtggaaaattggctcaacaataacacacagttctgcgttaaagtgcttaatccctatatgccgagcgtcatcgagaagatggaaaccctgcaaagaaaatacggaggcgccttggtgaggaaccctctgtcacgaaattccacgcacgagatgtactgggtcagtaacgcgaccggcaatatagtgagctctgttaacatgatttcccggatgctcatcaatcgttttacaatgaagcataagaaagctacttatgagccagatgtagacttagggtcaggaaccagaaacatcggtattgaaaacgagatacccaatctggacatcattggcaagcgcatcgagaaaattaagcaggagcacgaaacaagctggcattacgatcaggaccacccttataaaacttgggcataccacgggtcgtatgagaccaagcagacaggatctgccagttccatggtgaacggcgtcgtgaaacttctgaccaaaccatgggatgttgtgcccatggtcactcaaatggctatgacggacacaaccccgttcggtcagcagagggtgtttaaggagaaagtagatactcggacccaggaacctaaggaggggacgaaaaagctaatgagaatcacagccgaatggctctggaaggagctgggcaaaaagaaaacaccccgcatgtgtactagggaggagttcacaaagaaagtgcgaagcaatgcagccttgggcgctatatttaccgacgagaacaagtggaaatcagcgcgggaagccgttgaggattccagattctgggaactggtcgacagggagcgcaatctccatcttgagggcaagtgcgaaacttgtgtgtacaacatgatggggaagcgtgagaaaaagctgggagaatttggtaaagcaaagggctctcgggctatctggtatatgtggttaggggccagattcctggagtttgaagcattgggattcctcaatgaggatcactggtttagcaggggcaacagtctgtccggtgtggagggggaaggactacataaacttggctacattctgcgcgacgtcagcaagaaggagggcggggccatgtacgctgatgacacagccggatgggacacccgaatcacactcgaagatctgaaaaatgaggaaatggttactaaccacatgaagggtgagcataaaaagttggcggaggcaattttcaaactgacctatcaaaataaggtggtacgggtgcagagaccaacgcctaggggcaccgtcatggacatcatttctcgcaaggatcagagagggtcaggacaggtgggcacatacggtctcaacactttcaccaatatggaagcccaacttatacggcagatggagggggaaggaatctttaaaagtattcagaggctgacagttactgaggagatcgctgtgcaaaactggttagcccgtgtcggccgagaacgcctgtccagaatggcaatcagcggcgacgattgcgtggtaaagcccttggacgatcggttcgcttctgccctcaccgctctgaatgacatggggaaagttaggaaggatattcagcagtgggagccatcgcgcggatggaacgactggacacaggtgcccttttgctcacaccacttccatgagctagtcatgaaagatggtagagtgcttgtggtcccttgtcggaaccaagacgagctgataggcagggcccgaatcagccagggggcaggatggtccctcaaggaaacagcgtgcctgggcaagagttatgcccagatgtggaccttgatgtactttcaccgtagagatttacgcctggctgccaatgcaatttgttctgctgttccaagccattgggtgccgacttcccggacaacctggtcaatccacgccaaacacgagtggatgactaccgaggacatgctcgcagtatggaacagggtgtggattcaggaaaatccctggatggaggacaagacacctgtcgaaagttgggaggaagtgccatatcttggtaaaagagaggatcaatggtgcgggtctctgatcggactaacgagccgcgccacctgggcgaagaacatacagactgctatcaatcaggttcggtccctgattggcaacgaggaatacacagactatatgccctcaatgaaaaggttccgaaaggaggaagaggaagccggcgtgctctggtga

SEQ ID NO: 14701 - RNA, 9876 nt, synthetic construct
  misc_feature 1..9876: note = derived and/or modified CDS sequence (opt3) from DENV-2__EU687237__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgacaccgggtgtgtggtttcctggaagaataaagaattgaagtgcggaagcggcatcttcataactgataacgtccacacatggaccgagcagtacaagtttcagcccgaatctccatcaaaactcgctagtgccattcaaaaggcacatgaggaaggtatctgtggcattaggagcgtgactcggctggagaatttaatgtggaaacagatcacccccgagctgaaccacatactatccgaaaatgaggtgaagctcacaatcatgacgggggacattaaaggaatcatgcaggccggcaagcgctctctgagacctcagccaaccgaacttaaatattcgtggaagacttgggggaaggctaaaatgttgagcacagagtcccataaccaaaccttcctgattgatggaccggaaacagccgagtgccccaatactaacagggcatggaattcactcgaggtcgaagactacggctttggtgttttcagtaccaacatctggctgaagttacgtgagaaacaggacgtgttttgtgattctaagctgatgagcgcggctataaaagacaatcgggccgtgcacgcagatatggggtattggattgaatccgcccttaacgacacgtggaagatggagaaggcttcattcatcgagatcaaaagctgccactggcctaagtctcatacattgtggtccaatggagtactcgaaagtgagatgattatcccaaaaaacttcgccggccccgtcagccagcacaactaccgacctggttatcatacccagactgcaggcccatggcacctggggaagctagaaatggattttgacttctgtgagggaaccacagtggttgtgactgaagattgcggcaatagagggccctctctgaggaccacaacggcttccggaaaactcattaccgagtggtgctgtcgctcatgcactctgccgcctcttcggtacagaggcgaggacggttgttggtacgggatggaaataaggccattgaaggagaaggaagagaacctggtcaatagtttagtgacagccggacatggccaaatcgataactttagcctcggtgttctgggcatggcgcttttcctggaagagatgttgcgcacccgagtggggactaaacacgccattctcctggtagctgtctcgtttgtgacactaatcaccggaaatatgtccttccgggacctgggccgtgtgatggtcatggttggggcaacgatgactgatgacattggaatgggcgtgacctatctcgccctgcttgctgcctttaaggtaagacccacattcgcagcgggtttgctgttaaggaaactcacctctaaggagctgatgatggccactatcgggatagctcttctgagccagtcaacaatccctgaaaccattctagagctcacagatgccctggcattgggaatgatggtgctgaaaatcgtccgcaacatggaaaagtaccagttagctgtgactattatggccatcagttgcgttcccaatgcagtgatactccaaaacgcctggaaggtctcctgtaccattctggctgcggtgtctgttagcccacttctgttgacgtcctcacagcagaaagccgactggatccctctcgcactgacaatcaagggcctaaatcccaccgctatttttctgactacccttagccggacaagtaaaaagagatcttggccactcaacgaggccgtgatggccgtcggcatggtatccatactggctagctcgttgctgaaaaatgacatcccgatgactgggcctttagtggcaggaggtctcctgaccgtttgctatgtgcttacgggcaggtcagccgatctggaattggagcgagcggctgacgtcaagtgggaggatcaggccgaaatttctgggagttcccccatcctcagcattacaatctctgaggacggaagcatgtccataaaaaacgaagaggaggaacacaccctgactatcctaattcgcacaggcctgcttgtgatctcaggtgtattcccagtgagtattcccatcaccgcagccgcttggtacctctgggaggtcaagaagcaacgggcaggggttctgtgggatgtgcctagcccaccccctgtgggaaaagccgaattggaggacggcgcgtatagaataaagcagaggggcatttttgggtactctcagatcggagctggtgtctataaagaaggcactttccatacaatgtggcacgtgacccgtggggccgttttaatgcatcgcggaaagcggatcgagccgtcctgggcagatgtaaaaaaggacctgatttcatacggcggtgggtggaagctcgagggagaatggaaagagggcgaagaggtgcaggtcctggcccttgaaccaggcaagaatcccagagctgtgcaaacgaaacctgggctgtttaagactaacaccggaacaatcggtgccgttagtttggatttcagcccaggcacctccgggtctcccatagtggacaggaaaggaaaggtcgtgggcctatacggtaatggggtagtcacacgatcgggagcatatgtgagcgctattgcccagactgagaagtcaatcgaggataaccctgaaattgaggacgatatcttccggaaaaagcgcctgaccataatggacctccacccgggcgcgggcaaaacgaagagatacctgcccgccattgttagggaagcaatcaaacgggggcttcgaacattaatcctggctccaactagagtggtcgccgctgagatggaagaggcactccgcggattgcctattaggtatcagacccccgccatccgtgccgagcatacaggtcgggaaattgtggacctgatgtgtcacgctacctttactatgagactcctgtccccagttagggtgcctaactacaatcttataatcatggatgaggcgcacttcaccgaccccgcaagtattgccgctcgcggctatatctctacacgagtcgaaatgggggaggccgcaggaatctttatgacggccactccaccgggcagcagagatcctttcccccagtccaacgctccaattatggacgaggaacgggagatacccgaaaggtcatggaattctggtcatgagtgggtgaccgattttaaggggaagacagtatggttcgtgcctagcatcaaagcgggaaacgacattgccgcatgcctgcgcaagaatggcaaaaaggttatccaattgagtcgtaaaacctttgattccgaatacgtcaagactagagctaacgactgggatttcgtggtgacaaccgacattagcgagatgggcgccaattttcgggcagagagggtcatcgatccacgccgatgtatgaagcccgtaatactaacggacggggaagagagagtgatcctggccggacctatgccggttactcactcttcagctgcccagcggaggggtcgcattggcagaaacccaaaaaatgaaaacgaccagtatatctacatgggggagcccctcgaaaatgatgaggactgcgcgcattggaaggaggcaaaaatgttactggataacattaatacacctgaaggaatcataccctccatgttcgagccagaaagggagaaggtggacgccattgatggcgaataccggcttcgtggtgaggctcgcaaaacctttgtcgacctgatgcgaagaggggatctccctgtgtggttggcctatagggttgctgcagagggcatcaactacgccgaccggcgctggtgtttcgatggaattaagaataaccaaatcctggaagagaacgtggaagtcgagatatggaccaaagagggcgaaagaaagaagctcaaacccaggtggctggacgctcggatctatagtgatccacttgccctaaaggagttcaaagaatttgcagcggggcgaaagagcctgactttgaatttaattacagagatgggaagactgcctaccttcatgacacagaaagcccgcgacgctctcgataacctggccgtgcttcacactgcagaagtaggtggcagggcttacaatcacgccctgtcggagctcccggagacgttggaaaccctgctactgctcacacttctggcaactgtgaccgggggaatctttttattcttgatgtctggcaagggtattgggaagatgacactgggcatgtgctgcatcataaccgcctccattctcctgtggtatgctcagatccagccccattggatcgcggccagcattatccttgagtttttcctgatagttctcttgattccagaacctgagaaacaacggactccccaggacaaccagctgacgtacgtcgtgatcgcaattttaaccgtggtcgctgccacaatggccaatgaaatgggatttctagagaagactaaaaaggacctgggcctcgggtcaatcaccacacaggagagtgaatctaacatacttgatatcgacctgcgtccagcatccgcttggaccttgtatgccgttgcgactacattcgtgacgcctatgctgagacacagcattgagaattcaagtgtaaacgtgagcctcaccgctatcgccaatcaagcaactgtcctgatgggacttggtaggggctggcccctctccaaaatggatattggggtgccgctgttggccatcggatgttactctcaggttaacccaattacactgaccgctgcattactactgctcgtggcccattacgcgatcataggccctggtcttcaggctaaggccacccgcgaagcacagaagcggacagccgctgggattatgaaaaatcccactgtcgacggcatcacggtaatcgatctggagccaattccctatgaccctaagtttgaaaaacaattgggacaggtgatgctgctcgttctgtgcgtgacccaggtccttatgatgcgaacaacttgggccttatgtgaggcactgaccctcgctacaggcccgataagcaccttgtgggaggggaaccccggaagattctggaatactacgatcgccgtgtccatggcgaacatttttaggggctcatacctggccggtgcagggctactgttctctatcatgaagaatacaaccaacactcgccggggaaccggcaatattggtgaaacactcggcgagaaatggaagagtagacttaacgctctggggaagtcggaatttcagatctataaaaagagcggaatacaagaggtcgatcgtactttggccaaagagggcatcaagaggggggaaaccgaccaccatgcagtgtcccggggatctgctaaactgcgctggttcgttgagcgaaacatggtgacaccagaaggcaaggtagtggatctcggttgcgggagaggaggctggtcatactattgtggtggcctgaaaaatgtcagggaggttaaggggttaacgaagggaggccctgggcacgaagagcccattcctatgagcacctacggatggaaccttgtgcggctgcagtccggcgtcgacgtgttctttactccacccgagaaatgcgatacactcctatgtgacatcggtgaaagttctcctaatccaaccattgaggccgggcgcactctgagagtattgaacctggtggaaaattggctcaacaataacacacagttctgcgttaaggtgcttaatccctatatgccgagcgtcatcgagaaaatggaaaccctgcaaaggaagtacggaggcgccttggtgcgaaaccctctgtcacggaattccacgcacgagatgtactgggtcagtaacgcgaccggcaatatagtgagctctgttaacatgatttcccgtatgctcatcaatagatttacaatgaaacataagaaggctacttatgagccagatgtagacttagggtcaggaacccgcaacatcggtattgaaaacgagatacccaatctggacatcattggcaaaaggatcgaaaagattaaacaggagcacgaaacaagctggcattacgatcaggaccacccttataagacttgggcataccacgggtcgtatgagaccaaacagacaggatctgccagttccatggtgaacggcgtcgtgaagcttctgaccaagccatgggatgttgtgcccatggtcactcaaatggctatgacggacacaaccccgttcggtcagcagcgggtgtttaaagagaaggtagatactagaacccaggaacctaaagaggggacaaagaaactaatgcgcatcacggccgaatggctctggaaggagctgggaaagaaaaagacccccaggatgtgtactcgagaggaattcacacggaaagtgagaagcaatgcagccttgggcgctatatttaccgacgagaacaagtggaaatcagcgagggaagccgttgaggattcccgcttctgggaactggtcgaccgtgagcggaatctccatcttgagggcaagtgcgaaacttgtgtgtacaacatgatggggaaaagagagaagaagctgggagaatttggtaaagcaaagggctctagggctatctggtatatgtggttaggggcccgcttcctggagtttgaagcattgggattcctcaatgaggatcactggtttagccgaggcaacagtctgtccggtgtggagggggaaggactacataaacttggctacattctgcgggacgtcagcaagaaagagggcggggccatgtacgctgatgacacagccggatgggacaccagaatcacactcgaagatctgaagaatgaggaaatggttactaaccacatgaagggtgagcataaaaagttggcggaggcaattttcaaactgacctatcaaaataaggtggtaagggtgcagcgcccaacgcctagaggcaccgtcatggacatcatttctcggaaagatcagagggggtcaggacaggtgggcacatacggtctcaacactttcaccaatatggaagcccaacttatacgtcagatggagggggaaggaatctttaagagtattcagcgactgacagttactgaggagatcgctgtgcaaaactggttagcccgcgtcggcagagaacggctgtccaggatggcaatcagcggcgacgattgcgtggtaaagcccttggacgatcgcttcgcttctgccctcaccgctctgaatgacatggggaaagttagaaaggatattcagcagtgggagccatcgcggggatggaacgactggacgcaggtgcccttttgctcacaccacttccatgaactagtcatgaaagatggtagggtgcttgtggtcccttgtcgaaaccaagacgagctgataggccgtgccagaatcagccagggggcaggatggtccctcaaggaaacagcgtgcctgggcaaaagttatgcccagatgtggaccttgatgtactttcaccgccgggatttaaggctggctgccaatgcaatttgttctgctgttccaagccattgggtgccgacttccagaacaacctggtcaatccacgccaagcacgagtggatgactaccgaggacatgctcgcagtatggaaccgcgtgtggattcaggaaaatccctggatggaggacaagacacctgtcgaaagttgggaggaagtgccatatcttggtaaacgggaggatcaatggtgcgggtctctgatcggactaacgagcagggccacctgggcgaagaacatacagactgctatcaatcaggttcgatccctgattggcaacgaggaatacacagactatatgccctcaatgaaaagattccggaaggaggaagaggaagccggcgtgctctggtga

SEQ ID NO: 14702 - RNA, 9876 nt, synthetic construct
  misc_feature 1..9876: note = derived and/or modified CDS sequence (opt3) from DENV-2__EU687238__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaaccattacgtggatcggaatgaactccagatctacaagcctgtcagtcagtctcgtgctggttggcgtggtcaccctttatctgggtgtgatggtacaggccgacactgggtgtgtggtttcctggaagaataaagaattgaagtgcggaagcggcattttcatcacagataacgtccacacctggactgagcagtacaagtttcagcccgaatctccatcaaaactcgctagtgccatacaaaaggcacatgaggaaggtatttgtggcatcaggagcgtgacccggctggagaatttaatgtggaaacagattacacccgagctgaaccacatcctatccgaaaatgaggtgaagctcacgataatgaccggggacatcaaaggaattatgcaggccggcaagcgctctctgagacctcagccaactgaacttaaatattcgtggaagacatgggggaaggctaaaatgttgagcaccgagtcccataaccaaacattcctgatcgatggaccggaaactgccgagtgccccaataccaacagggcatggaattcactcgaggtcgaagactacggctttggtgttttcagtacgaacatttggctgaagttacgtgagaaacaggacgtgttttgtgattctaagctgatgagcgcggctatcaaagacaatcgggccgtgcacgcagatatggggtattggatagaatccgcccttaacgacacatggaagatggagaaggcttcattcattgagatcaaaagctgccactggcctaagtctcataccttgtggtccaatggagtactcgaaagtgagatgatcattccaaaaaacttcgccggccccgtcagccagcacaactaccgacctggttatcatactcagaccgcaggcccatggcacctggggaagctagaaatggattttgacttctgtgagggaacaactgtggttgtgaccgaagattgcggcaatagagggccctctctgaggacaacgaccgcttccggaaaactcatcactgagtggtgctgtcgctcatgcacactgccgcctcttcggtacagaggcgaggacggttgttggtacgggatggaaattaggccattgaaggagaaggaagagaacctggtcaatagtttagtgaccgccggacatggccaaatagataactttagcctcggtgttctgggcatggcgcttttcctggaagagatgttgcgcactcgagtggggacaaaacacgccatcctcctggtagctgtctcgtttgtgaccctaattacgggaaatatgtccttccgggacctgggccgtgtgatggtcatggttggggcaactatgaccgatgacatcggaatgggcgtgacatatctcgccctgcttgctgcctttaaggtaagacccaccttcgcagcgggtttgctgttaaggaaactcacttctaaggagctgatgatggccacaattgggatcgctcttctgagccagtcaaccatacctgaaacaatcctagagctcactgatgccctggcattgggaatgatggtgctgaaaattgtccgcaacatggaaaagtaccagttagctgtgaccatcatggccattagttgcgttcccaatgcagtgatcctccaaaacgcctggaaggtctcctgtacgatactggctgcggtgtctgttagcccacttctgttgacatcctcacagcagaaagccgactggattcctctcgcactgaccatcaagggcctaaatcccactgctatctttctgaccacacttagccggactagtaaaaagagatcttggccactcaacgaggccgtgatggccgtcggcatggtatccattctggctagctcgttgctgaaaaatgacataccgatgaccgggcctttagtggcaggaggtctcctgacggtttgctatgtgcttacaggcaggtcagccgatctggaattggagcgagcggctgacgtcaagtgggaggatcaggccgaaatctctgggagttcccccattctcagcatcaccatttctgaggacggaagcatgtccatcaaaaacgaagaggaggaacacactctgacaatactaatccgcaccggcctgcttgtgatttcaggtgtattcccagtgagtatccccattactgcagccgcttggtacctctgggaggtcaagaagcaacgggcaggggttctgtgggatgtgcctagcccaccccctgtgggaaaagccgaattggaggacggcgcgtatagaatcaagcagaggggcatatttgggtactctcagattggagctggtgtctataaagaaggcacattccataccatgtggcacgtgacgcgtggggccgttttaatgcatcgcggaaagcggatcgagccgtcctgggcagatgtaaaaaaggacctgatctcatacggcggtgggtggaagctcgagggagaatggaaagagggcgaagaggtgcaggtcctggcccttgaaccaggcaagaatcccagagctgtgcaaactaaacctgggctgtttaagaccaacacaggaaccattggtgccgttagtttggatttcagcccaggcacatccgggtctcccatcgtggacaggaaaggaaaggtcgtgggcctatacggtaatggggtagtcactcgatcgggagcatatgtgagcgctatagcccagaccgagaagtcaattgaggataaccctgaaatcgaggacgatattttccggaaaaagcgcctgacgatcatggacctccacccgggcgcgggcaaaacaaagagatacctgcccgccatagttagggaagcaattaaacgggggcttcgaactttaatcctggctccaaccagagtggtcgccgctgagatggaagaggcactccgcggattgcctatcaggtatcagacacccgccattcgtgccgagcataccggtcgggaaatcgtggacctgatgtgtcacgctacttttaccatgagactcctgtccccagttagggtgcctaactacaatcttattataatggatgaggcgcacttcacagaccccgcaagtatcgccgctcgcggctatatttctacgcgagtcgaaatgggggaggccgcaggaatctttatgactgccaccccaccgggcagcagagatcctttcccccagtccaacgctccaatcatggacgaggaacgggagattcccgaaaggtcatggaattctggtcatgagtgggtgacagattttaaggggaagaccgtatggttcgtgcctagcataaaagcgggaaacgacatcgccgcatgcctgcgcaagaatggcaaaaaggttattcaattgagtcgtaaaacttttgattccgaatacgtcaagacaagagctaacgactgggatttcgtggtgaccacggacatcagcgagatgggcgccaattttcgggcagagagggtcattgatccacgccgatgtatgaagcccgtaatcctaactgacggggaagagagagtgatactggccggacctatgccggttacacactcttcagctgcccagcggaggggtcgcatcggcagaaacccaaaaaatgaaaacgaccagtatatttacatgggggagcccctcgaaaatgatgaggactgcgcgcattggaaggaggcaaaaatgttactggataacatcaatacccctgaaggaattatcccctccatgttcgagccagaaagggagaaggtggacgccatagatggcgaataccggcttcgtggtgaggctcgcaaaacctttgtcgacctgatgcgaagaggggatctccctgtgtggttggcctatagggttgctgcagagggcattaactacgccgaccggcgctggtgtttcgatggaatcaagaataaccaaattctggaagagaacgtggaagtcgagatctggactaaagagggcgaaagaaagaagctcaaacccaggtggctggacgctcggatatatagtgatccacttgccctaaaggagttcaaagaatttgcagcggggcgaaagagcctgacattgaatttaatcaccgagatgggaagactgcctacattcatgactcagaaagcccgcgacgctctcgataacctggccgtgcttcacacggcagaagtaggtggcagggcttacaatcacgccctgtcggagctcccggagaccttggaaacactgctactgctcactcttctggcaaccgtgacagggggaatttttttattcttgatgtctggcaagggtatcgggaagatgaccctgggcatgtgctgcattatcactgcctccatactcctgtggtatgctcagattcagccccattggatcgcggccagcatcattcttgagtttttcctgatcgttctcttgataccagaacctgagaaacaacggacgccccaggacaaccagctgacctacgtcgtgattgcaatcttaacagtggtcgctgccactatggccaatgaaatgggatttctagagaagaccaaaaaggacctgggcctcgggtcaattacaacccaggagagtgaatctaacatccttgatatagacctgcgtccagcatccgcttggactttgtatgccgttgcgacaacgttcgtgacccctatgctgagacacagcatcgagaattcaagtgtaaacgtgagcctcactgctattgccaatcaagcaacagtcctgatgggacttggtaggggctggcccctctccaaaatggatatcggggtgccgctgttggccattggatgttactctcaggttaacccaatcaccctgaccgctgcattactactgctcgtggcccattacgcgattatcggccctggtcttcaggctaaggccacacgcgaagcacagaagcggactgccgctgggataatgaaaaatcccacggtcgacggcattaccgtaatcgatctggagccaatcccctatgaccctaagtttgaaaaacaattgggacaggtgatgctgctcgttctgtgcgtgacacaggtccttatgatgcgaactacctgggccttatgtgaggcactgacactcgctaccggcccgattagcactttgtgggaggggaaccccggaagattctggaatacgacaatagccgtgtccatggcgaacatctttaggggctcatacctggccggtgcagggctactgttctctattatgaagaataccactaacacccgccggggaacaggcaatatcggtgaaactctcggcgagaaatggaagagtagacttaacgctctggggaagtcggaatttcagatttataaaaagagcggaatccaagaggtcgatcgtaccttggccaaagagggcataaagaggggggaaacagaccaccatgcagtgtcccggggatctgctaaactgcgctggttcgttgagcgaaacatggtgacgccagaaggcaaggtagtggatctcggttgcgggagaggaggctggtcatactattgtggtggcctgaaaaatgtcagggaggttaaggggttaaccaagggaggccctgggcacgaagagcccatccctatgagcacttacggatggaaccttgtgcggctgcagtccggcgtcgacgtgttctttacaccacccgagaaatgcgataccctcctatgtgacattggtgaaagttctcctaatccaactatcgaggccgggcgcacactgagagtattgaacctggtggaaaattggctcaacaataacacccagttctgcgttaaggtgcttaatccctatatgccgagcgtcattgagaaaatggaaacgctgcaaaggaagtacggaggcgccttggtgcgaaaccctctgtcacggaattccacccacgagatgtactgggtcagtaacgcgacaggcaatatcgtgagctctgttaacatgatatcccgtatgctcattaatagatttactatgaaacataagaaggctacctatgagccagatgtagacttagggtcaggaacacgcaacatcggtatcgaaaacgagattcccaatctggacataatcggcaaaaggattgaaaagatcaaacaggagcacgaaactagctggcattacgatcaggaccacccttataagacctgggcataccacgggtcgtatgagacaaaacagaccggatctgccagttccatggtgaacggcgtcgtgaagcttctgactaagccatgggatgttgtgcccatggtcacgcaaatggctatgacagacaccactccgttcggtcagcagcgggtgtttaaagagaaggtagataccagaacacaggaacctaaagaggggacgaagaaactaatgcgcattaccgccgaatggctctggaaggagctgggaaagaaaaagactcccaggatgtgtacacgagaggaattcacccggaaagtgagaagcaatgcagccttgggcgctatctttactgacgagaacaagtggaaatcagcgagggaagccgttgaggattcccgcttctgggaactggtcgaccgtgagcggaatctccatcttgagggcaagtgcgaaacatgtgtgtacaacatgatggggaaaagagagaagaagctgggagaatttggtaaagcaaagggctctagggctatatggtatatgtggttaggggcccgcttcctggagtttgaagcattgggattcctcaatgaggatcactggtttagccgaggcaacagtctgtccggtgtggagggggaaggactacataaacttggctacatcctgcgggacgtcagcaagaaagagggcggggccatgtacgctgatgacaccgccggatgggacacaagaattactctcgaagatctgaagaatgaggaaatggttaccaaccacatgaagggtgagcataaaaagttggcggaggcaatcttcaaactgacgtatcaaaataaggtggtaagggtgcagcgcccaacccctagaggcacagtcatggacattatctctcggaaagatcagagggggtcaggacaggtgggcacttacggtctcaacaccttcacaaatatggaagcccaacttattcgtcagatggagggggaaggaatatttaagagtatccagcgactgactgttaccgaggagattgctgtgcaaaactggttagcccgcgtcggcagagaacggctgtccaggatggcaatcagcggcgacgattgcgtggtaaagcccttggacgatcgcttcgcttctgccctcacggctctgaatgacatggggaaagttagaaaggatatccagcagtgggagccatcgcggggatggaacgactggacacaggtgcccttttgctcacaccacttccatgaactagtcatgaaagatggtagggtgcttgtggtcccttgtcgaaaccaagacgagctgattggccgtgccagaataagccagggggcaggatggtccctcaaggaaaccgcgtgcctgggcaaaagttatgcccagatgtggactttgatgtactttcaccgccgggatttaaggctggctgccaatgcaatctgttctgctgttccaagccattgggtgccgacatccagaaccacttggtcaattcacgccaagcacgagtggatgaccacagaggacatgctcgcagtatggaaccgcgtgtggatccaggaaaatccctggatggaggacaagacgcctgtcgaaagttgggaggaagtgccatatcttggtaaacgggaggatcaatggtgcgggtctctgattggactaaccagcagggccacttgggcgaagaacatccagacagctataaatcaggttcgatccctgatcggcaacgaggaatacaccgactatatgccctcaatgaaaagattccggaaggaggaagaggaagccggcgtgctctggtga

SEQ ID NO: 14703 - RNA, 9876 nt, synthetic construct
  misc_feature 1..9876: note = derived and/or modified CDS sequence (opt3) from DENV-2__EU687240__SS-prME
  source 1..9876: mol_type = other RNA
accgtgggcgtcatcattatgctgatacccacagccatggctttccacctcactacgagaaacggggagcctcatatgatcgttggaaggcaggaaaagggtaaaagccttctgtttaagaccgaggacggcgtgaatatgtgcacattgatggcaattgatttaggggaactgtgtgaggacactatcacctacaaatgcccactactccggcaaaacgaaccggaggatattgactgttggtgcaattccacatctacctgggtaacttatggaacatgtaccacgactggcgagcaccgccgagaaaagcgttcagtggccctggtcccccatgtgggtatggggcttgagaccagaacagaaacttggatgagtagcgagggagcgtggaaacacgttcagaggatcgagacctggatactgcggcatcctggcttcacaatcatggctgccattttggcatacaccatcggcacgactcactttcagcgcgccctcattttcatcctgctgacagctgtggcaccatccatgaccatgagatgcatagggatttctaacagggattttgtcgaaggagtgtcgggtggctcatgggtagacatcgttctcgagcacgggagctgtgtgactacaatggccaagaataagcccaccttagatttcgaactgattaaaacggaggctaagcagcctgccacccttcggaaatattgcatcgaagcgaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggattgtgacctgcgcaatgtttacatgcaaaaagaatatggaaggaaaagtggtcctccctgagaacctggaatacaccatagttatcactccacacagcggtgaggagcatgccgtgggcaatgacacggggaagcacggaaaagaaattaagatcacaccgcagtcctcaataaccgaggctgaacttactggctatggtaccgtaacaatggagtgtagtcccaggaccgggctggatttcaacgaaatggtgttgctccagatggaggacaaagcctggctggtccaccggcaatggtttttagatctgcctctcccatggcttcccggcgcagacactcagggaagcaattggattcagaaggagacactggtgacgttcaagaaccctcatgctaaaaagcaggacgttgtggtcttgggctctcaagaaggggccatgcacaccgcgctaactggagccacagagatccagatgtcctcaggtaatctgctctttaccggccatctgaaatgccgtcttcgcatggataagctgcagttgaaagggatgagctacagtatgtgtacaggaaagttcaagatcgtgaaagaaattgcagagactcaacacggcaccatcgtaattagagttcagtatgagggtgacgggtctccatgcaagatacccttcgaaatcatggatctcgagaaaaggcatgtgctgggccggttaattacggtcaacccgatcgtgaccgaaaaggactcccctgtcaacatcgaggctgaacccccatttggagatagctacattataatcggcgtggagcctgggcagctgaaactaaattggttcaagaagggatcgtctattggtcagatgtttgagacaactatgcgaggcgccaaacgcatggctatcctcggggacaccgcctgggatttcggatccctgggcggtgtttttacatcaattgggaaggcacttcaccaagtgttcggcgccatctacggagctgcgtttagtggcgtaagctggactatgaaaatattgatcggggtcattatcacctggattggaatgaactccagatctacgagcctgtcagtgagtctcgttctggtgggcgtcgtgacactttatctgggtgtaatggtgcaggcagactccgggtgtgttgtcagctggaagaataaagaattgaagtgcggatctggcatcttcataaccgataacgtgcacacttggacagagcagtacaagtttcagcccgaatcaccaagtaaactcgccagcgctattcaaaaggcccatgaggaaggtatctgtggcattaggtccgtgacccggctggagaatttaatgtggaaacagatcactcccgagctgaaccacatactatctgaaaatgaggcaaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgagatcaaatcttgccactggcctaagtcccatacgttgtggagtaatggagtactcgaaagcgagatgattatcccaaaaaacttcgccggccccgtctctcagcacaactaccgacctggttatcatacacagaccgcaggcccatggcacctggggaagctagaaatggattttgacttctgtgagggaactaccgtggttgtgacagaagattgcggcaatagagggccctccctgaggactaccacagcttcaggaaaactcattacggagtggtgctgtcgcagttgcaccctgccgcctcttcggtacagaggcgaggacggttgttggtacgggatggaaataaggccattgaaggagaaggaagagaacctggtcaatagcttagtgactgccggacatggccaaatcgataacttttcgctcggtgttctgggcatggcgcttttcctggaagagatgttgcgcacacgagtggggaccaaacacgccattctcctggtagctgtctcctttgtgactctaatcacaggaaatatgtctttccgggacctgggccgtgtgatggtcatggttggggcaaccatgacggatgacattggaatgggcgtgacttatctcgccctgcttgctgcctttaaggtaagacccaccttcgcagcgggtttgctgttaaggaaactcacaagcaaggagctgatgatggccaccatcgggatagctcttctgtcacagagtactatccctgaaacaattctagagctcaccgatgccctggcattgggaatgatggtgctgaaaatcgtccgcaacatggaaaagtaccagttagctgtgacaattatggccatctcctgcgttcccaatgcagtgatactccaaaacgcctggaaggtctcttgtactattctggctgcggtgagcgtttccccacttctgttgacctcaagccagcagaaagccgactggatccctctcgcactgacgatcaagggcctaaatcccacagctatttttctgaccactcttagtcggacctctaaaaagagatcctggccactcaacgaggccgtgatggccgtcggcatggtaagcatactggcttcgtcattgctgaaaaatgacatcccgatgacagggcctttagtggcaggaggtctcctgactgtttgctatgtgcttaccggcaggtctgccgatctggaattggagcgagcggctgacgtcaagtgggaggatcaggccgaaattagtgggtccagccccatcctctctattacgatcagcgaggacggatccatgtcaataaaaaacgaagaggaggaacacacactgaccatcctaattcgcactggcctgcttgtgatcagtggtgtattcccagtgagcattcccatcacagcagccgcttggtacctctgggaggtcaagaagcaacgggcaggggttctgtgggatgtgccttctccaccccctgtgggaaaagccgaattggaggacggcgcgtatagaataaagcagaggggcatttttgggtactcccagatcggagctggtgtctataaagaaggcaccttccatactatgtggcacgtgacacgtggggccgttttaatgcatcgcggaaagcggatcgagccgtcatgggcagatgtaaaaaaggacctgattagttacggcggtgggtggaagctcgagggagaatggaaagagggcgaagaggtgcaggtcctggcccttgaaccaggcaagaatcccagagctgtgcaaaccaaacctgggctgtttaagacgaacactggaaccatcggtgccgttagcttggatttctccccaggcacatctgggtcgcccatagtggacaggaaaggaaaggtcgtgggcctatacggtaatggggtagtcacccgaagcggagcatatgtgtcagctattgcccagacagagaagtccatcgaggataaccctgaaattgaggacgatatcttccggaaaaagcgcctgactataatggacctccacccgggcgcgggcaaaaccaagagatacctgcccgccattgttagggaagcaatcaaacgggggcttcgaacgttaatcctggctccaacaagagtggtcgccgctgagatggaagaggcactccgcggattgcctattaggtatcagactcccgccatccgtgccgagcataccggtcgggaaattgtggacctgatgtgtcacgctacatttaccatgagactcctgagtccagttagggtgcctaactacaatcttataatcatggatgaggcgcacttcactgaccccgcatctattgccgctcgcggctatatcagcacccgagtcgaaatgggggaggccgcaggaatctttatgacagccacgccaccgggctccagagatcctttcccccagtcaaacgctccaattatggacgaggaacgggagatacccgaaaggtcttggaatagcggtcatgagtgggtgactgattttaaggggaagaccgtatggttcgtgcctagtatcaaagcgggaaacgacattgccgcatgcctgcgcaagaatggcaaaaaggttatccaattgtcccgtaaaacatttgatagcgaatacgtcaagaccagagctaacgactgggatttcgtggtgactacagacatttctgagatgggcgccaattttcgggcagagagggtcatcgatccacgccgatgtatgaagcccgtaatactaaccgacggggaagagagagtgatcctggccggacctatgccggttacgcactcatccgctgcccagcggaggggtcgcattggcagaaacccaaaaaatgaaaacgaccagtatatctacatgggggagcccctcgaaaatgatgaggactgcgcgcattggaaggaggcaaaaatgttactggataacattaatactcctgaaggaatcatacccagtatgttcgagccagaaagggagaaggtggacgccattgatggcgaataccggcttcgtggtgaggctcgcaaaacatttgtcgacctgatgcgaagaggggatctccctgtgtggttggcctatagggttgctgcagagggcatcaactacgccgaccggcgctggtgtttcgatggaattaagaataaccaaatcctggaagagaacgtggaagtcgagatatggaccaaagagggcgaaagaaagaagctcaaacccaggtggctggacgctcggatctatagcgatccacttgccctaaaggagttcaaagaatttgcagcggggcgaaagtcgctgaccttgaatttaattactgagatgggaagactgcctacattcatgacccagaaagcccgcgacgctctcgataacctggccgtgcttcacacagcagaagtaggtggcagggcttacaatcacgccctgtctgagctcccggagactttggaaacgctgctactgctcacccttctggcaacagtgactgggggaatctttttattcttgatgtccggcaagggtattgggaagatgaccctgggcatgtgctgcatcataacagccagcattctcctgtggtatgctcagatccagccccattggatcgcggcctcaattatccttgagtttttcctgatagttctcttgattccagaacctgagaaacaacggaccccccaggacaaccagctgacttacgtcgtgatcgcaattttaacggtggtcgctgccaccatggccaatgaaatgggatttctagagaagacaaaaaaggacctgggcctcgggagtatcactacccaggagtctgaatccaacatacttgatatcgacctgcgtccagcaagcgcttggacattgtatgccgttgcgaccactttcgtgacacctatgctgagacactcaattgagaatagtagcgtaaacgtgtccctcacggctatcgccaatcaagcaaccgtcctgatgggacttggtaggggctggcccctctctaaaatggatattggggtgccgctgttggccatcggatgttacagccaggttaacccaattactctgacagctgcattactactgctcgtggcccattacgcgatcataggccctggtcttcaggctaaggccacccgcgaagcacagaagcggaccgccgctgggattatgaaaaatcccacagtcgacggcatcactgtaatcgatctggagccaattccctatgaccctaagtttgaaaaacaattgggacaggtgatgctgctcgttctgtgcgtgacgcaggtccttatgatgcgaaccacatgggccttatgtgaggcactgactctcgctaccggcccgatatccacattgtgggaggggaaccccggaagattctggaataccactatcgccgtgtcaatggcgaacatttttaggggctcttacctggccggtgcagggctactgttcagtatcatgaagaatacgacaaacacccgccggggaactggcaatattggtgaaaccctcggcgagaaatggaagtcgagacttaacgctctggggaagagcgaatttcagatctataaaaagtccggaatacaagaggtcgatcgtacattggccaaagagggcatcaagaggggggaaactgaccaccatgcagtgtctcggggatcagctaaactgcgctggttcgttgagcgaaacatggtgaccccagaaggcaaggtagtggatctcggttgcgggagaggaggctggagctactattgtggtggcctgaaaaatgtcagggaggttaaggggttaacaaagggaggccctgggcacgaagagcccattcctatgtccacgtacggatggaaccttgtgcggctgcagagtggcgtcgacgtgttctttaccccacccgagaaatgcgatactctcctatgtgacatcggtgaatctagccctaatccaacaattgaggccgggcgcaccctgagagtattgaacctggtggaaaattggctcaacaataacactcagttctgcatcaaggttcttaatccctatatgccgtcagtgatagagaaaatggaaacactgcaaaggaagtacggaggcgccttggtccgaaaccctctgtcccggaatagtacccacgagatgtactgggtgagcaacgcgacgggcaatattgtctcttccgtgaacatgatctcacgtatgctcatcaatagatttaccatgaaacataagaaggctacatatgagccagatgttgacttagggagcggaactcgcaacattggtatagaaaacgagatccccaatctggacattatcggcaaaaggattgaaaagatcaaacaggagcacgaaacctcgtggcattacgatcaggaccacccttataagacatgggcataccacgggtcttatgagactaaacagaccggaagtgcctccagcatggtaaacggcgtggtcaagcttctgacaaagccatgggatgtggttcccatggtgacccaaatggctatgactgacacgacaccgttcggtcagcagcgggtctttaaagagaaggtggataccagaactcaggaacctaaagaggggaccaagaaactaatgcgcataacagccgaatggctctggaaggagctgggaaagaaaaagacgcccaggatgtgtacccgagaggaattcactcggaaagtaagatcaaatgcagccttgggcgctatctttacagacgagaacaagtggaaatccgcgagggaagccgtggaggattctcgcttctgggaactggttgaccgtgagcggaatctccatcttgagggcaagtgcgaaacctgtgtctacaacatgatggggaaaagagagaagaagctgggagaatttggtaaagcaaagggcagcagggctatttggtatatgtggttaggggcccgcttcctggagtttgaagcattgggattcctcaatgaggatcactggtttagtcgaggcaactccctgagcggtgtggagggggaaggactacataaacttggctacatcctgcgggacgtgtctaagaaagagggcggggccatgtacgctgatgacactgccggatgggacacaagaattaccctcgaagatctgaagaatgaggaaatggtcacaaaccacatgaagggtgagcataaaaagttggcggaggcaatcttcaaactgacttatcaaaataaggttgtgagggtacagcgcccaacccctagaggcacggtgatggacattatatcacggaaagatcagagggggagtggacaggtcggcacctacggtctcaacacattcactaatatggaagcccaacttatccgtcagatggagggggaaggaatttttaagtccatccagcgactgaccgtgacagaggagatcgctgttcaaaactggttagcccgcgtgggcagagaacggctgagcaggatggcaatttctggcgacgattgcgtcgtgaagcccttggacgatcgcttcgcttcggccctcactgctctgaatgacatggggaaagtaagaaaggatatacagcagtgggagccatcacggggatggaacgactggacccaggttcccttttgcagccaccacttccatgaactagtgatgaaagatggtagggtccttgtggtgccttgtcgaaaccaagacgagctgatcggccgtgccagaatttcccagggggcaggatggagtctcaaggaaacggcgtgcctgggcaaatcttatgcccagatgtggacattgatgtactttcaccgccgggatttaaggctggctgccaatgcaatctgtagcgctgtcccatcccattgggttccgacctcaagaactacatggagtattcacgccaagcacgagtggatgaccactgaggacatgctcgcagtgtggaaccgcgtatggatccaggaaaatccctggatggaggacaagacccctgtggaatcttgggaggaagtcccatatcttggtaaacgggaggatcaatggtgcgggagcctgataggactaacatccagggccacgtgggcgaagaacatccagaccgctattaatcaggtgcgatcactgatcggcaacgaggaatacactgactatatgcccagcatgaaaagattccggaaggaggaagaggaagccggcgttctctggtga

SEQ ID NO: 14704 - RNA, 9876 nt, synthetic construct
  misc_feature 1..9876: note = derived and/or modified CDS sequence (opt3) from DENV-2__EU687241__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctactccatcggcaccacgcactttcagcgcgctctcattttcatcctgctgactgcagttgccccatctatgacaatgagatgcatagggatttcgaacagggattttgtggaaggagtctcaggtggcagctgggtggacatcgtactcgagcacgggagttgtgttaccactatggctaagaataagcccacattagatttcgaactgaccaaaacggaggccaagcagcctgcgacccttcggaaatattgcattgaagcaaagttgacaaacactaccacagagtcccgctgtccaactcaaggagagccctctctgaatgaagagcaggacaaacgatttatctgcaagcatagcatggtggatagaggctggggtaacgggtgtggactattcggcaagggcgggatcgtcacctgcgccatgtttacatgcaaaaagaatatggaaggaaaagtggtgctccctgagaacctggaatacaccattgtcataactccacactccggtgaggagcatgctgttggcaatgacacggggaagcacggaaaagaaatcaagattacaccgcagtcaagtatcaccgaggccgaacttactggctatggtaccgtgacaatggagtgtagccccaggaccgggctggatttcaacgaaatggtattgctccagatggaggacaaagcatggctggtgcaccggcaatggtttttagatctgcctctcccatggcttcccggcgctgacactcagggatctaattggatacagaaggagacactggtcacgttcaagaaccctcatgccaaaaagcaggacgtggttgtgttgggctcccaagaaggggcgatgcacaccgccctaactggagcaacagagattcagatgtcaagcggtaatctgctctttaccggccatctgaaatgccgtcttcgcatggataagctgcagttgaaagggatgagttactctatgtgtacaggaaagttcaagatcgtcaaagaaatcgctgagactcaacacggcaccattgtgatcagagtacagtatgagggtgacgggtccccatgcaagattcccttcgaaataatggatctcgagaaaaggcatgttctgggccggttaatcacggtgaacccgattgtcaccgaaaaggacagccctgtgaacatcgaggccgaacccccatttggagattcgtacatcattataggcgtcgagcctgggcagctgaaactaaattggttcaagaagggatcttccatcggtcagatgtttgagacaactatgcgaggcgctaaacgcatggccattctcggggacaccgcatgggatttcggatcactgggcggtgtgtttacaagtatcgggaaggcccttcaccaagttttcggcgctatttacggagcggcatttagcggcgtgtcctggactatgaaaatcttgataggggtaatcattacctggatcggaatgaactctagaagcacgtcactgagtgtctccctcgtgctggttggcgtggtcacactttatctgggtgtgatggtacaggccgacaccgggtgtgtggttagctggaagaataaagaattgaagtgcggatctggcattttcatcactgataacgtccacacatggaccgagcagtacaagtttcagcccgaatcaccaagtaaactcgctagcgccatacaaaaggcacatgaggaaggtatttgtggcatcaggtccgtgactcggctggagaatttaatgtggaaacagattacccccgagctgaaccacatcctatctgaaaatgaggtgaagctcacaataatgacgggggacatcaaaggaattatgcaggccggcaagcgctcgctgagacctcagccaaccgaacttaaatatagctggaagacttgggggaaggctaaaatgttgtccacagagtcacataaccaaaccttcctgatcgatggaccggaaacagccgagtgccccaatactaacagggcatggaatagtctcgaggtcgaagactacggctttggtgttttctctaccaacatttggctgaagttacgtgagaaacaggacgtgttttgtgatagcaagctgatgtccgcggctatcaaagacaatcgggccgtgcacgcagatatggggtattggatagaatcagcccttaacgacacgtggaagatggagaaggctagcttcattgagatcaaatcttgccactggcctaagtcccatacattgtggagtaatggagtactcgaaagcgagatgatcattccaaaaaacttcgccggccccgtctctcagcacaactaccgacctggttatcatacccagactgcaggcccatggcacctggggaagctagaaatggattttgacttctgtgagggaaccacagtggttgtgactgaagattgcggcaatagagggccctccctgaggaccacaacggcttcaggaaaactcatcaccgagtggtgctgtcgcagttgcactctgccgcctcttcggtacagaggcgaggacggttgttggtacgggatggaaattaggccattgaaggagaaggaagagaacctggtcaatagcttagtgacagccggacatggccaaatagataacttttcgctcggtgttctgggcatggcgcttttcctggaagagatgttgcgcacccgagtggggactaaacacgccatcctcctggtagctgtctcctttgtgacactaattaccggaaatatgtctttccgggacctgggccgtgtgatggtcatggttggggcaacgatgactgatgacatcggaatgggcgtgacctatctcgccctgcttgctgcctttaaggtaagacccacattcgcagcgggtttgctgttaaggaaactcaccagcaaggagctgatgatggccactattgggatcgctcttctgtcacagagtacaatacctgaaaccatcctagagctcacagatgccctggcattgggaatgatggtgctgaaaattgtccgcactatggaaaagtaccagttagctgtgaccatcatggccatttcctgcgttcccaacgcagtgatcctccaaaatgcctggaaggtctcttgtacgatactggctgcggtgagcgtttccccacttctgttgacatcaagccagcagaaagccgactggattcctctcgcactgaccatcaagggcctaaaccccactgctatctttctgaccacacttagtcggacttctaaaaagagatcctggccactcaatgaggccgtgatggccgtcggcatggtaagcattctggcttcgtcattgctgaaaaacgacataccgatgaccgggcctttagtggcaggaggtctcctgacggtttgctatgtgcttacaggcaggtctgccgatctggaattggagcgagcggctgacgtcaagtgggaggatcaggccgaaatcagtgggtccagccccattctctctatcaccattagcgaggacggatccatgtcaatcaaaaatgaagaggaggaacacactctgacaatactaatccgcaccggcctgcttgtgattagtggtgtattcccagtgagcatccccattactgcagccgcttggtacctctgggaggtcaagaagcaacgggcaggggttctgtgggatgtgccttctccaccccctgtgggaaaagccgaattggaggacggcgcgtatagaatcaagcagaggggcatatttgggtactcccagattggagctggtgtctataaagaaggcacattccataccatgtggcacgtgacgcgtggggccgttttaatgcatcgcggaaagcggatcgagccgtcatgggcagatgtaaaaaaggacctgatcagttacggcggtgggtggaagctcgagggagaatggaaagagggcgaagaggtgcaggtcctggcccttgaaccaggcaagaaccccagagctgtgcaaactaaacctgggctgtttaagaccaatacaggaaccattggtgccgttagcttggatttctccccaggcacatctgggtcgcccatcgtggacaggaaaggaaaggtcgtgggcctatacggtaacggggtagtcactcgaagcggagcatatgtgtcagctatagcccagaccgagaagtccattgaggataatcctgaaatcgaggacgatattttccggaaaaagcgcctgacgatcatggacctccacccgggcgcgggcaaaacaaagagatacctgcccgccatagttagggaagcaattaaacgggggcttcgaactttaatcctggctccaaccagagtggtcgccgctgagatggaagaggcactccgcggattgcctatcaggtatcagacacccgccattcgtgccgagcataccggtcgggaaatcgtggacctgatgtgtcacgctacttttaccatgagactcctgagtccagttagggtgcctaactacaaccttattataatggatgaggcgcacttcacagaccccgcatctatcgccgctcgcggctatattagcacgcgagtcgaaatgggggaggccgcaggaatctttatgactgccaccccaccgggctccagagatcctttcccccagtcaaatgctccaatcatggacgaggaacgggagattcccgaaaggtcttggaacagcggtcatgagtgggtgacagattttaaggggaagaccgtatggttcgtgcctagtataaaagcgggaaatgacatcgccgcatgcctgcgcaagaacggcaaaaaggttattcaattgtcccgtaaaacttttgatagcgaatacgtcaagacaagagctaatgactgggatttcgtggtgaccacggacatctctgagatgggcgccaactttcgggcagagagggtcattgatccacgccgatgtatgaagcccgtaatcctaactgacggggaagagagagtgatactggccggacctatgccggttacacactcatccgctgcccagcggaggggtcgcatcggcagaaatccaaaaaacgaaaatgaccagtatatttacatgggggagcccctcgaaaacgatgaggactgcgcgcattggaaggaggcaaaaatgttactggataatatcaacacccctgaaggaattatccccagtatgttcgagccagaaagggagaaggtggacgccatagatggcgaataccggcttcgtggtgaggctcgcaaaacctttgtcgacctgatgcgaagaggggatctccctgtgtggttggcctatagggttgctgcagagggcattaattacgccgaccggcgctggtgtttcgatggaatcaagaacaatcaaattctggaagagaacgtggaagtcgagatctggactaaagagggcgaaagaaagaagctcaaacccaggtggctggacgctcggatatatagcgatccacttgccctaaaggagttcaaagaatttgcagcggggcgaaagtcgctgacattgaacttaatcaccgagatgggaagactgcctacattcatgactcagaaagcccgcgacgctctcgataatctggccgtgcttcacacggcagaagtaggtggcagggcttacaaccacgccctgtctgagctcccggagaccttggaaacactgctactgctcactcttctggcaaccgtgacagggggaatttttttattcttgatgtccggcaagggtatcgggaagatgaccctgggcatgtgctgcattatcactgccagcatactcctgtggtatgctcagattcagccccattggatcgcggcctcaatcattcttgagtttttcctgatcgttctcttgataccagaacctgagaaacaacggacgccccaggacaatcagctgacctacgtcgtgattgcaatcttaacagtggtcgctgccactatggccaacgaaatgggatttctagagaagaccaaaaaggacctgggcctcgggagtattacaacccaggagtctgaatccaatatccttgatatagacctgcgtccagcaagcgcttggactttgtatgccgttgcgacaacgttcgtgacccctatgctgagacactcaatcgagaacagtagcgtaaatgtgtccctcactgctattgccaaccaagcaacagtcctgatgggacttggtaggggctggcccctctctaaaatggatatcggggtgccgctgttggccattggatgttacagccaggttaatccaatcaccctgaccgctgcattactactgctcgtggcccattacgcgattatcggccctggtcttcaggctaaggccacacgcgaagcacagaagcggactgccgctgggataatgaaaaaccccacggtcgacggcattaccgtaatcgatctggagccaatcccctatgaccctaagtttgaaaaacaattgggacaggtgatgctgctcgttctgtgcgtgacacaggtccttatgatgcgaactacctgggccttatgtgaggcactgacactcgctaccggcccgatttccactttgtgggaggggaatcccggaagattctggaacacgacaatagccgtgtcaatggcgaatatctttaggggctcttacctggccggtgcagggctactgttcagtattatgaagaacaccactaatacccgccggggaacaggcaacatcggtgaaactctcggcgagaaatggaagtcgagacttaatgctctggggaagagcgaatttcagatttataaaaagtccggaatccaagaggtcgatcgtaccttggccaaagagggcataaagaggggggaaacagaccaccatgcagtgtctcggggatcagctaaactgcgctggttcgttgagcgaaacatggtgacgccagaaggcaaggtagtggatctcggttgcgggagaggaggctggagctactattgtggtggcctgaaaaacgtcagggaggttaaggggttaaccaagggaggccctgggcacgaagagcccatccctatgtccacttacggatggaatcttgtgcggctgcagagtggcgtcgacgtgttctttacaccacccgagaaatgcgataccctcctatgtgacattggtgaatctagccctaacccaactatcgaggccgggcgcacactgagagtattgaatctggtggaaaactggctcaataacaatacccagttctgcgttaaggtgcttaacccctatatgccgtcagtcattgagaaaatggaaacgctgcaaaggaagtacggaggcgccttggtgcgaaatcctctgtcccggaacagtacccacgagatgtactgggtcagcaatgcgacaggcaacatcgtgtcttccgttaatatgatatcacgtatgctcattaacagatttactatgaaacataagaaggctacctatgagccagatgtagacttagggagcggaacacgcaatatcggtatcgaaaacgagattcccaacctggacataatcggcaaaaggattgaaaagatcaaacaggagcacgaaacttcgtggcattacgatcaggaccacccttataagacctgggcataccacgggtcttatgagacaaaacagaccggaagtgcctccagcatggtgaatggcgtcgtgaagcttctgactaagccatgggatgttgtgcccatggtcacgcaaatggctatgacagacaccactccgttcggtcagcagcgggtgtttaaagagaaggtagataccagaacacaggaacctaaagaggggacgaagaaactaatgcgcattaccgccgaatggctctggaaggagctgggaaagaaaaagactcccaggatgtgtacacgagaggaattcacccggaaagtgagatcaaacgcagccttgggcgctatctttactgacgagaataagtggaaatccgcgagggaagccgttgaggattctcgcttctgggaactggtcgaccgtgagcggaacctccatcttgagggcaagtgcgaaacatgtgtgtacaatatgatggggaaaagagagaagaagctgggagaatttggtaaagcaaagggcagcagggctatatggtatatgtggttaggggcccgcttcctggagtttgaagcattgggattcctcaacgaggatcactggtttagtcgaggcaattccctgagcggtgtggagggggaaggactacataaacttggctacatcctgcgggacgtctctaagaaagagggcggggccatgtacgctgatgacaccgccggatgggacacaagaattactctcgaagatctgaagaacgaggaaatggttaccaatcacatgaagggtgagcataaaaagttggcggaggcaatcttcaaactgacgtatcaaaacaaggtggtaagggtgcagcgcccaacccctagaggcacagtcatggacattatctcacggaaagatcagagggggagtggacaggtggttacttacggcctcaataccttcacaaacatggaagcccaacttattcgtcagatggagggtgaagggatatttaagtccatccagcgactgactgtgaccgaggagattgctgtccaaaattggttagcccgcgtgggaagagaacggctgagcaggatggcaatctctggcgacgattgcgtagttaagcccttggacgatcgcttcgcttcggccctcacggctctgaacgacatgggcaaagtgagaaaggatatccagcagtgggagccatcacgggggtggaatgactggacacaggtccccttttgcagccaccacttccatgaactagtgatgaaagatggaagggtgcttgtcgttccttgtcgaaaccaagacgagctgattggtcgtgccagaatatcccagggcgcagggtggagtctcaaggaaaccgcgtgcctgggaaaatcttatgcccagatgtggactttgatgtactttcaccgccgggatttaaggctggctgccaacgcaatctgtagcgctgtgccatcccattgggtaccgacatcaagaaccacttggagtattcacgccaagcacgagtggatgaccacagaggacatgctcgcagtgtggaatcgcgtctggatccaggaaaacccctggatggaggacaagacgcctgtggaatcttgggaggaagttccatatcttggcaaacgggaggatcaatggtgcggtagcctgattgggctaacctccagggccacttgggcgaagaatatccagacagctataaaccaggtgcgatcactgatcggaaatgaggaatacaccgactatatgcccagcatgaaaagattccggaaggaggaagaggaagccggcgtcctctggtga

SEQ ID NO: 14705 - RNA, 9876 nt, synthetic construct
  misc_feature 1..9876: note = derived and/or modified CDS sequence (opt3) from DENV-2__EU687242__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgacaccgggtgtgtggtttcctggaagaataaagaattgaagtgcggaagcggcatcttcataactgataacgtccacacatggaccgagcagtacaagtttcagcccgaatctccatcaaaactcgctagtgccattcaaaaggcacatgaggaaggtatctgtggcattaggagcgtgactcggctggagaatttaatgtggaaacagatcacccccgagctgaaccacatactatccgaaaatgaggtgaagctcacaatcatgacgggggacattcgcggaatcatgcaggccggcaaaagatctctgaggcctcagccaaccgaacttaagtattcgtggaaaacttgggggaaggctaagatgttgagcacagagtcccataaccaaaccttcctgattgatggaccggaaacagccgagtgccccaatactaaccgtgcatggaattcactcgaggtcgaagactacggctttggtgttttcagtaccaacatctggctgaaattacgggagaagcaggacgtgttttgtgattctaaactgatgagcgcggctataaaggacaatcgagccgtgcacgcagatatggggtattggattgaatccgcccttaacgacacgtggaaaatggagaaggcttcattcatcgagatcaagagctgctactggcctaaatctcacacattgtggtccaatggagtactcgaaagtgagatgattatcccaaagaacttcgccggccccgtcagccagcataactatagacctggttaccacacccagactgcaggcccatggcatctggggaaactagaaatggattttgacttctgtgagggaaccacagtggttgtgactgaagattgcggcaatagggggccctctctgcgcaccacaacggcttccggaaagctcattaccgagtggtgctgtcggtcatgcactctgccgcctcttagatacaggggcgaggacggttgttggtatgggatggaaatacgcccattgaaagagaaggaagagaacctggtcaatagtttagtgacagccggacacggccaaatcgataactttagcctcggtgttctgggcatggcgcttttcctggaagagatgttgcgaacccgggtggggactaagcatgccattctcctggtagctgtctcgtttgtgacactaatcaccggaaatatgtccttccgtgacctgggcagagtgatggtcatggttggggcaacgatgactgatgacattggaatgggcgtgacctacctcgccctgcttgctgcctttaaagtaaggcccacattcgcagcgggtttgctgttacgcaagctcacctctaaagagctgatgatggccactatcgggatagctcttctgagccagtcaacaatccctgaaaccattctagagctcacagatgccctggcattgggaatgatggtgctgaagatcgtccggaacatggaaaaatatcagttagctgtgactattatggccatcagttgcgttcccaatgcagtgatactccaaaacgcctggaaggtctcctgtaccattctggctgcggtgtctgttagcccacttctgttgacgtcctcacagcagaaggccgactggatccctctcgcactgacaatcaaaggcctaaatcccaccgctatttttctgactacccttagcagaacaagtaagaaaaggtcttggccactcaacgaggccgtgatggccgtcggcatggtatccatactggctagctcgttgctgaagaatgacatcccgatgactgggcctttagtggcaggaggtctcctgaccgtttgctacgtgcttacgggccgatcagccgatctggaattggagcgcgcggctgacgtcaaatgggaggatcaggccgaaatttctgggagttcccccatcctcagcattacaatctctgaggacggaagcatgtccataaagaacgaagaggaggaacacaccctgactatcctaattcggacaggcctgcttgtgatctcaggtgtattcccagtgagtattcccatcaccgcagccgcttggtatctctgggaggtcaaaaagcaaagagcaggggttctgtgggatgtgcctagcccaccccctgtgggaaaggccgaattggaggacggcgcgtacaggataaaacagcgtggcatttttgggtattctcagatcggagctggtgtctacaaggaaggcactttccacacaatgtggcatgtgacccgcggggccgttttaatgcaccggggaaaaagaatcgagccgtcctgggcagatgtaaagaaagacctgatttcatacggcggtgggtggaagctcgagggagaatggaaggagggcgaagaggtgcaggtcctggcccttgaaccaggcaaaaatcccagggctgtgcaaacgaagcctgggctgtttaaaactaacaccggaacaatcggtgccgttagtttggatttcagcccaggcacctccgggtctcccatagtggaccgaaagggaaaagtcgtgggcctatatggtaatggggtagtcacacggtcgggagcatacgtgagcgctattgcccagactgagaagtcaatcgaggataaccctgaaattgaggacgatatcttccgcaagaaaagactgaccataatggacctccatccgggcgcgggcaagacgaaaaggtatctgcccgccattgttcgggaagcaatcaagcgagggcttagaacattaatcctggctccaactcgcgtggtcgccgctgagatggaagaggcactcaggggattgcctattcgttaccagacccccgccatccgggccgagcacacaggtagagaaattgtggacctgatgtgtcatgctacctttactatgaggctcctgtccccagttcgcgtgcctaactataatcttataatcatggatgaggcgcacttcaccgaccccgcaagtattgccgctcgaggctacatctctacaagagtcgaaatgggggaggccgcaggaatctttatgacggccactccaccgggcagccgggatcctttcccccagtccaacgctccaattatggacgaggaaagggagatacccgaacgctcatggaattctggtcacgagtgggtgaccgattttaaagggaagacagtatggttcgtgcctagcatcaaggcgggaaacgacattgccgcatgcctgcgtaaaaatggcaagaaagttatccaattgagtagaaagacctttgattccgaatatgtcaaaactcgggctaacgactgggatttcgtggtgacaaccgacattagcgagatgggcgccaattttagggcagagcgcgtcatcgatccacgaagatgtatgaagcccgtaatactaacggacggggaagagcgggtgatcctggccggacctatgccggttactcattcttcagctgcccagaggcgcggtagaattggcaggaacccaaagaatgaaaacgaccagtacatctacatgggggagcccctcgaaaatgatgaggactgcgcgcactggaaagaggcaaagatgttactggataacattaatacacctgaaggaatcataccctccatgttcgagccagaacgggagaaagtggacgccattgatggcgaatatcgtcttcgcggtgaggctcgaaagacctttgtcgacctgatgagaaggggggatctccctgtgtggttggcctaccgggttgctgcagagggcatcaactatgccgaccgcagatggtgtttcgatggaattaaaaataaccaaatcctggaagagaacgtggaagtcgagatatggaccaaggagggcgaaaggaaaaagctcaagccccggtggctggacgctcgaatctacagtgatccacttgccctaaaagagttcaaggaatttgcagcggggagaaaaagcctgactttgaatttaattacagagatgggacgcctgcctaccttcatgacacagaaggccagggacgctctcgataacctggccgtgcttcatactgcagaagtaggtggccgggcttataatcacgccctgaacgagctcccggagacgttggaaaccctgctactgctcacacttctggcaactgtgaccgggggaatctttttattcttgatgtcgggcaaaggtattgggaagatgacactgggcatgtgctgcatcataaccgcctctattctcctgtggtacgctcagatccagccccactggatcgcggcctccattatccttgagtttttcctgatagttctcttgattccagaacctgagaagcaacgtactccccaggacaatcagctgacgtatgtcgtgatcgcaattttaaccgtggtcgctgccacaatggccaacgaaatgggatttctagagaaaactaagaaagacctgggcctcgggagcatcaccacacaggagtcagaaagtaatatacttgatatcgacctgagaccagcatctgcttggaccttgtacgccgttgcgactacattcgtgacgcctatgctgaggcattccattgagaacagctcagtaaatgtgagtctcaccgctatcgccaaccaagcaactgtcctgatgggacttggtcgcggctggcccctcagcaagatggatattggggtgccgctgttggccatcggatgttactcccaggttaatccaattacactgaccgctgcattactactgctcgtggcccactatgcgatcataggccctggtcttcaggctaaagccacccgggaagcacagaagcgaacagccgctgggattatgaagaaccccactgtcgacggcatcacggtaatcgatctggagccaattccctacgaccctaaatttgaaaagcaattgggacaggtgatgctgctcgttctgtgcgtgacccaggtccttatgatgagaacaacttgggccttatgtgaggcactgaccctcgctacaggcccgatatctaccttgtgggaggggaatcccggaaggttctggaacactacgatcgccgtgagcatggcgaatatttttcgcggctcctatctggccggtgcagggctactgttctcaatcatgaaaaacacaaccaatactcggagaggaaccggcaacattggtgaaacactcggcgagaagtggaaatctcgtcttaacgctctggggaagagtgaatttcagatctacaagaaatcgggaatacaagaggtcgataggactttggccaaggagggcatcaaacggggggaaaccgaccatcacgcagtgagccgcggatccgctaagctgcgatggttcgttgagagaaatatggtgacaccagaaggcaaagtagtggatctcggttgcgggaggggaggctggtcttattactgtggtggcctgaagaacgtccgggaggttaaagggttaacgaagggaggccctgggcatgaagagcccattcctatgtcaacctatggatggaatcttgtgcgcctgcagagcggcgtcgacgtgttctttactccacccgagaagtgcgatacactcctatgtgacatcggtgaatccagtcctaacccaaccattgaggccgggagaactctgagggtattgaatctggtggaaaactggctcaataacaatacacagttctgcgttaaagtgcttaacccctacatgccgtctgtcatcgagaagatggaaaccctgcaacgaaaatacggaggcgccttggtgcggaatcctctgagccgtaactcaacgcacgagatgtattgggtctccaatgcgaccggcaacatagtgagtagcgttaatatgatttctagaatgctcatcaaccgctttacaatgaagcacaaaaaggctacttacgagccagatgtagacttagggtccggaaccaggaacatcggtattgaaaatgagatacccaacctggacatcattggcaagcggatcgaaaaaattaagcaggagcatgaaacatcatggcactatgatcaggaccatccttacaaaacttgggcatatcacgggagctacgagaccaagcagacaggatcggcctctagtatggtgaatggcgtcgtgaaacttctgaccaagccatgggatgttgtgcccatggtcactcaaatggctatgacggacacaaccccgttcggtcagcagagagtgtttaaggagaaagtagatactcgcacccaggaacctaaggaggggacaaaaaagctaatgaggatcacggccgaatggctctggaaagagctgggaaagaagaaaaccccccgaatgtgtactcgggaggaattcacaagaaaggtgaggtccaacgcagccttgggcgctatatttaccgacgagaataaatggaagagcgcgcgcgaagccgttgaggattcacgtttctgggaactggtcgaccgggagagaaacctccaccttgagggcaaatgcgaaacttgtgtgtataatatgatggggaagagggagaaaaagctgggagaatttggtaaggcaaaaggctcccgcgctatctggtacatgtggttaggggcccgattcctggagtttgaagcattgggattcctcaacgaggatcattggttttctcggggcaatagcctgagtggtgtggagggggaaggactacacaagcttggctacattctgagagacgtctccaaaaaggagggcggggccatgtatgctgatgacacagccggatgggacaccaggatcacactcgaagatctgaaaaacgaggaaatggttactaatcatatgaagggtgagcacaagaaattggcggaggcaattttcaagctgacctaccaaaacaaagtggtacgcgtgcagagaccaacgcctcggggcaccgtcatggacatcattagcaggaaggatcagcgtgggtctggacaggtgggcacatatggtctcaatactttcaccaacatggaagcccaacttatacgacagatggagggggaaggaatctttaaatcaattcagcgcctgacagttactgaggagatcgctgtgcaaaattggttagccagagtcggccgggaaaggctgagtcgcatggcaatctccggcgacgattgcgtggtaaagcccttggacgatagattcgctagcgccctcaccgctctgaacgacatggggaaggttcggaaagatattcagcagtgggagccatctaggggatggaacgactggacgcaggtgcccttttgctcgcatcacttccacgaactagtcatgaaggatggtcgagtgcttgtggtcccttgtcgtaatcaagacgagctgataggcagagcccgcatctcacagggggcaggatggagcctcaaagaaacagcgtgcctgggcaagtcctacgcccagatgtggaccttgatgtattttcatcggagggatttaagactggctgccaacgcaatttgtagtgctgttccatctcactgggtgccgactagccgcacaacctggtccatccatgccaaacacgagtggatgactaccgaggacatgctcgcagtatggaatcgggtgtggattcaggaaaacccctggatggaggacaagacacctgtcgaatcatgggaggaagtgccataccttggtaagagggaggatcaatggtgcgggagtctgatcggactaacgtctcgagccacctgggcgaaaaatatacagactgctatcaaccaggttagaagcctgattggcaatgaggaatatacagactacatgccctccatgaagcggttcaggaaagaggaagaggaagccggcgtgctctggtga

SEQ ID NO: 14706 - RNA, 9876 nt, synthetic construct
  misc_feature 1..9876: note = derived and/or modified CDS sequence (opt3) from DENV-2__EU687243__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgacaccgggtgtgtggtttcctggaagaataaagaattgaagtgcggaagcggcatcttcataactgataacgtccacacatggaccgagcagtacaagtttcagcccgaatctccatcaaaactcgctagtgccattcaaaaggcacatgaggaaggtatctgtggcattaggagcgtgactcggctggagaatttaatgtggaaacagatcacccccgagctgaaccacatactatccgaaaatgaggtgaagctcacaatcatgacgggggacattcgcggaatcatgcaggccggcaaaagatctctgaggcctcagccaaccgaacttaagtattcgtggaaaacttgggggaaggctaagatgttgagcacagagtcccataaccaaaccttcctgattgatggaccggaaacagccgagtgccccaatactaaccgtgcatggaattcactcgaggtcgaagactacggctttggtgttttcagtaccaacatctggctgaaattacgggagaagcaggacgtgttttgtgattctaaactgatgagcgcggctataaaggacaatcgagccgtgcacgcagatatggggtattggattgaatccgcccttaacgacacgtggaaaatggagaaggcttcattcatcgagatcaagagctgccactggcctaaatctcatacattgtggtccaatggagtactcgaaagtgagatgattatcccaaagaacttcgccggccccgtcagccagcacaactacagacctggttatcatacccagactgcaggcccatggcacctggggaaactagaaatggattttgacttctgtgagggaaccacagtggttgtgactgaagattgcggcaatagggggccctctctgcgcaccacaacggcttccggaaagctcattaccgagtggtgctgtcggtcatgcactctgccgcctcttagatacaggggcgaggacggttgttggtacgggatggaaatacgcccattgaaagagaaggaagagaacctggtcaatagtttagtgacagccggacatggccaaatcgataactttagcctcggtgttctgggcatggcgcttttcctggaagagatgttgcgaacccgggtggggactaagcacgccattctcctggtagctgtctcgtttgtgacactaatcaccggaaatatgtccttccgtgacctgggcagagtgatggtcatggttggggcaacgatgactgatgacattggaatgggcgtgacctatctcgccctgcttgctgcctttaaagtaaggcccacattcgcagcgggtttgctgttacgcaagctcacctctaaagagctgatgatggccactatcgggatagctcttctgagccagtcaacaatccctgaaaccattctagagctcacagatgccctggcattgggaatgatggtgctgaagatcgtccggaacatggaaaaataccagttagctgtgactattatggccatcagttgcgttcccaatgcagtgatactccaaaacgcctggaaggtctcctgtaccattctggctgcggtgtctgttagcccacttctgttgacgtcctcacagcagaaggccgactggatccctctcgcactgacaatcaaaggcctaaatcccaccgctatttttctgactacccttagcagaacaagtaagaaaaggtcttggccactcaacgaggccgtgatggccgtcggcatggtatccatactggctagctcgttgctgaagaatgacatcccgatgactgggcctttagtggcaggaggtctcctgaccgtttgctatgtgcttacgggccgatcagccgatctggaattggagcgcgcggctgacgtcaaatgggaggatcaggccgaaatttctgggagttcccccatcctcagcattacaatctctgaggacggaagcatgtccataaagaacgaagaggaggaacacaccctgactatcctaattcggacaggcctgcttgtgatctcaggtgtattcccagtgagtattcccatcaccgcagccgcttggtacctctgggaggtcaaaaagcaaagagcaggggttctgtgggatgtgcctagcccaccccctgtgggaaaggccgaattggaggacggcgcgtataggataaaacagcgtggcatttttgggtactctcagatcggagctggtgtctataaggaaggcactttccatacaatgtggcacgtgacccgcggggccgttttaatgcatcggggaaaaagaatcgagccgtcctgggcagatgtaaagaaagacctgatttcatacggcggtgggtggaagctcgagggagaatggaaggagggcgaagaggtgcaggtcctggcccttgaaccaggcaaaaatcccagggctgtgcaaacgaagcctgggctgtttaaaactaacaccggaacaatcggtgccgttagtttggatttcagcccaggcacctccgggtctcccatagtggaccgaaagggaaaagtcgtgggcctatacggtaatggggtagtcacacggtcgggagcatatgtgagcgctattgcccagactgagaagtcaatcgaggataaccctgaaattgaggacgatatcttccgcaagaaaagactgaccataatggacctccacccgggcgcgggcaagacgaaaaggtacctgcccgccattgttcgggaagcaatcaagcgagggcttagaacattaatcctggctccaactcgcgtggtcgccgctgagatggaagaggcactcaggggattgcctattcgttatcagacccccgccatccgggccgagcatacaggtagagaaattgtggacctgatgtgtcacgctacctttactatgaggctcctgtccccagttcgcgtgcctaactacaatcttataatcatggatgaggcgcacttcaccgaccccgcaagtattgccgctcgaggctatatctctacaagagtcgaaatgggggaggccgcaggaatctttatgacggccactccaccgggcagccgggatcctttcccccagtccaacgctccaattatggacgaggaaagggagatacccgaacgctcatggaattctggtcatgagtgggtgaccgattttaaagggaagacagtatggttcgtgcctagcatcaaggcgggaaacgacattgccgcatgcctgcgtaaaaatggcaagaaagttatccaattgagtagaaagacctttgattccgaatacgtcaaaactcgggctaacgactgggatttcgtggtgacaaccgacattagcgagatgggcgccaattttagggcagagcgcgtcatcgatccacgaagatgtatgaagcccgtaatactaacggacggggaagagcgggtgatcctggccggacctatgccggttactcactcttcagctgcccagaggcgcggtagaattggcaggaacccaaagaatgaaaacgaccagtatatctacatgggggagcccctcgaaaatgatgaggactgcgcgcattggaaagaggcaaagatgttactggataacattaatacacctgaaggaatcataccctccatgttcgagccagaacgggagaaagtggacgccattgatggcgaataccgtcttcgcggtgaggctcgaaagacctttgtcgacctgatgagaaggggggatctccctgtgtggttggcctatcgggttgctgcagagggcatcaactacgccgaccgcagatggtgtttcgatggaattaaaaataaccaaatcctggaagagaacgtggaagtcgagatatggaccaaggagggcgaaaggaaaaagctcaagccccggtggctggacgctcgaatctatagtgatccacttgccctaaaagagttcaaggaatttgcagcggggagaaaaagcctgactttgaatttaattacagagatgggacgcctgcctaccttcatgacacagaaggccagggacgctctcgataacctggccgtgcttcacactgcagaagtaggtggccgggcttacaatcacgccctgaacgagctcccggagacgttggaaaccctgctactgctcacacttctggcaactgtgaccgggggaatctttttattcttgatgtcgggcaaaggtattgggaagatgacactgggcatgtgctgcatcataaccgcctctattctcctgtggtatgctcagatccagccccattggatcgcggcctccattatccttgagtttttcctgatagttctcttgattccagaacctgagaagcaacgtactccccaggacaatcagctgacgtacgtcgtgatcgcaattttaaccgtggtcgctgccacaatggccaacgaaatgggatttctagagaaaactaagaaagacctgggcctcgggagcatcaccacacaggagtcagaaagtaatatacttgatatcgacctgagaccagcatctgcttggaccttgtatgccgttgcgactacattcgtgacgcctatgctgaggcactccattgagaacagctcagtaaatgtgagtctcaccgctatcgccaaccaagcaactgtcctgatgggacttggtcgcggctggcccctcagcaagatggatattggggtgccgctgttggccatcggatgttactcccaggttaatccaattacactgaccgctgcattactactgctcgtggcccattacgcgatcataggccctggtcttcaggctaaagccacccgggaagcacagaagcgaacagccgctgggattatgaagaaccccactgtcgacggcatcacggtaatcgatctggagccaattccctatgaccctaaatttgaaaagcaattgggacaggtgatgctgctcgttctgtgcgtgacccaggtccttatgatgagaacaacttgggccttatgtgaggcactgaccctcgctacaggcccgatatctaccttgtgggaggggaatcccggaaggttctggaacactacgatcgccgtgagcatggcgaatatttttcgcggctcctacctggccggtgcagggctactgttctcaatcatgaaaaacacaaccaatactcggagaggaaccggcaacattggtgaaacactcggcgagaagtggaaatctcgtcttaacgctctggggaagagtgaatttcagatctataagaaatcgggaatacaagaggtcgataggactttggccaaggagggcatcaaacggggggaaaccgaccaccatgcagtgagccgcggatccgctaagctgcgatggttcgttgagagaaatatggtgacaccagaaggcaaagtagtggatctcggttgcgggaggggaggctggtcttactattgtggtggcctgaagaacgtccgggaggttaaagggttaacgaagggaggccctgggcacgaagagcccattcctatgtcaacctacggatggaatcttgtgcgcctgcagagcggcgtcgacgtgttctttactccacccgagaagtgcgatacactcctatgtgacatcggtgaatccagtcctaacccaaccattgaggccgggagaactctgagggtattgaatctggtggaaaactggctcaataacaatacacagttctgcgttaaagtgcttaacccctatatgccgtctgtcatcgagaagatggaaaccctgcaacgaaaatacggaggcgccttggtgcggaatcctctgagccgtaactcaacgcacgagatgtactgggtctccaatgcgaccggcaacatagtgagtagcgttaatatgatttctagaatgctcatcaaccgctttacaatgaagcataaaaaggctacttatgagccagatgtagacttagggtccggaaccaggaacatcggtattgaaaatgagatacccaacctggacatcattggcaagcggatcgaaaaaattaagcaggagcacgaaacatcatggcattacgatcaggaccacccttataaaacttgggcataccacgggagctatgagaccaagcagacaggatcggcctctagtatggtgaatggcgtcgtgaaacttctgaccaagccatgggatgttgtgcccatggtcactcaaatggctatgacggacacaaccccgttcggtcagcagagagtgtttaaggagaaagtagatactcgcacccaggaacctaaggaggggacaaaaaagctaatgaggatcacggccgaatggctctggaaagagctgggaaagaagaaaaccccccgaatgtgtactcgggaggaattcacaagaaaggtgaggtccaacgcagccttgggcgctatatttaccgacgagaataaatggaagagcgcgcgcgaagccgttgaggattcacgtttctgggaactggtcgaccgggagagaaacctccatcttgagggcaaatgcgaaacttgtgtgtacaatatgatggggaagagggagaaaaagctgggagaatttggtaaggcaaaaggctcccgcgctatctggtatatgtggttaggggcccgattcctggagtttgaagcattgggattcctcaacgaggatcactggttttctcggggcaatagcctgagtggtgtggagggggaaggactacataagcttggctacattctgagagacgtctccaaaaaggagggcggggccatgtacgctgatgacacagccggatgggacaccaggatcacactcgaagatctgaaaaacgaggaaatggttactaatcacatgaagggtgagcataagaaattggcggaggcaattttcaagctgacctatcaaaacaaagtggtacgcgtgcagagaccaacgcctcggggcaccgtcatggacatcattagcaggaaggatcagcgtgggtctggacaggtgggcacatacggtctcaatactttcaccaacatggaagcccaacttatacgacagatggagggggaaggaatctttaaatcaattcagcgcctgacagttactgaggagatcgctgtgcaaaattggttagccagagtcggccgggaaaggctgagtcgcatggcaatctccggcgacgattgcgtggtaaagcccttggacgatagattcgctagcgccctcaccgctctgaacgacatggggaaggttcggaaagatattcagcagtgggagccatctaggggatggaacgactggacgcaggtgcccttttgctcgcaccacttccatgaactagtcatgaaggatggtcgagtgcttgtggtcccttgtcgtaatcaagacgagctgataggcagagcccgcatctcacagggggcaggatggagcctcaaagaaacagcgtgcctgggcaagtcctatgcccagatgtggaccttgatgtactttcaccggagggatttaagactggctgccaacgcaatttgtagtgctgttccatctcattgggtgccgactagccgcacaacctggtccatccacgccaaacacgagtggatgactaccgaggacatgctcgcagtatggaatcgggtgtggattcaggaaaacccctggatggaggacaagacacctgtcgaatcatgggaggaagtgccatatcttggtaagagggaggatcaatggtgcgggagtctgatcggactaacgtctcgagccacctgggcgaaaaatatacagactgctatcaaccaggttagaagcctgattggcaatgaggaatacacagactatatgccctccatgaagcggttcaggaaagaggaagaggaagccggcgtgctctggtga

SEQ ID NO: 14707 - RNA, 9876 nt, synthetic construct
  misc_feature 1..9876: note = derived and/or modified CDS sequence (opt3) from DENV-2__EU687245__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgacaccgggtgtgtggtttcctggaagaataaagaattgaagtgcggaagcggcatcttcataactgataacgtccacacatggaccgagcagtacaagtttcagcccgaatctccatcaaaactcgctagtgccattcaaaaggcacatgaggaaggtatctgtggcattaggagcgtgactcggctggagaatttaatgtggaaacagatcacccccgagctgaaccacatactatccgaaaatgaggtgaagctcacaatcatgacgggggacattaaaggaatcatgcaggccggcaagcgctctctgagacctcagccaaccgaacttaaatattcgtggaagacttgggggaaggctaaaatgttgagcacagagtcccataaccaaaccttcctgattgatggaccggaaacagccgagtgccccaatactaacagggcatggaattcactcgaggtcgaagactacggctttggtgttttcagtaccaacatctggctgaagttacgtgagaaacaggacgtgttttgtgattctaagctgatgagcgcggctataaaagacaatcgggccgtgcacgcagatatggggtattggattgaatccgcccttaacgacacgtggaagatggagaaggcttcattcatcgagatcaaaagctgccactggcctaagtctcatacattgtggtccaatggagtactcgaaagtgagatgattatcccaaaaaacttcgccggccccgtcagccagcacaactaccgacctggttatcatacccagactgcaggcccatggcacctggggaagctagaaatggattttgacttctgtgagggaaccacagtggttgtgactgaagattgcggcaatagagggccctctctgaggaccacaacggcttccggaaaactcattaccgagtggtgctgtcgctcatgcactctgccgcctcttcggtacagaggcgaggacggttgttggtacgggatggaaataaggccattgaaggagaaggaagagaacctggtcaatagtttagtgacagccggacatggccaaatcgataactttagcctcggtgttctgggcatggcgcttttcctggaagagatgttgcgcacccgagtggggactaaacacgccattctcctggtagctgtctcgtttgtgacactaatcaccggaaatatgtccttccgggacctgggccgtgtgatggtcatggttggggcaacgatgactgatgacattggaatgggcgtgacctatctcgccctgcttgctgcctttaaggtaagacccacattcgcagcgggtttgctgttaaggaaactcacctctaaggagctgatgatggccactatcgggatagctcttctgagccagtcaacaatccctgaaaccattctagagctcacagatgccctggcattgggaatgatggtgctgaaaatcgtccgcaacatggaaaagtaccagttagctgtgactattatggccatcagttgcgttcccaatgcagtgatactccaaaacgcctggaaggtctcctgtaccattctggctgcggtgtctgttagcccacttctgttgacgtcctcacagcagaaagccgactggatccctctcgcactgacaatcaagggcctaaatcccaccgctatttttctgactacccttagccggacaagtaaaaagagatcttggccactcaacgaggccgtgatggccgtcggcatggtatccatactggctagctcgttgctgaaaaatgacatcccgatgactgggcctttagtggcaggaggtctcctgaccgtttgctatgtgcttacgggcaggtcagccgatctggaattggagcgagcggctgacgtcaagtgggaggatcaggccgaaatttctgggagttcccccatcctcagcattacaatctctgaggacggaagcatgtccataaaaaacgaagaggaggaacacaccctgactatcctaattcgcacaggcctgcttgtgatctcaggtgtattcccagtgagtattcccatcaccgcagccgcttggtacctctgggaggtcaagaagcaacgggcaggggttctgtgggatgtgcctagcccaccccctgtgggaaaagccgaattggaggacggcgcgtatagaataaagcagaggggcatttttgggtactctcagatcggagctggtgtctataaagaaggcactttccatacaatgtggcacgtgacccgtggggccgttttaatgcatcgcggaaagcggatcgagccgtcctgggcagatgtaaaaaaggacctgatttcatacggcggtgggtggaagctcgagggagaatggaaagagggcgaagaggtgcaggtcctggcccttgaaccaggcaagaatcccagagctgtgcaaacgaaacctgggctgtttaagactaacaccggaacaatcggtgccgttagtttggatttcagcccaggcacctccgggtctcccatagtggacaggaaaggaaaggtcgtgggcctatacggtaatggggtagtcacacgatcgggagcatatgtgagcgctattgcccagactgagaagtcaatcgaggataaccctgaaattgaggacgatatcttccggaaaaagcgcctgaccataatggacctccacccgggcgcgggcaaaacgaagagatacctgcccgccattgttagggaagcaatcaaacgggggcttcgaacattaatcctggctccaactagagtggtcgccgctgagatggaagaggcactccgcggattgcctattaggtatcagacccccgccatccgtgccgagcatacaggtcgggaaattgtggacctgatgtgtcacgctacctttactatgagactcctgtccccagttagggtgcctaactacaatcttataatcatggatgaggcgcacttcaccgaccccgcaagtattgccgctcgcggctatatctctacacgagtcgaaatgggggaggccgcaggaatctttatgacggccactccaccgggcagcagagatcctttcccccagtccaacgctccaattatggacgaggaacgggagatacccgaaaggtcatggaattctggtcatgagtgggtgaccgattttaaggggaagacagtatggttcgtgcctagcatcaaagcgggaaacgacattgccgcatgcctgcgcaagaatggcaaaaaggttatccaattgagtcgtaaaacctttgattccgaatacgtcaagactagagctaacgactgggatttcgtggtgacaaccgacattagcgagatgggcgccaattttcgggcagagagggtcatcgatccacgccgatgtatgaagcccgtaatactaacggacggggaagagagagtgatcctggccggacctatgccggttactcactcttcagctgcccagcggaggggtcgcattggcagaaacccaaaaaatgaaaacgaccagtatatctacatgggggagcccctcgaaaatgatgaggactgcgcgcattggaaggaggcaaaaatgttactggataacattaatacacctgaaggaatcataccctccatgttcgagccagaaagggagaaggtggacgccattgatggcgaataccggcttcgtggtgaggctcgcaaaacctttgtcgacctgatgcgaagaggggatctccctgtgtggttggcctatagggttgctgcagagggcatcaactacgccgaccggcgctggtgtttcgatggaattaagaataaccaaatcctggaagagaacgtggaagtcgagatatggaccaaagagggcgaaagaaagaagctcaaacccaggtggctggacgctcggatctatagtgatccacttgccctaaaggagttcaaagaatttgcagcggggcgaaagagcctgactttgaatttaattacagagatgggaagactgcctaccttcatgacacagaaagcccgcgacgctctcgataacctggccgtgcttcacactgcagaagtaggtggcagggcttacaatcacgccctgaacgagctcccggagacgttggaaaccctgctactgctcacacttctggcaactgtgaccgggggaatctttttattcttgatgtcgggcaagggtattgggaagatgacactgggcatgtgctgcatcataaccgcctctattctcctgtggtatgctcagatccagccccattggatcgcggcctccattatccttgagtttttcctgatagttctcttgattccagaacctgagaaacaacggactccccaggacaatcagctgacgtacgtcgtgatcgcaattttaaccgtggtcgctgccacaatggccaacgaaatgggatttctagagaagactaaaaaggacctgggcctcgggagcatcaccacacaggagtcagaaagtaatatacttgatatcgacctgcgtccagcatctgcttggaccttgtatgccgttgcgactacattcgtgacgcctatgctgagacactccattgagaacagctcagtaaatgtgagtctcaccgctatcgccaaccaagcaactgtcctgatgggacttggtaggggctggcccctcagcaaaatggatattggggtgccgctgttggccatcggatgttactcccaggttaatccaattacactgaccgctgcattactactgctcgtggcccattacgcgatcataggccctggtcttcaggctaaggccacccgcgaagcacagaagcggacagccgctgggattatgaaaaaccccactgtcgacggcatcacggtaatcgatctggagccaattccctatgaccctaagtttgaaaaacaattgggacaggtgatgctgctcgttctgtgcgtgacccaggtccttatgatgcgaacaacttgggccttatgtgaggcactgaccctcgctacaggcccgatatctaccttgtgggaggggaatcccggaagattctggaacactacgatcgccgtgagcatggcgaatatttttaggggctcctacctggccggtgcagggctactgttctcaatcatgaagaacacaaccaatgctcgccggggaactggcaacattggtgaaaccctcggcgagaaatggaagtctagacttaacgccctggggaagagtgaatttcagatctataaaaagtcgggaatacaagaggtcgatcgtacattggcaaaagagggcatcaagaggggggaaactgaccaccatgctgtgagccggggatccgccaaactgcgctggttcgttgagcgaaatatggtgaccccagaaggcaaggtagtggatctcggttgcgggagaggaggctggtcttactattgtggtggcctgaaaaacgtcagggaggttaaggggttaacaaagggaggccctgggcacgaagagcccattcctatgtcaacgtacggatggaatcttgtgcggctgcagagcggcgtcgacgtgttctttaccccacccgagaaatgcgatactctcctatgtgacatcggtgaatccagtcctaacccaacaattgaggccgggcgcaccctgagagtattgaatctggtggaaaactggctcaataacaatactcagttctgcgttaaggtgcttaacccctatatgccgtctgtcatcgagaaaatggaaacactgcaaaggaagtacggaggcgcgttggtgcgaaatcctctgagccggaactcaacccacgagatgtactgggtctccaatgctacgggcaacatagtgagtagcgttaatatgatttctcgtatgctcatcaacagatttaccatgaaacataagaaggcaacatatgagccagatgtagacttagggtccggaactcgcaacatcggtattgaaaatgagatacccaacctggacatcattggcaaaaggatcgaaaagattaaacaggagcacgaaacctcatggcattacgatcaggaccacccttataagacatgggcctaccacgggagctatgagactaaacagaccggatcggcttctagtatggtgaatggcgtcgtgaagcttctgacaaagccatgggatgttgtgcccatggtcacccaaatggccatgactgacacgacaccgttcggtcagcagcgggtgtttaaagagaaggtagataccagaactcaggaacctaaagaggggaccaagaaactaatgcgcatcacagcagaatggctctggaaggagctgggaaagaaaaagacgcccaggatgtgtacccgagaggaattcactcggaaagtgagatccaacgccgctttgggcgcgatatttacagacgagaataagtggaaaagcgccagggaagcagttgaggattcacgcttctgggaactggtcgaccgtgagcggaacctccatcttgagggcaagtgcgaaacctgtgtgtacaatatgatggggaaaagagagaagaagctgggagaatttggtaaagctaagggctccagggccatctggtatatgtggttaggggcacgcttcctggagtttgaagccttgggattcctcaacgaggatcactggttttctcgaggcaatagcctgagtggtgtggagggggaaggactacataaacttggctacattctgcgggacgtctccaagaaagagggcggggctatgtacgccgatgacactgcgggatgggacacaagaatcaccctcgaagatctgaagaacgaggaaatggttacaaatcacatgaagggtgagcataaaaagttggcagaggccattttcaaactgacttatcaaaacaaggtggtaagggtgcagcgcccaaccagcagaggcacggtcatggacatcatttctcggaaagatcagagggggtcaggacaggtgggcacctacggtctcaatacattcactaacatggaagctcaacttatacgtcagatggagggggaaggaatctttaagagtattcagcgactgaccgttacagaggagatcgccgtgcaaaattggttagcacgcgtcggcagagaacggctgtccaggatggctatcagcggcgacgattgcgtggtaaagcctttggacgatcgcttcgcctctgctctcactgccctgaacgacatggggaaagttagaaaggatattcagcagtgggagccctcgcggggatggaacgactggacccaggtgccattttgctcacaccacttccatgaactagtcatgaaagatggtagggtgcttgtggtcccctgtcgaaatcaagacgagctgataggccgtgcaagaatcagccagggggcgggatggtccctcaaggaaacggcctgcctgggcaaaagttatgctcagatgtggacattgatgtactttcaccgccgggatttaaggctggccgcaaacgctatttgttctgccgttcctagccattgggtgccaacctccagaactacatggtcaatccacgcaaagcacgagtggatgaccactgaggacatgctcgccgtatggaatcgcgtgtggattcaggaaaacccgtggatggaggacaagacccccgtcgaaagttgggaggaagtgccttatcttggtaaacgggaggatcaatggtgcgggtctctgatcggactaacaagcagggcgacgtgggctaagaatatacagaccgccgttaaccaggtgcgatccctgatcggcaatgaggaatacactgactatatgccatcaatgaaaagattccggaaggaggaagaggaagcaggcgtcctctggtga

SEQ ID NO: 14708 - RNA, 9873 nt, synthetic construct
  misc_feature 1..9873: note = derived and/or modified CDS sequence (opt3) from DENV-2__HQ541798__SS-prME
  source 1..9873: mol_type = other RNA
accgccggcatgatcttcatgctgattccaacagtgatggcttttcacctcactacgaggaacggggagcctcatatgatagtcagcaggcaggaaaagggaaaatcccttctgttcaagaccggtgacggcgttaatatgtgcacattgatggcaatggatttaggggagctgtgtgaagacactatcacctacaaatgcccacttctccggcaaaacgagccggaagatattgactgttggtgcaattctacatcaacctgggtgacttatggaacatgtaccacgactggcgagcaccgccgagagaagcgtagtgtcgccctggtgccccatgtcggtatggggcttgaaaccagaacagagacttggatgagctccgaaggagcgtggaaacacgctcagaggatcgagacctggattctgcggcatcctggctttacaatcatggccgcaatattggcctacaccatcggcacgactcacttccagcgcgctctcatttttatcctgctgacagcagtggccccatctatgaccatgagatgcattgggatctcgaacagggatttcgttgagggagtgtcaggtggcagctgggtcgacatagtgctcgaacacgggagttgtgtaactacaatggctaagaataagcccaccttagattttgagctgattaaaacggaagccaagcagtccgcgacccttcggaaatattgcatcgaggcaaagttgacaaacactaccacagaatctcgctgtcctactcaaggagagccaagcctgaatgaggaacaggacaaacgattcgtttgcaagcattccatggtggatagaggctggggtaacgggtgtggactatttggcaagggcgggattgtaacctgcgccatgttcacatgcaaaaaggacatgaaaggagaggtggtgcagcccgaaaatctcgagtacaccatcgtcatcactcctcactcaggtgaagaacatgctgttggcaacgatacggggaagcacggaaaagagattaagataacaccacagagtagcatcaccgaagccgagctgactggctatggtaccgtgacaatggaatgttctccgaggaccgggcttgactttaatgagatggtactgttgcaaatggaaaacaaagcatggctcgtgcaccggcagtggttcctggatttacccctgccttggctcccaggcgctgacactcagggatccaattggattcagaaggagacacttgtcacgtttaagaacccccatgccaaaaagcaagacgtggttgtgctgggctcacaggagggggcgatgcacaccgccttgactggagcaacagaaatccagatgagcagtggtaatctactgttcaccggccatctcaaatgccgtctgcgcatggataaacttcaactgaaagggatgtcttactccatgtgtacaggaaagttcaaggtcgtgaaagagatagctgaaactcagcacggcaccattgtaatcagagttcagtatgagggtgacgggagcccttgcaagatcccatttgagattatggatttggagaagaggcatgtgctcggccggctgatcacggtcaaccccattgtgaccgagaaggactcgccggtcaacatagaagccgagcctcccttcggagattcttacatcattatcggcgtggaaccagggcagttaaaactgaattggtttaagaagggatcctcaatcggtcaaatgctagagacaactatgcgaggcgctaaacgcatggccattctcggggacaccgcatgggatttcggaagtctgggcggtgtttttacaagcatagggaaggcccttcaccaggtgttcggcgctatctacggagcggcattttccggcgtatcttggactatgaaaattttgatcggggtcattatcacctggataggaatgaacagcagatcaacgagtctgtccgtgagcctcgttctggtgggcgtcgtgacactttatctgggtgtaatggtgcaggccgactctgggtgtgttgtctcatggaagaataaagagttgaagtgcggaagtggcatcttcattaccgataacgtgcacacttggacagaacagtacaagtttcaacctgagagcccctccaaactcgcttctgccatccagaaggcacatgaagagggtatttgtggcatcaggtcggtgacccggctggaaaatttaatgtggaaacagataactccagagctgaaccacattctaagcgagaatgaagtcaagctcaccatcatgacaggggacattaaaggaatcatgcaggccggcaagcgctccctgagaccccaacctacggagcttaaatattcatggaagacctgggggaaggctaaaatgttgagtactgaatctcataaccagacattcctgatagatggaccagagaccgccgaatgcccgaatacaaacagggcatggaatagcctcgaggttgaggactacggctttggtgtgttcactaccaacatctggctgaagttacgtgaaaaacaggacgtgttttgtgattccaagctgatgtcagcggctattaaagacaatcgggccgtacacgcagatatggggtattggatcgagagcgcccttaacgacacgtggaagattgaaaaggcttctttcatcgaggtcaaatcctgccactggcccaagcctcatacattgtggagtaatgaggtgctcgaaagcgagatgataattcccaagaacttcgccggacccgtttctcagcacaactaccgacctggctatcatacccaaactgcaggtccatggcacctgggcaagctagaaatggattttgacttctgtgaggggaccacagtggtcgtgactgaagattgcggaaatagaggcccctccctgaggaccacaacggcttcagggaaactcatcaccgagtggtgctgtcgcagttgcactctgccgcctcttcggtacagaggagaggacggctgttggtacggtatggaaatcaggccattgaaggagaaggaagagaacctggttaatagcttagtgacagccgggcatggacagattgataacttttcgctcggcgtactgggtatggcgcttttcctggaagagatgttgcgcacccgagtcggcactaaacacgccatcctcctggtggctgtgtcctttgtcacactaattaccgggaatatgtctttccgggacctgggacgtgttatggtgatggtaggcgcaacgatgactgatgacatagggatgggagtgacctatctcgccctgcttgctgcctttaaggtcagacccacattcgcagcgggcttgctgttaaggaaactcaccagcaaggagctgatgatgactacaatcggtattgtgcttctgtcacagagtaccatccctgaaacaattctagagctcactgatgccctggctttggggatgatggttctgaaaatggtgcgcaagatggaaaagtaccaattagccgtcaccatcatggcaatactctgcgtgcccaacgctgttatcctgcagaatgcctggaaagtgtcctgtacgattcttgcagtcgtatctgtgagcccactgtttttgacatcctcacagcagaaggccgactggatccctctcgctctgaccattaaaggactaaaccccactgcgatcttcctgaccacacttagccggactaataagaaaagaagttggccactcaacgaggccataatggcagttggcatggtgtctattctggcttccagcttgctgaagaatgacatcccgatgaccggccctttagtcgccgggggactcctgacggtgtgctatgtacttacaggtaggtcggccgatctggaattggagcgagctgcagacgtgaaatgggaggatcaagccgaaatctcaggctctagtcccattctctccataaccatcagcgaggacgggtctatgagcattaagaacgaagaggaggaacagactctgacaatcctaattcgcaccggactgcttgtcatctccggcctctttccagtttcactgcccataactgcggctgcctggtacttgtgggaggtgaagaaacagcgggccggtgtgttatgggatgtccctagtccaccccctgtggggaaggccgaactggaggacggagcttatagaatcaaacagaagggcattctcggctacagccaaatcggggcaggagtttataaagaaggtacattccacaccatgtggcatgtaacgaggggcgccgtgctgatgcacaaggggaagcgtattgagccgtcttgggcggatgtcaaaaaggaccttatctcctacggaggcggttggaaactggagggggaatggaaggagggagaagaggtgcaggttttggctctagaaccaggcaaaaatccccgcgccgtgcagactaagcctggcctgtttaagaccaacgcagggacaataggagccgtctcactcgatttcagtccaggtaccagcggctcccccattatcgacaaaaaggggaaagtggtaggactgtacggcaatggtgtcgtgacacggtctggggcttatgtttcggccatcgcacagactgaaaagagcattgaggataaccctgaaatcgaggacgatatattcagaaaaaggaaacttaccattatggacttacatccgggagctggcaagacgaagcgatacctgcccgccatcgtgcgggaagcgattaagcgcggcctcagaacattgatcctggccccaactagggtcgtggcagctgagatggaagaggccctccgggggctgcctatacgatatcaaacccccgctattagagcagagcacacaggacgcgaaatcgttgaccttatgtgtcatgccacctttactatgaggctgttgtcaccagtgcgtgtccctaactacaatctaatcattatggatgaggcccacttcaccgaccccgcttccatcgcggcacggggttatattagtacaagagtggaaatgggcgaggccgctgggatatttatgacggccactccaccgggatctagggatcctttcccccagagcaacgcaccaatcatggacgaggaacgcgagattcccgaacgatcctggtcatctggccacgagtgggtaaccgattttaaaggtaagacagtgtggttcgttcctagcatcaaagccgggaatgacatcgctgcgtgcctgagaaagaacggaaagaaagtcattcagctcagtcggaagacctttgattccgaatacgtgaaaactaggacaaatgactgggatttcgtggtcaccacggacataagcgagatgggcgccaactttaaggcagagcgcgtaatcgatccacgtagatgtatgaaacccgtgattttaactgacggcgaagaacgggttatcctggctgggcctatgccggtgacacattcttcagccgcacaaaggcgcggacgaattggtagaaatccaaagaacgaaaatgaccagtatatctacatgggcgagccccttgaaaacgatgaggactgcgcccactggaaagaggctaagatgctgctcgataatataaacacccctgaagggatcattccctccatgttcgagccagaacgggagaaggtcgacgccatcgatggagaatacaggttgcgcggcgaggcgagaaaaacctttgtggacctgatgaggcggggtgatctccctgtttggctggcatatcgtgtggccgctgaggggattaattacgccgaccgccgatggtgtttcgatggcatcaagaacaatcagatacttgaagagaacgtcgaagtggagatttggactaaagagggagaaagaaagaaactaaagcccaggtggctggacgctcggatctatagtgatccattggcattaaaggagttcaaagaatttgccgctggccgcaagagcctgacactctcgctgattaccgagatggggagacttcctacattcatgactcagaaagccagggacgcactggataacctcgcggtattgcatacggccgaagctggaggtcgggcctacaatcacgcactgtctgagctaccggagaccctggaaacactccttctgttaactttgctggctaccgtgacaggcgggatctttctcttcctgatgtccggacgaggcataggtaagatgacccttgggatgtgctgcatcattactgccagcatcctgctctggtatgcacaaattcagccccactggatcgccgcttcaataattttggagtttttcctgatcgttttactaatcccagaacctgagaaacagagaacgccccaggacaaccaactgacctacgtcgtgattgcgatcctcacagtggtcgccgcaactatggctaatgaaatgggctttcttgagaagaccaagaaagacctgggattgggcagtataacaacccagcagccagagtctaacattctggatatcgacctccgccctgcctccgcctggactctgtatgcagttgctacaacgttcgtgacccccatgcttaggcatagcattgaaaattcaagtgtaaacgtgagcctcactgccatcgcgaatcaggctacagtcctgatggggttgggaaagggttggccgctgtccaaaatggatataggcgtgccattactagccatcgggtgttactctcaagttaaccctattaccctgaccgcagccctctttcttctggtggctcactacgcaatcattggacccggcttgcaggccaaggcgacacgggaggctcagaaacgtgccgcagccggtatcatgaagaatccaactgtcgacgggattacggtaatcgatctggaccccataccttatgatccgaagttcgaaaaacagctcggccaagtgatgctgcttgttttatgcgtgacccaggtcctgatgatgagaacaacttgggctctctgtgaggccttgaccctggcaacaggacccattagcaccctatgggaaggcaacccagggaggttttggaatactacgatcgctgtgtccatggccaacatcttccgcggatcatacctggcgggcgccggtctcctattttctattatgaagaatacaaccaacactcggcgagggaccggaaatataggcgagacactgggtgagaaatggaagagtagattgaacgcactgggcaaatcggagttccagatctataagaaaagcgggattcaagaggtcgacaggactctcgctaaggaaggaatcaagcgcggcgagaccgatcatcacgccgtgtcccgggggtctgcaaaactgagatggttcgttgagcgtaatatggtgacacctgaaggaaaggtagtggacttaggctgcggtagaggagggtggtcatactattgtggcggtcttaaaaacgtccgggaggttaagggcctgacgaaagggggacccggccatgaggaacctattccaatgagcacctacgggtggaacctcgtgcgcctacagtccggagtcgatgtgtttttcactccccctgaaaagtgcgacacactgttgtgtgatatcggcgagagttctccaaatcccaccgtagaggctggtcgaactctgagagtgctcaaccttgttgaaaattggctgaacaataacacacagttttgcataaaggtgttgaatccgtatatgcctagcgtcatcgagaaaatggaagccctgcagaggaagtacgggggagccctcgtgcggaacccattatcacgcaattccacccacgagatgtactgggtcagtaacgcgagcggcaatattgtgtcttccgttaacatgatctcaagaatgctgattaataggttcacgatgcgacacaaaaaggctacctatgaacccgacgtagaccttggcagcgggacacggaacatcggaatagagtcggagattcctaatctggatatcatcggtaaacgtattaagataaagcaagaacatgagacttcttggcactacgaccaggatcatccatataaaacctgggcataccacggcagttatgaaacaaagcagactgggtccgccagctcaatggtgaacggagtcgtgagactactcaccaaaccctgggacgttgtgccgatggtcacacagatggctatgaccgatactacgccttttggccaacagcgcgtgttcaaggagaaagtagacacaaggacccaggaacccaaggagggtactaagaaactgatgaagatcaccgccgagtggttgtggaaagaactggggaagaaaaagacaccacggatgtgtacgagagaggaatttacccgcaaagtgaggtccaacgcagccctcggagctattttcactgatgagaataagtggaagtctgcgcgagaggccgttgaagacagccggttttgggagcttgtcgataaagaaagaaacctgcacttagagggcaagtgcgaaacatgtgtgtacaatatgatgggcaaaagggagaagaaactgggggagttcggaaaggcaaagggtagtcgcgctatctggtatatgtggttgggcgcccgttttctcgagttcgaggcactggggtttctaaacgaagaccattggttctcccgggagaatagcctttctggagtggaaggcgagggtctgcacaaactcgggtacattctgagagatgtctcaaagaaagagggaggcgccatgtacgctgacgacaccgccggctgggatactaggatcacattggaagacctgaagaacgaggaaatggttaccaatcatatggagggggaacacaaaaagctcgcggaggcaatattcaaacttacatatcagaacaaagtggtacgcgtgcaacgacctactccccggggaaccgtcatggatatcattagtagaagggaccagcgcggttccggccaggtggggacgtacggactgaatacctttacaaacatggaggcccaattaatcagacagatggaaggcgagggtgttttcaagagcattcagcatctgactgtgaccgaagagatcgctgtccagaattggttggcccgggtggggagggagcgtctctctcgaatggcaatttcgggagatgactgcgtagttaaaccactggatgaccgctttgcttcagccctaacagctcttaacgatatgggcaaggtgagaaaagacatacaacagtgggaacccagccggggctggaatgattggactcaggtccctttctgctcccaccactttcatgagctgatcatgaaggacgggagggtgctcgtggtcccatgtcgcaaccaggatgaactgattgggagagcacggatcagtcaaggtgcaggctggtctttgagggagaccgcgtgcttaggaaagagctatgcccagatgtggtccctgatgtacttccaccgacgtgacctcagacttgctgccaatgcaatctgttcagctgttccgagtcattgggtgcccacgtctcgcacaacctggagcattcacgccaaacacgaatggatgactgcagaggacatgctgacagtatggaaccgggtgtggatacaggagaacccttggatggaagataagaccccagtcgagtcctgggaagagatcccctatctaggaaaaagggaagaccagtggtgcggctcactgattggtctcactagcagagccacctgggcgaagaatatccaaacagctattaaccaggtgcgctctttgatcgggaatgaggagtacacggattatatgccttccatgaaacggtttaggcgagaagaggaagaggccggagttctgtggtga

SEQ ID NO: 14709 - RNA, 9876 nt, synthetic construct
  misc_feature 1..9876: note = derived and/or modified CDS sequence (opt3) from DENV-2__JF730053__SS-prME
  source 1..9876: mol_type = other RNA
accgccggcatgatcattatgctgatacccacagtgatggctttccacctcactacgagaaacggggagcctcatatgatcgtcagcaggcaggaaaagggaaaatcccttctgtttaagaccggtgacggcgttaatatgtgcacattgatggcaatggatttaggggagctgtgtgaagacactattacctacaaatgcccactactccggcaaaacgagccggaagatatcgactgttggtgcaattctacatcaacctgggtgacttatggaacatgtaccacgactggcgagcaccgccgagagaagcgtagtgtagccctggtgccccatgtcggtatggggcttgaaaccagaacagagacttggatgagctccgaaggagcgtggaaacacgctcagaggattgagacctggatcctgcggcatcctggcttcacaataatggccgcaatcttggcctacaccattggcacgactcactttcagcgcgctctcatcttcattctgctgacagcagtggccccatctatgaccatgagatgcatcgggatatcgaacagggattttgttgagggagtgtcaggtggcagctgggtcgacattgtgctcgaacacgggagttgtgtaactacaatggctaagaataagcccaccttagatttcgagctgatcaaaacggaagccaagcagtccgcgacccttcggaaatattgcattgaggcaaagttgacaaacactaccacagaatctcgctgtcctactcaaggagagccaagcctgaatgaggaacaggacaaacgatttgtttgcaagcattccatggtggatagaggctggggtaacgggtgtggactattcggcaagggcgggatcgtcacctgcgccatgtttacatgcaaaaagaatatgaaaggaaaggtggtgcagcccgagaacctcgaatacaccatcgtcattactcctcactcaggtgaggaacatgctgttggcaatgacacggggaaacacggaaaggagataaaaatcacaccacagagtagcattaccgaggccgaactgactggctatggtaccgtgacaatggagtgttctccgaggaccgggcttgatttcaacgaaatggtactgttgcaaatggagaataaggcatggctcgtgcaccggcagtggtttctggacttacccctgccttggctcccaggcgctgatactcagggatccaactggatccagaaggaaacacttgtcacgttcaaaaatccccatgccaagaaacaagacgtggttgtgctgggctcacaggagggggcgatgcacaccgccttgactggagcaacagagatacagatgagcagtggtaacctactgtttaccggccatctcaagtgccgtctgcgcatggacaaacttcaactgaaggggatgtcttactccatgtgtacaggaaagttcaaagtcgtgaaggaaattgctgagactcagcacggcaccatcgtaatcagagttcagtatgaaggtgatgggagcccttgcaaaattccattcgagatcatggacttggagaagaggcatgtgctcggccggctgattacggtcaaccccatagtgaccgaaaaagattcgccggtcaatatcgaggccgaacctccctttggagactcttacattatcatcggcgtggagccagggcagttaaagctgaactggttcaagaaaggatcctcaattggtcaaatgctagaaacaactatgcgaggcgctaagcgcatggccatactcggggataccgcatgggactttggaagtctgggcggtgttttcacaagcatcgggaaagcccttcaccaggtgtttggcgctatttacggagcggcattctccggcgtatcttggactatgaagatcttgattggggtcatcataacctggatcggaatgaatagcagatcaacgagtctgtccgtgagcctcgttctggtgggcgtcgtgacactttatctgggtgtaatggtgcaggccgattctgggtgtgttgtctcatggaaaaacaaggagttgaagtgcggaagtggcatttttatcaccgacaatgtgcacacttggacagagcagtacaaattccaacctgaaagcccctccaagctcgcttctgccattcagaaagcacatgaggaaggtatctgtggcataaggtcggtgacccggctggagaacttaatgtggaagcagattactccagaactgaatcacatcctaagcgagaacgaggtcaaactcaccattatgacaggggatatcaagggaataatgcaggccggcaaacgctccctgagaccccaacctacggaacttaagtattcatggaagacctgggggaaagctaagatgttgagtactgagtctcataatcagacatttctgatcgacggaccagaaaccgccgagtgcccgaacacaaatagggcatggaacagcctcgaagttgaggattacggcttcggtgtgtttactaccaatatttggctgaaattacgtgagaagcaggacgtgttctgtgactccaaactgatgtcagcggctatcaaggataaccgggccgtacacgcagacatggggtattggattgaaagcgcccttaatgatacgtggaagatcgagaaagcttcttttatagaagtcaagtcctgccactggcccaaaagtcatacattgtggagcaacgaggtgctcgagtctgaaatgattatccctaagaacttcgccggaccagtttcccagcacaattaccgacccggctatcatacccaaactgcaggtccttggcacctgggcaaactagagatggacttcgatttttgtgaagggaccacagtggtcgtgactgaggactgcggaaacagaggcccatcactgaggaccacaacggctagtgggaagctcatcaccgaatggtgctgtcgcagctgcactctgcccccgcttcggtacagaggagaggatggctgttggtacggtatggagattaggcctttgaaggaaaaagaggaaaatctggttaactcgttagtgacagccgggcatggacagatcgacaatttctccctcggcgtactgggtatggcgctttttctggaggaaatgttgcgcacccgagtcggcactaagcacgccattctcctggtggctgtgtctttcgtcacactaataaccgggaacatgagctttcgggatctgggacgtgttatggtgatggtaggcgcaacgatgactgacgatatcgggatgggagtgacctatctcgccctgcttgctgccttcaaagtcagaccaacatttgcagcgggcttgctgttaaggaagctcacctcaaaagagctgatgatgactacaattggtatcgtgcttctgagtcagtccaccattcccgagacaatcctagaactcactgacgccctggctttggggatgatggttctgaagatggtgcgcaagatggagaaataccaattagccgtcaccataatggcaatcctctgcgtgcctaatgctgttattctgcagaacgcctggaaggtgtcttgtacgatccttgcagtcgtaagcgtgtcccccctgttcttgacatcaagccagcagaaagccgattggattccactcgctctgaccatcaagggactaaatcctactgcgatatttctgaccacacttagtcggactaacaaaaagagatcttggcccctcaatgaagccattatggcagttggcatggtgtccatcctggctagctcgttgctgaaaaacgacatcccaatgaccggcccgttagtcgccgggggactcctgacggtgtgctatgtacttacaggtaggtcagccgacctggagttggaacgagctgcagatgtgaagtgggaggaccaagccgagatttctggcagttcccctatactcagcatcaccatttctgaagatgggagcatgtccatcaagaatgaggaagaggagcagactctgacaattctaatccgcaccggactgcttgtcatatcaggcctcttccccgttagtctgccaatcactgcggctgcctggtacttgtgggaagtgaaaaagcagcgggcaggtgtgttatgggacgtccccagccctccacccgtggggaaagccgagctggaagatggagcttatagaattaagcagaaaggcatcctcggctactctcaaattggggcaggagtttataaggagggtacatttcacaccatgtggcatgtaacgaggggcgccgtgctgatgcacaaggggaaacgtatcgaaccttcctgggcggacgtcaagaaagatcttatatcatacggaggcggttggaagctggagggggagtggaaagaaggagaggaagtgcaggttttggctctagagccgggcaagaacccacgcgccgtgcagactaagcccggcctgttcaaaaccaatgcagggacaattggagccgtcagtctcgactttagccctggtacctccggctctccaatcatcgataagaaagggaaggtggtaggactgtacggcaacggtgtcgtgacacggtcgggggcttatgttagcgccattgcacagactgaaaaatcaatcgaggacaaccccgagatagaagatgacattttcagaaagaggaagcttaccatcatggatttacatcctggagctggcaaaacgaagcgatacctgccggccattgtgcgggaggcgatcaaacgcggcctcagaacattgatactggcccccactagggtcgtggcagctgaaatggaggaagccctccgggggctgccaattcgatatcaaacccctgctatcagagcagagcacacaggacgcgagatcgttgaccttatgtgtcatgccaccttcactatgaggctgttgtcccccgtgcgtgtcccaaattacaacctaattatcatggacgaagcccactttaccgatcctgctagtattgcggcacggggttatatatctacaagagtggagatgggcgaagccgctgggatcttcatgacggccactcccccaggaagcagggacccgtttcctcagtccaatgcacccattatggatgaggagcgcgaaatcccagagcgatcatggtctagcggccacgaatgggtaaccgacttcaagggtaaaacagtgtggtttgttcccagtatcaaggccgggaacgatattgctgcgtgcctgagaaagaatggaaaaaaggtcatacagctctcccggaaaaccttcgacagcgagtacgtgaagactaggacaaacgattgggactttgtggtcaccacggatatctctgaaatgggcgccaatttcaaagcagagcgcgtaattgaccctcgtagatgtatgaagccagtgatcttaactgatggcgaggaacgggttattctggctgggcccatgcctgtgacacattcatccgccgcacaaaggcgcggacgaatcggtagaaacccgaaaaatgagaacgaccagtatatatacatgggcgaaccacttgagaatgacgaagattgcgcccactggaaggaggctaagatgctgctcgacaacatcaatacccccgaggggattatccctagtatgtttgaacccgagcgggaaaaagtcgatgccattgacggagagtacaggttgcgcggcgaagcgagaaagaccttcgtggatctgatgaggcggggtgacctcccagtttggctggcatatcgtgtggccgctgaggggatcaactacgccgatcgccgatggtgttttgacggcataaaaaataaccagattcttgaggaaaacgtcgaggtggaaatctggactaaggagggagagagaaaaaagctaaagcctaggtggctggatgctcggatttatagcgaccccttggcattaaaagaattcaaggagttcgccgctggccgcaaatcgctgacactctctctgatcaccgaaatggggagacttccaacatttatgactcagaaggccagggatgcactggacaatctcgcggtattgcatacggccgaggctggaggtcgggcctacaaccacgcactgtccgaactacctgagaccctggagacactccttctgttaactttgctggctaccgtgacaggcgggatattcctctttctgatgagcggacgaggcatcggtaaaatgacccttgggatgtgctgcattatcactgcctcaattctgctctggtatgcacaaatccagccgcactggatagccgctagtattatcttggaattctttctgatcgttttactaattcccgagccagaaaagcagagaacgcctcaggataatcaactgacctacgtcgtgatcgcgatactcacagtggtcgccgcaactatggctaacgagatgggcttccttgaaaagaccaaaaaggacctgggattgggctctattacaacccagcagcccgagtccaatatcctggacattgatctccgcccagccagcgcctggactctgtatgcagttgctacaacgtttgtgacccctatgcttaggcattcaatcgagaacagtagcgtaaatgtgtccctcactgccatagcgaaccaggctacagtcctgatggggttgggaaaaggttggcccctgtctaagatggacatcggcgtgccgttactagccattgggtgttacagccaagttaatccaatcaccctgaccgcagccctcttccttctggtggctcactacgcaattatcggacctggcttgcaggccaaagcgacacgggaagctcagaagcgtgccgcagccggtattatgaagaaccccactgtcgatgggatcacggtaatagacctggatccaattccctatgaccctaaatttgagaagcagctcggccaagtgatgctgcttgttttatgcgtgacccaggtcctgatgatgagaacaacttgggctctctgtgaagccttgaccctggcaacaggaccgatctccaccctatgggagggcaatcccgggaggttctggaacactacgatcgctgtgtcaatggccaatatttttcgcggatcttacctggcgggcgccggtctccttttcagtataatgaaaaacacaaccaatactcggcgagggaccggaaacatcggcgaaacactgggtgagaagtggaaatcgagattgaatgcactgggcaagagcgagtttcagatttataaaaagtccgggatccaagaagtcgataggactctcgctaaggagggaattaaacgcggcgaaaccgaccatcacgccgtgtctcgggggtcagcaaagctgagatggttcgttgagcgtaacatggtgacaccagagggaaaagtagtggatttaggctgcggtagggggggatggagctactattgtggcggtcttaagaacgtccgggaagttaaaggcctgacgaaggggggacctggccatgaggaacccatccctatgtccacctacgggtggaatctcgtgcgcctacagagtggagtcgacgtgttctttactccacccgagaagtgcgatacactgttgtgtgacataggcgaatctagccctaacccaaccgtagaggctggtcgaactctgagagtgctcaatcttgttgagaactggctgaataacaatacacagttctgcatcaaagtgttgaacccctatatgccgtcagtcattgaaaagatggaggccctgcagaggaaatacgggggagccctcgtgcggaatcctttatcccgcaacagtacccacgaaatgtactgggtcagcaatgcgtctggcaacatcgtgtcctcagttaatatgattagcagaatgctgatcaacaggtttacgatgcgacacaagaaagctacctatgagccagatgtagaccttggctcggggacacggaatataggaattgaatctgagatccccaacctggacatcattggtaagcgtatagagaagatcaaacaagaacatgagactagttggcactacgatcaggaccatccttataagacctgggcataccacggctcctatgaaacaaaacagactgggagcgcctcatccatggtgaacggagtcgtgagactactcaccaagccatgggatgttgtgcccatggtcacacagatggctatgaccgacactacgccgttcggccaacagcgcgtgtttaaagagaaggtagatacaaggacccaggaacctaaggagggtactaaaaagctgatgaaaattaccgccgagtggttgtggaaggaactggggaaaaagaaaacaccccggatgtgtacgagagaggaattcacccgcaaggtgaggtctaatgcagccctcggagctatctttactgacgagaacaagtggaaaagcgcgcgagaggccgttgaagatagtcggttctgggagcttgtcgacaaggaaagaaatctgcacttagagggcaaatgcgaaacatgtgtgtacaacatgatgggcaagagggagaaaaagctgggggagtttggaaaggcaaaaggttcccgcgctatttggtatatgtggttgggcgcccgtttcctcgaatttgaggcactggggttcctaaatgaagatcattggtttagccgggagaactctctttcaggagtggaaggcgagggtctgcacaagctcgggtacatcctgagagacgtcagtaaaaaggagggaggcgccatgtacgctgatgacaccgccggctgggacactaggataacattggaagatctgaaaaatgaggaaatggttaccaaccatatggagggggaacacaagaagctcgcggaggcaatcttcaaacttacatatcagaataaggtggtacgcgtgcaacgaccaactcctcggggaaccgtcatggacattatctccagaagggatcagcgcggtagcggccaggtggggacgtacggactgaacaccttcacaaatatggaggcccaattaattagacagatggaaggcgagggtgtttttaaatctatccagcatctgactgtgaccgaagagattgctgtccagaactggttggcccgggtggggagggagcgtctctcgcgaatggcaatatcaggagacgattgcgtagttaagcccctggacgatcgcttcgctagcgccctaacagctcttaatgacatgggcaaagtgagaaaggatatccaacagtgggaaccatcccggggctggaacgactggactcaggtccccttttgcagtcaccacttccatgagctgattatgaaggatgggagggtgctcgtggtcccttgtcgcaatcaggacgaactgatcggaagagcccggatctctcaaggtgcaggctggagcttgagggagaccgcgtgcttagggaaatcctatgcccagatgtggtcactgatgtactttcaccgacgtgatctcagacttgctgccaacgcaatttgtagtgctgttccatctcattgggtgccgacgagccgcacaacctggtccatacacgccaagcacgaatggatgactgcagaggacatgctgacagtatggaaccgggtgtggatccaggagaatccctggatggaagacaaaacccctgtcgagtcatgggaagagattccatatctaggaaagagggaagatcagtggtgcggcagcctgatcggtctcacttctagagccacctgggcgaaaaacattcaaacagctatcaatcaggtgcgctccttgatagggaacgaggagtacacggactatatgcccagtatgaagcggttcaggcgagaagaggaagaggccggagttctgtggtga

SEQ ID NO: 14710 - RNA, 9876 nt, synthetic construct
  misc_feature 1..9876: note = derived and/or modified CDS sequence (opt3) from DENV-2__EU529706__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataagcttcaactgaaagggatgagctacagtatgtgtacaggaaagttcaagatcgtcaaagaaattgctgagactcagcacggcaccatcgtgattagagtacagtatgagggtgacgggtctccatgcaagatacccttcgaaatcatggatttggagaaaaggcatgttctcggccggctgattacggtgaacccgatcgtcaccgaaaaggactcccctgtgaacatcgaggccgaacccccatttggagatagctacattataatcggcgtcgagcctgggcagttaaaactgaattggttcaagaagggatcgtctattggtcaaatgtttgagacaactatgcgaggcgctaaacgcatggccatcctaggggacaccgcatgggatttcggatccctcggcggtgtgtttacatcaattgggaaggccctgcaccaggttttcggcgctatctacggagcggcatttagtggcgtgagctggactatgaaaatacttatcggggtaattatcacctggattggaatgaactccagatctacgagcttgtcagtcagtctggtgctcgttggcgtggtcacactgtatcttggtgtgatggtacaggccgacaccgggtgtgtggtttcctggaagaataaagaactgaagtgcggaagcggcatcttcataactgataacgtccacacatggaccgagcagtacaagtttcaacccgaatctccatcaaaattggctagtgccattcagaaggcacatgaggaaggtatctgtggcattaggagcgtgactcggctcgagaatctgatgtggaaacagatcacccccgagttaaaccacatactgtccgaaaatgaggtgaagctaacaatcatgacgggggacattaaaggaatcatgcaggccggcaagcgctctctcagacctcaaccaaccgaactgaaatattcgtggaagacttgggggaaggctaaaatgcttagcacagagtcccataaccagaccttcttgattgatggaccggaaacagccgagtgccccaatactaacagggcatggaattcactggaggtcgaagactacggctttggtgttttcagtaccaacatctggctcaagctgcgtgagaaacaggacgtgttttgtgattctaagttaatgagcgcggctataaaagacaatcgggccgtgcacgcagatatggggtattggattgaatccgccctgaacgacacgtggaagatggagaaggcttcattcatcgagatcaaaagctgccactggcctaagtctcatacactttggtccaatggagtattggaaagtgagatgattatcccaaaaaacttcgccggccccgtcagccagcacaactaccgacctggttatcatacccaaactgcaggcccatggcacctcgggaagctggaaatggattttgacctatgtgagggaaccacagtggttgtgactgaagattgcggcaatagagggccctctctgaggaccacaacggcttccggaaaactcattaccgagtggtgctgtcgctcatgcactctgccgcctcttcggtacagaggcgaggacggttgttggtacgggatggaaataaggccattgaaggagaaggaagagaacctggtcaatagtttagtgacagccggacatggccagatcgataacttcagcctcggtgttctgggcatggcgctttttctggaagagatgttgcgcacccgaattgggactaaacacgccatcctcctggtggctgtatcgttcgtcacactaattaccggaaatatgtcctttcgggacctgggccgtgtgatggtgatggtcggggcaacgatgactgatgacatcggaatgggcgttacctatctcgccctgcttgctgccttcaaggtgagacccacatttgcagcgggtttgctgttaaggaaactcacctctaaggagctgatgatggccactatagggatcgctcttctgagccagtcaacaattcctgaaaccatcctagagctcacagatgccctggcattgggaatgatggtactgaaaattgtgcgcaacatggaaaagtaccaattagctgtcactatcatggccataagttgcgtgcccaatgcagttattctccagaacgcctggaaggtgtcctgtaccatcctggctgcggtctctgtgagcccacttctgttgacgtcctcacagcagaaagccgactggatccctctcgcactgacaattaagggcctaaatcccaccgctatattcctgactacccttagccggacaagtaaaaagagatcttggccactcaacgaggccgttatggccgtgggcatggtctccatcctggctagctcgttgctgaaaaatgacattccgatgactgggcctttagtagcaggaggtctcctgaccgtgtgctatgttcttacgggcaggtcagccgatctggaattggagcgagcggctgacgtgaagtgggaggatcaagccgaaatctctgggagttcccccattctcagcatcacaatatctgaggacggaagcatgtccatcaaaaacgaagaggaggaacacaccctgactattctaatccgcacaggcctgcttgtcatttcaggtgtgtttccagtaagtatccccataaccgcagccgcttggtacctctgggaggtgaagaagcagcgggcaggggtcctgtgggatgttcctagcccaccccctgtgggaaaagccgaattggaggacggcgcgtatagaattaagcagaggggcatcttcgggtactctcagatcggagctggtgtgtataaagaaggcacttttcatacaatgtggcacgtcacccgtggggccgtgttaatgcatcgcggaaagcggattgagccgtcctgggcagatgttaaaaaggacctgatctcatacggcggtgggtggaagctcgagggagaatggaaagagggcgaagaggtacaagtgctggcccttgaaccaggcaagaatcccagagctgtccagacgaaacctgggctgttcaagactaacaccggaacaataggtgccgtgagtttggattttagcccaggcacctccgggtctcccattgttgacaggaaaggaaaggtggtcggcctatacggtaatggggtggtaacacgatcgggagcatatgtcagcgctatcgcccagactgagaagtcaattgaggataaccctgaaatcgaggacgatatattccggaaaaagcgcctgaccattatggacctccacccgggcgcgggcaaaacgaagagatacctgcccgccatcgtgagggaagcaatcaaacgggggcttcgaacattaattctggctccaactagagttgtggccgctgagatggaagaggcactccgcggattgcctatcaggtatcagacccccgccattcgtgccgagcatacaggtcgggaaatagtcgacctgatgtgtcacgctaccttcactatgagactcctgtccccagtgagggttcctaactacaatcttatcattatggatgaggcgcactttaccgaccccgcaagtatcgccgctcgcggctatatctctacacgagtggaaatgggggaggccgcaggaattttcatgacggccactccaccgggcagcagagatccttttccccaatccaacgctccaataatggacgaggaacgggagatccccgaaaggtcatggaattctggtcatgagtgggtcaccgatttcaaggggaagacagtgtggtttgtacctagcattaaagcgggaaacgacatcgccgcatgcctgcgcaagaatggcaaaaaggtgattcagttgagtcgtaaaaccttcgattccgaatacgttaagactagagctaacgactgggattttgtcgtgacaaccgacatcagcgagatgggcgccaatttccgggcagagagggtgatagatccacgccgatgtatgaagcccgtcatcctaacggacggggaagagagagtaattctggccggacctatgccggtgactcactcttcagctgcccagcggaggggtcgcatcggcagaaacccaaaaaatgaaaacgaccaatatatttacatgggggagcccctcgaaaatgatgaggactgcgcgcattggaaggaggcaaaaatgttactggataacatcaatacacctgaaggaataattccctccatgtttgagccagaaagggagaaggttgacgccatcgatggcgaataccggcttcgtggtgaggctcgcaaaaccttcgtggacctgatgcgaagaggggatctccctgtctggttggcctatagggtggctgcagagggcattaactacgccgaccggcgctggtgttttgatggaatcaagaataaccagatactggaagagaacgttgaagtggagatctggaccaaagagggcgaaagaaagaagctcaaacccaggtggctggacgctcggatttatagtgatccacttgccctaaaggagttcaaagaattcgcagcggggcgaaagagcctgactttgaatttaatcacagagatgggaagactgcctacctttatgacacagaaagcccgcgacgctctcgataacctggccgtccttcacactgcagaagtgggtggcagggcttacaatcacgccctgtcggagctcccggagacgttggaaaccctgctactgctcacacttctggcaactgtaaccgggggaattttcttatttttgatgtctggcaagggtatcgggaagatgacactgggcatgtgctgcataattaccgcctccatcctcctgtggtatgctcagatccaaccccattggattgcggccagcatcatacttgagttctttctgattgtgctcttgatcccagaacctgagaaacagcggactccccaggacaaccagctgacgtacgttgtcattgcaatcttaaccgtggtggctgccacaatggccaatgaaatgggattcctagagaagactaaaaaggacctgggcctcgggtcaataaccacacaagagagtgaatctaacatccttgatattgacctgcgtccagcatccgcttggaccttgtatgccgtcgcgactacatttgttacgcctatgctgagacacagcatcgagaattcaagtgtgaacgtaagcctcaccgctattgccaatcaggcaactgtgctgatgggacttggtaggggctggcccctctccaaaatggatatcggggtcccgctgttggccattggatgttactctcaggtgaacccaatcacactgaccgctgcattactactgctcgttgcccattacgcgataattggccctggtcttcaggctaaggccacccgcgaagcacaaaagcggacagccgctgggatcatgaaaaatcccactgtggacggcatcacggtcattgatctggagccaataccctatgaccctaagttcgaaaaacagttgggacaggtaatgctgctcgtgctgtgcgttacccaggtgcttatgatgcgaacaacttgggccttatgtgaggcactgaccctcgctacaggcccgatcagcaccttgtgggaggggaaccccggaagattttggaatactacgattgccgtctccatggcgaacatcttcaggggctcatacctggccggtgcagggctactgttttctattatgaagaatacaaccaacactcgccggggaaccggcaatatcggtgaaacactcggcgagaaatggaagagtagacttaacgctctggggaagtcggaattccaaatatataaaaagagcggaatccaggaggtggatcgtactttggccaaagagggcattaagaggggggaaaccgaccaccatgcagtctcccggggatctgctaaactgcgctggtttgtggagcgaaacatggttacaccagaaggcaaggtggtagatctcggttgcgggagaggaggctggtcatactattgtggtggcctgaaaaatgtgagggaggtcaaggggttaacgaagggaggccctgggcacgaagagcccatccctatgagcacctacggatggaaccttgttcggctgcagtccggcgtggacgtcttcttcactccacccgagaaatgcgatacactcctatgtgacattggtgaaagttctcctaatccaaccgtggaggccgggcgcactctgagagtattgaacctggtggaaaattggctcaacaataacacacaattttgcgttaaggtgcttaatccctatatgccgagcgtcatcgagaaaatggaagccctgcagaggaagtacggaggcgcgttggtgcgaaaccctctgtcacggaattccacccacgagatgtactgggtcagtaacgctacgggcaatatagtgagctctgttaacatgatttcccgtatgctcatcaatagattcaccatgaaacataagaaggcaacatatgagccagatgtagacttagggtcaggaactcgcaacatcggtattgaaagcgagatacccaacctggacatcattggcaaaaggatcgaaaagattaaacaggagcacgaaacctcgtggcattacgatcaggaccacccttataagacatgggcctaccacgggtcttatgagactaaacaaaccggaagtgcttccagcatggtgaatggcgtcgtgaagcttctgacaaagccatgggatgttgtgcccatggtcacccagatggccatgactgacacgacaccgtttggtcagcagcgggtgttcaaagagaaggtagataccagaactcaagaacctaaagaggggaccaagaaactaatgcgcatcacagcagaatggctctggaaggagctgggaaggaagaaaacgccccgaatgtgtacccgggaggaatttactagaaaggtgaggtcaaacgccgctttgggcgcgatattcacagacgagaataaatggaagtccgcccgcgaagcagttgaggattctcgtttttgggaactggtcgaccgggagagaaacctccatcttgagggcaaatgcgaaacctgtgtgtacaatatgatggggaagagggagaaaaagctgggagaattcggtaaggctaaaggcagccgcgccatctggtatatgtggttaggggcacgatttctggagttcgaagccttgggatttctcaacgaggatcactggttcagtcggggcaattccctgagcggtgtggagggggaaggactacataagcttggctacattctgagagacgtctctaaaaaggagggcggggctatgtacgccgatgacactgcgggatgggacacaaggatcaccctcgaagatctgaaaaacgaggaaatggttacaaatcacatgaagggtgagcataagaaattggcagaggccatttttaagctgacttatcagaacaaagtggtacgcgtgcagagaccaacccctcggggcacggtcatggacatcatttcaaggaaggatcagcgtgggagtggacaagtgggcacctacggtctcaatacattcactaacatggaagctcagcttatacgacagatggagggggaaggaatcttcaaatccattcaacgcctgaccgttacagaggagatcgccgtgcagaattggttagcaagagtcggccgggaaaggctgagccgcatggctatctctggcgacgattgcgtggtaaagcccttggacgatagatttgcctcggctctcactgccctgaacgacatggggaaggttcggaaagatattcagcagtgggagccatcaaggggatggaatgactggacccaagtgcccttctgcagccaccactttcatgaactagtcatgaaggatggtcgagtgcttgtggtcccttgtcgtaaccaggacgagctgataggcagagcacgcatctcccagggggcgggatggagtctcaaagaaacggcctgcctgggcaagtcttatgctcagatgtggacattgatgtacttccaccggagggatttaagactggccgcaaacgctatttgtagcgccgttccatcccattgggtgccgacctcacgcactacatggagtatccacgcaaaacacgagtggatgaccactgaggacatgctcgccgtatggaatcgggtgtggattcaagaaaacccctggatggaggacaagacccctgtcgaatcttgggaggaagtgccatatcttggtaagagggaggatcagtggtgcgggagcctgatcggactaacatcccgagcgacgtgggctaaaaatatacagaccgccatcaaccaggttagatcactgattggcaatgaggaatacactgactatatgcccagcatgaagcggtttaggaaagaggaagaggaagcaggcgtgctctggtga

SEQ ID NO: 14711 - RNA, 9876 nt, synthetic construct
  misc_feature 1..9876: note = derived and/or modified CDS sequence (opt3) from DENV-2__EU482720__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaaccatggccgcaatcttggcctacacgattggcactacacactttcagcgcgctctcatcttcattctgctgaccgcagttgccccatccatgactatgagatgcatcgggatatctaacagggattttgtggaaggagtctcgggtggctcatgggtggacattgtactcgagcacgggagctgtgttacaaccatggctaagaataagcccacgttagatttcgaactgatcaaaaccgaggccaagcagcctgcgacacttcggaaatattgcattgaagcaaagttgactaacaccacaactgagagtcgctgtccaacccaaggagagccctccctgaatgaagagcaggacaaacgatttatctgcaagcattctatggtggatagaggctggggtaacgggtgtggactattcggcaagggcgggatcgtcacatgcgccatgtttacctgcaaaaagaatatggaaggaaaagtggtgctccctgagaacctggaatacactattgtcataacgccacacagcggtgaggagcatgctgttggcaatgacacagggaagcacggaaaagaaatcaagattaccccgcagtcctcaatcactgaggccgaacttaccggctatggtacagtgaccatggagtgtagtcccaggactgggctggatttcaacgaaatggtattgctccagatggaggacaaagcatggctggtgcaccggcaatggtttttagatctgcctctcccatggcttcccggcgctgacacacagggaagcaattggatacagaaggagacgctggtcaccttcaagaaccctcatgccaaaaagcaggacgtggttgtgttgggctctcaagaaggggcgatgcacactgccctaacaggagcaaccgagattcagatgtcctcaggtaatctgctctttacaggccatctgaaatgccgtcttcgcatggataagctgcagttgaaagggatgagctacagtatgtgtactggaaagttcaagatcgtcaaagaaatcgctgagacccaacacggcacgattgtgatcagagtacagtatgagggtgacgggtctccatgcaagattcccttcgaaataatggatctcgagaaaaggcatgttctgggccggttaatcaccgtgaacccgattgccacagaaaaggactcccctgtcaacatcgaggctgaacccccatttggagatagctacatcattataggcgtggagcctgggcagctgaaactaaattggttcaagaagggatcgtctatcggtcagatgtttgagactaccatgcgaggcgccaaacgcatggcaattctcggggacacagcctgggatttcggatccctgggcggtgtctttacttcaatcgggaaggctcttcaccaagtgttcggcgcgatttacggagcagcctttagtggcgttagctggaccatgaaaatcttgataggggtgatcattacgtggatcggaatgaactccagatctacaagcctgtcagtaagtctcgtcctggtgggcattgttaccctttatctgggtgtgatggtccaggctgacactgggtgtgtggtatcctggaagaataaagaattgaagtgcggaagcggcatcttcataacagataacgtgcacacctggactgagcagtacaagtttcagcccgaatctccatcaaaactcgccagtgcaattcaaaaggcccatgaggaaggtatctgtggcattaggagcgttacccggctggagaatttaatgtggaaacagatcacacccgagctgaaccacatactatccgaaaatgaggtcaagctcacgatcatgaccggggacattaaaggaatcatgcaggctggcaagcgctctctgagacctcagccaactgaacttaaatattcgtggaagacatgggggaaggccaaaatgttgagcaccgagtcccataaccaaacattcctgattgatggaccggaaactgcagagtgccccaataccaacagggcgtggaattcactcgaggtggaagactacggctttggtgtgttcagtacgaacatctggctgaagttacgtgagaaacaggacgtcttttgtgattctaagctgatgagcgctgccataaaagacaatcgggcagttcacgccgatatggggtattggattgaatccgctcttaacgacacatggaagatggagaaggcctcattcatcgagatcaaaagctgccactggcctaagtctcataccttgtggtccaatggagtgctcgaaagtgagatgattatcccaaaaaacttcgcaggccccgtgagccagcacaactaccgacctggttatcatactcagaccgctggcccatggcacctggggaagctagaaatggattttgacttctgtgagggaacaactgtagtcgtgaccgaagattgcggcaatagagggccctctctgaggacaacgaccgcctccggaaaactcattactgagtggtgctgtcgctcatgcacactgccgcctcttcggtacagaggcgaggacggttgttggtacgggatggaaataaggccattgaaggagaaggaagagaacctggttaatagtttagtgaccgcgggacatggccaaatcgataactttagcctcggtgtcctgggcatggcccttttcctggaagagatgttgcgcactcgagtggggacaaaacacgctattctcctggttgcagtgtcgtttgtaaccctaatcacgggaaatatgtccttccgggacctgggccgtgtcatggtgatggtgggggccactatgaccgatgacattggaatgggcgtcacatatctcgctctgcttgccgcatttaaggttagacccaccttcgcggccggtttgctgttaaggaaactcacttctaaggagctgatgatggctacaatcgggatagcccttctgagccagtcaaccatccctgaaacaattctagagctcactgatgcactggctttgggaatgatggtgctgaaaatcgtacgcaacatggaaaagtaccagttagccgtgaccattatggcaatcagttgcgtccccaatgccgtgatactccaaaacgcttggaaggtttcctgtacgattctggcggccgtgtctgtcagcccacttctgttgacatcctcacagcagaaagcagactggatccctctcgctctgaccatcaagggcctaaatcccactgccatttttctgaccacacttagccggactagtaaaaagagatcttggccactcaacgaggccgtgatggctgttggcatggtgtccatactggcaagctcgttgctgaaaaatgacatcccgatgaccgggcctttagtcgccggaggtctcctgacggtatgctatgtgcttacaggcaggtcagcggatctggaattggagaaggctgccgacgttaaatgggaggatcaggcagaaatttctgggagttcccccatcctcagcattaccatctctgaggacggaagcatgtccataaagaacgaagaggaggaacacactctgacaatcctaattcgaaccggcctgcttgtgatctcaggtgtcttcccagtgagtattcccatcactgccgctgcatggtacctctgggaggtaaagaaacaacgcgccggggtgctgtgggatgtccctagcccaccccctgttggaaaggcggaattggaggacggcgcttatcggataaaacagagaggcatttttgggtactctcagatcggagccggtgtgtataaggaaggcacattccataccatgtggcacgtgacgaggggggcagtcttaatgcatcgtggaaaacgcatcgagccgtcctgggccgatgtgaagaaggacctgatttcatacggcggtgggtggaaactcgagggagaatggaaggagggcgaagaggttcaggtactggctcttgaaccaggcaaaaatccccgggccgtgcaaactaagcctgggctgtttaaaaccaacacaggaaccatcggtgcagtcagtttggatttcagcccaggcacatccgggtctcccatagtggacagaaagggaaaggttgtgggcctatacggtaatggggtcgtgactaggtcgggagcttatgtaagcgccattgcgcagaccgagaaatcaatcgaggataaccctgaaattgaggacgatatcttccgaaagaaacggctgacgataatggacctccacccgggcgccggcaagacaaaacgctacctgcccgcaattgtcagagaagctatcaagagggggcttcggactttaatcctggccccaacccgagtggttgctgcagagatggaagaggccctcagaggattgcctattcgctatcagacacccgccatcagggctgagcataccggtcgtgaaattgtggacctgatgtgtcacgcgacttttaccatgcggctcctgtccccagtcagagtgcctaactacaatcttataatcatggatgaggcacacttcacagaccccgccagtattgctgccaggggctatatctctacgcgcgttgaaatgggggaggcagccggaatctttatgactgctaccccaccgggcagccgagatcctttcccccagtccaacgcgccaattatggacgaggaaagagagatacccgaacggtcatggaattctggtcatgagtgggtgacagattttaaggggaaaaccgtctggttcgtgcctagcatcaaggccggaaacgacattgcagcttgcctgaggaaaaatggcaagaaagtaatccaattgagtcgcaagacttttgattccgaatacgtgaagacacgtgccaacgactgggatttcgttgtcaccacggacattagcgagatgggcgcaaattttagagccgagcgggtgatcgatccaaggcgctgtatgaaacccgtgatactaactgacggggaagagcgagtcatcctggctggacctatgccggtaacacactcttcagccgcgcagagacggggtaggattggccgcaacccaaagaatgaaaacgaccagtatatctacatgggggagcccctcgaaaatgatgaggactgcgcacattggaaagaggccaagatgttactggataacattaatacccctgaaggaatcataccctccatgttcgagccagaaagagagaaagtggacgctattgatggcgaatacaggcttcggggtgaggcccgtaagacctttgttgacctgatgcgccgaggggatctccctgtgtggttggcttatagagtcgcagccgagggcatcaactacgctgacaggcggtggtgtttcgatggaattaaaaataaccaaatcctggaagagaacgtggaagttgagatatggactaaggagggcgaacgcaagaaactcaagcccagatggctggacgccaggacatatagtgatccacttgcactaaaagagttcaaggaatttgcggccgggcggaaaagcctgaccttgaatttaatcacagagatgggacgactgcctactttcatgacgcagaaggctagagacgccctcgataacctggcagtgcttcacaccgctgaagtcggtggccgcgcctacaatcacgcactgtcggagctcccggagacattggaaactctgctactgctcacccttctggccacagtgaccgggggaatttttttattcttgatgtctggcaagggtatcgggaaaatgactctgggcatgtgctgcattatcacggcttccatactcctgtggtatgcgcagattcagccccattggatcgccgcaagcatcattcttgagtttttcctgatcgtactcttgataccagaacctgagaagcaaaggaccccccaggacaaccagctgacatacgtggttattgctatcttaactgtcgtggccgccaccatggcaaatgaaatgggatttctagagaaaacaaagaaagacctgggcctcgggtcaattaccactcaggagagtgaatctaacatccttgatatagacctgcggccagcttccgcctggacattgtatgcggtggctacgaccttcgtcactcctatgctgcgtcacagcatcgagaattcaagtgttaacgtgagcctcacagccattgcaaatcaagccaccgtactgatgggacttggtagaggctggcccctctccaagatggatatcggggtgccgctgttggctattggatgttactctcaggtcaacccaatcaccctgacagcagccttactactgctcgtggcgcattacgctattatcggccctggtcttcaggccaaggcaactagggaagcccagaaacgcacggctgccgggataatgaagaatcccaccgttgacggcattacagtgatcgatctggagccaatcccctatgaccctaaatttgaaaagcaattgggacaggtcatgctgctcgtactgtgcgtgactcaggttcttatgatgcggaccacatgggcattatgtgaggctctgaccctcgccactggcccgattagcacgttgtgggaggggaaccccggacgattctggaatacaaccatagcggtgtccatggccaacatctttagaggctcatacctggcaggtgctgggctactgttctctattatgaaaaatactaccaacacaaggcgcggaactggcaatatcggtgaaaccctcggcgagaagtggaagagtcggcttaacgccctggggaaatcggaatttcagatttataagaaaagcggaatccaagaggtcgatagaacattggcaaaggagggcataaaacgtggggaaacggaccaccatgctgtgtccaggggatctgccaagctgcggtggttcgtcgagcgcaacatggtgaccccagaaggcaaagttgtggatctcggttgcgggcgaggaggctggtcatactattgtggtggcctgaagaatgtaagagaggtgaaggggttaactaaaggaggccctgggcacgaagagcccatccctatgagcacatacggatggaaccttgtcaggctgcagtccggcgttgacgtgttctttaccccacccgagaagtgcgatactctcctatgtgacattggtgaaagttctcctaatccaacaatcgaggccgggcggaccctgcgcgtcttgaacctggtggaaaattggctcaacaataacacgcagttctgcgtaaaagtgcttaatccctatatgccgagcgttattgagaagatggaaaccctgcaaagaaaatacggaggcgcgttggtgaggaaccctctgtcacgaaattccacacacgagatgtactgggtcagtaacgctactggcaatatcgtgagctctgtcaacatgatatcccggatgctcattaatcgttttaccatgaagcataagaaagcaacatatgagccagatgtggacttagggtcaggaactagaaacatcggtatcgaaaacgagattcccaatctggacataatcggcaagcgcattgaaaaaatcaagcaggagcacgaaaccagctggcattacgatcaggaccacccttataaaacatgggcctaccacgggtcgtatgagaccaagcagactggatctgctagttccatggttaacggcgtagtgaagcttctgacgaaaccatgggatgtcgtgcccatggttacacaaatggccatgaccgacactaccccgttcggtcagcagagggtgtttaaggagaaagtcgatacacggacgcaggaacctaaggaggggaccaaaaagctaatgagaattactgcagaatggctctggaaggagctgggaaaaaagaaaacaccccgcatgtgtaccagggaggaattcactcgaaaggtgcggagcaatgccgctttgggcgcgatctttacagacgagaacaaatggaagtcagccagagaagcagtagaggattccaggttctgggaactggtggaccgcgagcgtaatctccatcttgagggcaaatgcgaaacctgtgtttacaacatgatggggaagcgggagaagaaactgggagaatttggtaaggctaaaggctctagagccatatggtatatgtggttaggggcaaggttcctggagtttgaagccttgggattcctcaatgaggatcactggtttagccgcggcaacagtctgtccggtgtcgagggggaaggactacataagcttggctacatcctgcgagacgtgagcaaaaaggagggcggggctatgtacgccgatgacacagcgggatgggacactcggattaccctcgaagatctgaagaatgaggaaatggtgacgaaccacatgaaaggtgagcataagaaattggcagaggccatcttcaagctgacctatcaaaataaagtcgttagagtgcagaggccaacacctcgcggcactgtaatggacattatctctagaaaggatcagcgggggtcaggacaggtgggcacctacggtctcaacacattcactaatatggaagctcaacttattaggcagatggagggggaaggaatatttaagagtatccagcgtctgaccgtcacggaggagattgccgtgcaaaactggttagcacgagttggccgcgaaagactgtcccggatggctatcagcggcgacgattgcgtggtcaaacccttggacgataggttcgcctctgctctcacagccctgaatgacatggggaaggtgcgcaaagatatccagcagtgggagccatcgagaggatggaacgactggacccaggtacccttttgctcacaccacttccatgaactagttatgaaggatggtcggatgcttgtggtcccttgtaggaaccaagacgagctgattggccgagcacgtataagccagggggcgggatggtccctcaaagaaactgcctgcctgggcaagagttatgctcagatgtggacattgatgtactttcacagacgcgatttacggctggccgcaaatgctatctgttctgccgtgccaagccattgggtgccgacctccaggactacctggtcaattcacgcaaagcacgagtggatgacaacggaggacatgctcgccgtctggaacagagtttggatccaggaaaatccctggatggaggacaaaacccctgtggaaagttgggaggaagtaccatatcttggtaagcgcgaggatcaatggtgcgggtctctgattggactaactagccgggcgacatgggctaaaaacatccagaccgccataaatcaggtgaggtccctgatcggcaacgaggaatacactgactatatgccctcaatgaagcgattcagaaaagaggaagaggaagcaggcgtcctctggtga

SEQ ID NO: 14712 - RNA, 9876 nt, synthetic construct
  misc_feature 1..9876: note = derived and/or modified CDS sequence (opt3) from DENV-2__EU482721__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaaccatggccgcaatcttggcctacacgattggcactacacactttcagcgcgctctcatcttcattctgctgaccgcagttgccccatccatgactatgagatgcatcgggatatctaacagggattttgtggaaggagtctcgggtggctcatgggtggacattgtactcgagcacgggagctgtgttacaaccatggctaagaataagcccacgttagatttcgaactgatcaaaaccgaggccaagcagcctgcgacacttcggaaatattgcattgaagcaaagttgactaacaccacaactgagagtcgctgtccaacccaaggagagccctccctgaatgaagagcaggacaaacgatttatctgcaagcattctatggtggatagaggctggggtaacgggtgtggactattcggcaagggcgggatcgtcacatgcgccatgtttacctgcaaaaagaatatggaaggaaaagtggtgcagcctgagaacctcgaatacactattgtcataacgccacacagcggtgaggagcatgctgttggcaatgacacagggaagcacggaaaagaaatcaagattaccccgcagtcctcaatcactgaggccgaactgaccggctatggtacagtgaccatggagtgtagtcccaggactgggcttgatttcaacgaaatggtactgttgcaaatggaggacaaagcatggctcgtgcaccggcagtggtttctggatttacctctgccatggctccccggcgctgacacacagggaagcaattggatacagaaggagacgcttgtcaccttcaagaaccctcatgccaaaaagcaagacgtggttgtgctgggctctcaggaaggggcgatgcacactgccttgacaggagcaaccgagattcagatgtcctcaggtaatctactgtttacaggccatctcaaatgccgtctgcgcatggataagcttcaactgaaagggatgagctacagtatgtgtactggaaagttcaagatcgtcaaagaaatcgctgagacccagcacggcacgattgtgatcagagtacagtatgagggtgacgggtctccatgcaagattcccttcgaaataatggatttggagaaaaggcatgttctcggccggctgatcaccgtgaacccgattgtcacagaaaaggactcccctgtgaacatcgaggccgaacccccatttggagatagctacatcattataggcgtcgagcctgggcagttaaaactgaattggttcaagaagggatcgtctatcggtcaaatgtttgagactaccatgcgaggcgctaaacgcatggccattctaggggacacagcatgggatttcggatccctcggcggtgtgtttacttcaatcgggaaggccctgcaccaggttttcggcgctatttacggagcggcatttagtggcgtgagctggaccatgaaaatccttataggggtaatcattacgtggatcggaatgaactccagatctacaagcttgtcagtcagtctggtgctcgttggcattgtgaccctgtatcttggtgtcatggtgcaggccgacactgggtgtgtagtgtcctggaagaataaagaactgaagtgcggaagcggcatcttcataacagataacgttcacacctggactgagcagtacaagtttcaacccgaatctccatcaaaattggctagtgccattcagaaggcacatgaggaaggtatctgtggcattaggagcgtcacccggctcgagaatctgatgtggaaacagatcacacccgagttaaaccacatactgtccgaaaatgaggtgaagctaacgatcatgaccggggacattaaaggaatcatgcaggccggcaagcgctctctcagacctcaaccaactgaactgaaatattcgtggaagacatgggggaaggctaaaatgcttagcaccgagtcccataaccagacattcttgattgatggaccggaaactgccgagtgccccaataccaacagggcatggaattcactggaggtggaagactacggctttggtgtcttcagtacgaacatctggctcaagctgcgtgagaaacaggacgttttttgtgattctaagttaatgagcgcggctataaaagacaatcgggccgtgcacgcagatatggggtattggattgaatccgccctgaacgacacatggaagatggagaaggcttcattcatcgagatcaaaagctgccactggcctaagtctcataccctttggtccaatggagtgttggaaagtgagatgattatcccaaaaaacttcgccggccccgtaagccagcacaactaccgacctggttatcatactcaaaccgcaggcccatggcacctcgggaagctggaaatggattttgacttctgtgagggaacaactgtcgtggttaccgaagattgcggcaatagagggccctctctaaggacaacgaccgcttccggaaaactgattactgagtggtgctgtcgctcatgcacactcccgcctctgcggtacagaggcgaggacggttgttggtacgggatggaaataaggccacttaaggagaaggaagagaacttggtgaatagtctggtcaccgccggacatggccagatcgataactttagcttaggtgtgctcggcatggcgctgttccttgaagagatgctgcgcactcgaattgggacaaaacacgccatcttgctcgttgctgtgtcgtttgtaaccctgattacgggaaatatgtccttccgggacctaggccgtgtcatggtgatggtgggggcaactatgaccgatgacatcggaatgggcgtcacatatctggccctcctggctgcctttaaggttagacccaccttcgcagcgggtcttttgctgaggaaattaacttctaaggagctcatgatggccacaatagggatcgctctgcttagccagtcaaccattcctgaaacaatcctggagctaactgatgccctcgcactgggaatgatggtgttgaaaattgtacgcaacatggaaaagtaccaactggctgtgaccatcatggccataagttgcgtccccaatgcagtgattttacagaacgcctggaaggtttcctgtacgatcctcgctgcggtgtctgtcagcccactgcttctgacatcctcacagcagaaagccgactggatccctttggcactcaccattaagggcctgaatcccactgctatatttctaaccacactgagccggactagtaaaaagagatcttggccacttaacgaggccatcatggccgtgggcatggtttccattctcgctagctcgctgttgaaaaatgacatcccgatgaccgggcctctggtggcaggaggtttactcacggtctgctatgtactgacaggcaggtcagccgatcttgaactggagcgagcggctgacgtgaagtgggaggatcaagccgaaatttctgggagttcccccatcttgagcataaccatctctgaggacggaagcatgtccattaaaaacgaagaggaggaacacactctcacaatcctgattcgcaccggcctactggttatctcaggtgtgttcccagtcagtatacccattactgcagccgcttggtacctttgggaggtgaagaagcagcgggcaggggtactctgggatgtgcctagcccaccccctgtcggaaaagccgaactggaggacggcgcgtatagaatcaagcagaggggcatctttgggtactctcagattggagctggtgtttataaagaaggcacattccataccatgtggcacgtgacgcgtggggccgtgttgatgcatcgcggaaagcggatcgagccgtcctgggcagatgtcaaaaaggacttaatatcatacggcggtgggtggaagctggagggagaatggaaagagggcgaagaggtgcaagttctcgccctggaaccaggcaagaatcccagagctgtacagactaaacctgggctttttaagaccaacacaggaaccattggtgccgtgagtctggatttcagcccaggcacatccgggtctcccatcgtcgacaggaaaggaaaggtggttggcttgtacggtaatggggtggtcactcgatcgggagcatatgtgagcgctattgcccagaccgagaagtcaatcgaggataaccctgaaatagaggacgatattttccggaaaaagcgcctaacgatcatggacctgcacccgggcgcgggcaaaacaaagagatacctccccgccatcgtaagggaagcaattaaacgggggctgcgaactcttatcttagctccaaccagagtcgtggccgctgagatggaagaggcactgcgcggactccctattaggtatcagacacccgccatacgtgccgagcataccggtcgggaaatcgttgacttgatgtgtcacgctacttttaccatgagactgctctccccagtgagggtccctaactacaatctgattatcatggatgaggcgcacttcacagaccccgcaagtatcgccgctcgcggctatatttctacgcgagtggaaatgggggaggccgcaggaatatttatgactgccaccccaccgggcagcagagatcctttcccccaatccaacgctccaatcatggacgaggaacgggagattcccgaaaggtcatggaattctggtcatgagtgggttacagattttaaggggaagaccgtgtggttcgtccctagcatcaaagcgggaaacgacattgccgcatgccttcgcaagaatggcaaaaaggtgatccagctgagtcgtaaaacttttgattccgaatacgtaaagacaagagctaacgactgggatttcgtggttaccacggacataagcgagatgggcgccaattttcgggcagagagggtcatcgatccacgccgatgtatgaagcccgtgattttgactgacggggaagagagagtgatcctagccggacctatgccggtcacacactcttcagctgcccagcggaggggtcgcattggcagaaacccaaaaaatgaaaacgaccaatatatctacatgggggagcccctggaaaatgatgaggactgcgcgcattggaaggaggcaaaaatgctcttagataacataaatacccctgaaggaattatcccctccatgttcgagccagaaagggagaaggtagacgccattgatggcgaataccggctgcgtggtgaggctcgcaaaacctttgtggaccttatgcgaagaggggatctgcctgtttggctcgcctatagggtggctgcagagggcatcaactacgccgaccggcgctggtgtttcgatggaataaagaataaccagatcttggaagagaacgtcgaagtggagatttggactaaagagggcgaaagaaagaagctgaaacccaggtggctcgacgctcggatctatagtgatccactggcccttaaggagttcaaagaatttgcagcggggcgaaagagcctaacactgaatttgattaccgagatgggaagattacctacattcatgactcagaaagcccgcgacgctctggataacctcgccgttctgcacacggcagaagctggtggcagggcctacaatcacgcactttcggagctgccggagaccctcgaaacattgctgctactgactctccttgccaccgtgacagggggaatctttctgttcttaatgtctggcaagggtatagggaagatgaccttgggcatgtgctgcattatcactgcttccatcctgctctggtatgcgcagattcaaccccattggatcgccgcaagcataattctggagtttttccttatcgtcctgctcattccagaacctgagaaacagcggacgccccaggacaaccagttgacctacgtggtaatcgctatactgacagtggttgccgccactatggcaaatgaaatgggatttttagagaagaccaaaaaggacctaggcctggggtcaatcacaacccaagagagtgaatctaacattctcgatatcgaccttcgtccagcttccgcctggactctgtatgcggtcgctacaacgttcgtgacccctatgttgagacacagcattgagaattcaagtgtgaacgtcagcctgactgccatcgcaaatcaggccacagttctcatgggactgggtaaaggctggcccctttccaagatggatattggggtgccgctcctggctatcggatgttactctcaggtaaacccaataaccttgaccgcagccctgttactactggtggcgcattacgctattatcggccctggtctccaggccaaggcaacaagggaagcccaaaaacgcgctgccgcagggatcatgaagaatcccactgtcgacggcattacggtgatagatcttgagccaatcccctatgaccctaaatttgaaaagcagctgggacaggttatgttgctgattctctgcgtgacccaggtcctgatgatgcggacaacttgggctctttgtgaggccttaaccctggcgacaggcccgatcagcaccctctgggaggggaaccccggacgattctggaatactacgattgccgtatccatggcaaacatctttagaggctcatacttggctggtgccgggctgctattctctataatgaaaaatacaaccaacactaggcgcggaaccggcaatatcggtgaaacactgggcgagaagtggaagagtcggctcaacgcacttgggaaatcggaatttcaaatttataagaaaagcggaatccaggaggtggatagaactctggctaaggagggcattaaacgtggggaaaccgaccaccatgccgtttccaggggatctgccaagttgcggtggttcgtggagcgcaacatggtcacaccagaaggcaaagtggtcgatctgggttgcgggcgaggaggctggtcatactattgtggtggcctcaagaatgtgagagaggttaaggggctgacgaaaggaggccctgggcacgaagagcccatccctatgagcacctacggatggaacttagtgaggcttcagtccggcgtagacgtgttctttactccacccgagaagtgcgatacactgctctgtgacataggtgaaagttctcctaatccaaccattgaggcggggcggactctacgcgtcctgaacttggttgaaaattggctgaacaataacacacaattctgcatcaaagtgctcaatccctatatgccgagcgtcatcgagaagatggaagctcttcagagaaaatacggaggcgcactggtgaggaaccctttgtcacgaaattccacccacgagatgtactgggtaagtaacgccacgggcaatattgtgagctctgttaacatgatatcccggatgctgatcaatcgttttaccatgaagcataagaaagctacatatgagccagatgtggacctcgggtcaggaactagaaacattggtatcgaaagcgagattcccaacttagacatcataggcaagcgcatcgaaaaaattaagcaggagcacgaaacctcgtggcattacgatcaggaccacccttataaaacatgggcctaccacgggtcttatgagactaagcaaaccggaagtgcatccagcatggtcaatggcgtggtcaggctgcttacaaagccatgggatgtggttcccatggtaacccagatggccatgactgacacgacaccgttcggtcagcagcgggtgtttaaagagaaggtcgataccagaactcaagaacctaaagaggggaccaagaaactgatgaagatcacagctgaatggctatggaaggagctcggaaaaaagaaaacgccccgcatgtgtaccagggaggaattcactcgaaaggtgcggtcaaacgcggccctgggcgcaatttttacagacgagaataaatggaagtccgctagagaagccgttgaggatggcaggttctgggaattggtggaccgcgagcgtaacctgcatctcgaggggaaatgcgaaacctgtgtctacaatatgatgggaaagcgggagaagaaacttggtgaatttggcaaggcaaaagggtctagagccatctggtatatgtggctgggagctaggttcttagagtttgaagccctgggcttcttgaacgaggatcactggtttagccgcggtaatagtctctccggggtggagggagaaggcctgcatcgactaggctacattcttcgggacgtaagcaagaaagaggggggagcgatgtacgcagatgacactgccggttgggacacaagaataaccctggaagatctcaagaacgaggaaatggtgacaaatcacatgaagggcgagcataaaaagctggctgaggccatcttcaaattgacttatcagaacaaggttgtcagggtgcagcgcccaacccctagagggacggtgatggacattatctctcggaaagatcagaggggatcaggccaagtcggtacctacgggctgaatacattcactaacatggaagcacagctcatccgtcagatggagggagaaggcatttttaagagtatacaacgacttaccgttacagaggagatcgctgtgcagaattggctggcccgcgtaggcagagaacggttatccaggatggctattagcggggacgattgcgtggtcaagcccctggacgatcgcttcgcctctgcattgactgcgctcaacgacatgggaaaagtgagaaaggatatccagcagtgggagccatcgcggggttggaatgactggacccaagttcccttttgctcacaccacttccatgaactggtgatgaaagatggcaggatgctagtcgtgccttgtcgaaaccaggacgagcttattgggcgtgccagaatcagccagggagctggctggtccctgaaggaaacggcctgcctcggtaaaagttatgcacagatgtggacactgatgtactttcaccgccgggatttgaggttagctgccaacgcaatatgttctgccgtaccaagccattgggttccgacctccagaactacatggtcaatccacgcgaagcacgagtggatgaccactgaggacatgctggctgtgtggaatcgcgtctggattcaagaaaacccctggatggaggacaagacccctgtggaaagttgggaggaagtgccatatctcgggaaacgggaggatcagtggtgcggatctcttatcggcctgacaagcagggccacgtgggcaaagaatattcagaccgccatcaaccaggtccgatccctaataggcaatgaggaatacactgactatatgccctcaatgaaaagattccggaaggaggaagaggaagctggggttctgtggtga

SEQ ID NO: 14713 - RNA, 9876 nt, synthetic construct
  misc_feature 1..9876: note = derived and/or modified CDS sequence (opt3) from DENV-2__EU482722__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgagatcaaatcttgccactggcctaagtcccatacgttgtggagtaatggagtactcgaaagcgagatgattatcccaaaaaacttcgccggccccgtctctcagcacaactaccgacctggttatcatacacagaccgcaggcccatggcacctggggaagctagaaatggattttgacttctgtgagggaactaccgtggttgtgacagaagattgcggcaatagagggccctccctgaggactaccacagcttcaggaaaactcattacggagtggtgctgtcgcagttgcaccctgccgcctcttcggtacagaggcgaggacggttgttggtacgggatggaaataaggccattgaaggagaaggaagagaacctggtcaatagcttagtgactgccggacatggccaaatcgataacttttcgctcggtgttctgggcatggcgcttttcctggaagagatgttgcgcacacgagtggggaccaaacacgccattctcctggtagctgtctcctttgtgactctaatcacaggaaatatgtctttccgggacctgggccgtgtgatggtcatggttggggcaaccatgacggatgacattggaatgggcgtgacttatctcgccctgcttgctgcctttaaggtaagacccaccttcgcagcgggtttgctgttaaggaaactcacaagcaaggagctgatgatggccaccatcgggatagctcttctgtcacagagtactatccctgaaacaattctagagctcaccgatgccctggcattgggaatgatggtgctgaaaatcgtccgcaacatggaaaagtaccagttagctgtgacaattatggccatctcctgcgttcccaatgcagtgatactccaaaacgcctggaaggtctcttgtactattctggctgcggtgagcgtttccccacttctgttgacctcaagccagcagaaagccgactggatccctctcgcactgacgatcaagggcctaaatcccacagctatttttctgaccactcttagtcggacctctaaaaagagatcctggccactcaacgaggccgtgatggccgtcggcatggtaagcatactggcttcgtcattgctgaaaaatgacatcccgatgacagggcctttagtggcaggaggtctcctgactgtttgctatgtgcttaccggcaggtctgccgatctggaattggagcgagtcgcggacgtgaagtgggaggatcaggctgaaattagtgggtccagccccatcctctctattacgatcagcgaggacggatccatgtcaataaaaaacgaagaggaggaacacacactgaccatcctaattcgcactggcctgcttgtaatcagtggtgtgttcccagtcagcattcccatcacagccgcagcctggtacctctgggaggttaagaagcaacgggctggggtgctgtgggatgtgccttctccaccccctgtcggaaaagcagaattggaggacggcgcctatagaataaagcagaggggcatttttgggtactcccagatcggagcgggtgtgtataaagaaggcaccttccatactatgtggcacgttacacgtggggctgtattaatgcatcgcggaaagcggatcgagccgtcatgggccgatgtgaaaaaggacctgattagttacggcggtgggtggaagctcgagggagaatggaaagagggcgaagaggtccaggtgctggcacttgaaccaggcaagaatcccagagccgttcaaaccaaacctgggctgtttaagacgaacactggaaccatcggtgctgtgagcttggatttctccccaggcacatctgggtcgcccatagtcgacaggaaaggaaaggtggtaggcctatacggtaatggggtcgtgacccgaagcggagcctatgtttcagcaattgctcagacagagaagtccatcgaggataaccctgaaattgaggacgatatcttccggaaaaagcgcctgactataatggacctccacccgggcgccggcaaaaccaagagatacctgcccgcgattgtgagggaagccatcaaacgggggcttcgaacgttaatcctggcaccaacaagagtcgtggctgccgagatggaagaggctctccgcggattgcctattaggtatcagactcccgcaatccgtgccgagcataccggtcgggaaattgttgacctgatgtgtcacgccacatttaccatgagactcctgagtccagtgagggtccctaactacaatcttataatcatggatgaggctcacttcactgaccccgcgtctattgcagcccgcggctatatcagcacccgagtggaaatgggggaggctgccggaatctttatgacagcaacgccaccgggctccagagatcctttcccccagtcaaacgccccaattatggacgaggaacgggagatacccgaaaggtcttggaatagcggtcatgagtgggtaactgattttaaggggaagaccgtgtggttcgttcctagtatcaaagctggaaacgacattgcggcctgcctgcgcaagaatggcaaaaaggtcatccaattgtcccgtaaaacatttgatagcgaatacgtgaagaccagagcaaacgactgggatttcgtggtcactacagacatttctgagatgggcgctaattttcgggccgagagggtaatcgatccacgccgatgtatgaagcccgtgatactaaccgacggggaagagagagttatcctggcaggacctatgccggtgacgcactcatccgccgctcagcggaggggtcgcattggcagaaacccaaaaaatgaaaacgaccagtatatctacatgggggagcccctcgaaaatgatgaggactgcgcccattggaaggaggcgaaaatgttactggataacattaatactcctgaaggaatcatacccagtatgttcgagccagaaagggagaaggtcgacgcaattgatggcgaataccggcttcgtggtgaggcccgcaaaacatttgtggacctgatgcgaagaggggatctccctgtttggttggcttatagggtggccgctgagggcatcaactacgcagaccggcgctggtgtttcgatggaattaagaataaccaaatcctggaagagaacgtcgaagtggagatatggaccaaagagggcgaaagaaagaagctcaaacccaggtggctggacgcccggatctatagcgatccacttgctctaaaggagttcaaagaatttgccgcagggcgaaagaccctgactttgaatttaattacagagatgggaagactgcctaccttcatgacacagaaagcgcgcgacgccctcgataacctggctgtacttcacactgccgaagtgggtggcagggcatacaatcacgctctgtcggagctcccggagacgttggaaaccctgctactgctcacacttctggccactgttaccgggggaatctttttattcttgatgtctggcaagggtattgggaagatgacactgggcatgtgctgcatcataaccgcatccattctcctgtggtatgcccagatccagccccattggatcgctgcgagcattatccttgagtttttcctgatagtcctcttgattccagaacctgagaaacaacggactccccaggacaaccagctgacgtacgtggtgatcgccattttaaccgtcgttgcagctacaatggccaatgaaatgggatttctagagaagactaaaaaggacctgggcctcgggtcaatcaccacacaggagagtgaatctaacatacttgatatcgacctgcgtccagcctccgcatggaccttgtatgctgtggccactacattcgtaacgcctatgctgagacacagcattgagaattcaagtgtgaacgtcagcctcaccgcgatcgctaatcaagccactgtgctgatgggacttggtaggggctggcccctctccaaaatggatattggggttccgctgttggcaatcggatgttactctcaggtgaacccaattacactgaccgccgctttactactgctcgtcgcacattacgccatcataggccctggtcttcaggcgaaggctacccgcgaagcccagaagcggacagcagccgggattatgaaaaatcccactgtagacggcatcacggtgatcgatctggagccaattccctatgaccctaagtttgaaaaacaattgggacaggttatgctgctcgtgctgtgcgtcacccaggtgcttatgatgcgaacaacttgggctttatgtgaggccctgaccctcgcaacaggcccgataagcaccttgtgggaggggaaccccggaagattctggaatactacgatcgctgtctccatggccaacatttttaggggctcatacctggcgggtgccgggctactgttctctatcatgaagaatacaaccaacactcgccggggaaccggcaatattggtgaaacactcggcgagaaatggaagagtagacttaacgcactggggaagtcggaatttcagatctataaaaagagcggaatacaagaggtggatcgtactttggctaaagagggcatcaagaggggggaaaccgaccaccatgccgtttcccggggatctgcaaaactgcgctggttcgtggagcgaaacatggtaacaccagaaggcaaggtggtcgatctcggttgcgggagaggaggctggtcatactattgtggtggcctgaaaaatgttagggaggtgaaggggttaacgaagggaggccctgggcacgaagagcccattcctatgagcacctacggatggaaccttgtccggctgcagtccggcgtggacgtattctttactccacccgagaaatgcgatacactcctatgtgacatcggtgaaagttctcctaatccaaccattgaggctgggcgcactctgagagtgttgaacctggttgaaaattggctcaacaataacacacagttctgcgtgaaggtccttaatccctatatgccgagcgtgatcgagaaaatggaaaccctgcaaaggaagtacggaggcgccttggtccgaaaccctctgtcacggaattccacgcacgagatgtactgggtgagtaacgccaccggcaatatagttagctctgtaaacatgatttcccgtatgctcatcaatagatttacaatgaaacataagaaggcgacttatgagccagatgtggacttagggtcaggaacccgcaacatcggtattgaaaacgagatacccaatctggacatcattggcaaaaggatcgaaaagattaaacaggagcacgaaacaagctggcattacgatcaggaccacccttataagacttgggcttaccacgggtcgtatgagaccaaacagacaggatctgcaagttccatggtcaacggcgtggttaagcttctgaccaagccatgggatgtgatccccatggtcactcaaatggccatgacggacacaaccccgttcggtcagcagcgggtgtttaaagagaaggtagatactagaacccaggaacctaaagaggggacaaagaaactaatgcgcataacggctgaatggctctggaaggagctgggaaagaaaaagacccccaggatgtgtactcgagaggaattcacacggaaagtgagaagcaatgccgcattgggcgccatctttaccgacgagaacaagtggaaatcagctagggaagcggttgaggattcccgcttctgggaactggtcgaccgtgagcggaatctccatcttgagggcaagtgcgaaacttgtgtgtacaacatgatggggaaaagagagaagaagctgggagaatttggtaaagccaagggctctagggcaatttggtatatgtggttaggggctcgcttcctggagtttgaagccttgggattcctcaatgaggatcactggtttagccgaggcaacagtctgtccggtgtggagggggaaggactacataaacttggctacatcctgcgggacgtcagcaagaaagagggcggggcaatgtacgccgatgacacagctggatgggacaccagaattacactcgaagatctgaagaatgaggaaatggttactaaccacatgaagggtgagcataaaaagttggccgaggcgatcttcaaactgacctatcaaaataaggtggtaagggtgcagcgcccaacgcctagaggcaccgtcatggacattatatctcggaaagatcagagggggtcaggacaggtgggcacatacggtctcaacactttcaccaatatggaagcacaacttatccgtcagatggagggggaaggaatttttaagagtatccagcgactgacagttactgaggagatcgccgtgcaaaactggttagctcgcgtcggcagagaacggctgtccaggatggccattagcggcgacgattgcgtggtaaagcccttggacgatcgcttcgcatctgctctcaccgccctgaatgacatggggaaagttagaaaggatatacagcagtgggagccatcgcggggatggaacgactggacgcaggtgcccttttgctcacaccacttccatgaactagtcatgaaagatggtagggtgcttgtggtcccttgtcgaaaccaagacgagctgatcggccgtgctagaattagccagggggccggatggtccctcaaggaaacagcatgcctgggcaaaagttatgcgcagatgtggaccttgatgtactttcaccgccgggatttaaggctggccgctaatgccatctgttctgcagttccaagccattgggtgccgacttccagaacaacctggtcaattcacgctaagcacgagtggatgactaccgaggacatgctcgccgtatggaaccgcgtgtggatccaggaaaatccctggatggaggacaagacacctgtcgaaagttgggaggaagtgccatatcttggtaaacgggaggatcaatggtgcgggtctctgataggactaacgagcagggcaacctgggccaagaacatccagactgcgattaatcaggttcgatccctgatcggcaacgaggaatacacagactatatgccctcaatgaaaagattccggaaggaggaagaggaagctggcgtgctctggtga

SEQ ID NO: 14714 - RNA, 9876 nt, synthetic construct
  misc_feature 1..9876: note = derived and/or modified CDS sequence (opt3) from DENV-2__EU482723__SS-prME
  source 1..9876: mol_type = other RNA
accgccggagtgataattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccaggacagaaacttggatgagtagcgagagggcttggaaacacgtgcagcggatcgagacctggatactgcgccatcctggattcacaatcatggccgcaattttggcctacaccatcggcacgactcactttcagagagctctcattttcatcctgctgacagcagttgccccatccatgaccatgaggtgcataggcatttctaaccgggattttgtggaaggggtctcgggaggttcatgggtggacatcgtactcgagcacggcagctgtgttactacaatggctaagaataagcccaccttagatttcgaactgattaaaacggaggccaagcagcctgcgacccttcgcaaatattgcatcgaagcaaagttgacaaacactaccacagagagtcgatgtccaactcaaggggagccctccctgaatgaagaacaggacaaaagatttatctgcaagcattctatggtggataggggatggggcaacggttgtgggctattcggaaagggcggcattgtaacatgcgccatgtttacatgcaaaaagaatatggaagggaaagtggtgctccctgagaacctggaatacaccatagtcatcactccacacagcggagaggagcatgctgttggtaatgacacgggcaagcacgggaaagaaattaagatcacaccgcagtcctcaataaccgaggccgaacttactggatatggcaccgtgacaatggagtgtagtccccggaccggtctggatttcaacgaaatggtattgctccagatggaggacaaagcatggctggtgcaccgtcaatggtttttagatctgcctctcccatggcttcccggggctgacactcagggcagcaattggattcagaaggagacactggtcacgttcaagaaccctcatgccaaaaagcaggacgtggttgtgttgggatctcaagaaggcgcgatgcacaccgccctaactggggcaacagagatccagatgtcctcaggaaatctgctctttaccggtcatctgaaatgccgccttagaatggataagctgcagttgaaaggcatgagctacagtatgtgtacagggaagttcaagatcgtcaaagaaattgctgagactcaacacggaaccatcgtgattagggtacagtatgagggcgacggttctccatgcaagatacccttcgaaatcatggatctcgagaaacggcatgttctggggcgattaattacggtgaacccgatcgtcaccgaaaaggactcccctgtgaacatcgaggccgaacccccatttggcgatagctacattataatcggagtcgagcctggccagctgaaactaaattggttcaagaaggggtcgtctattggacagatgtttgagacaactatgcgcggtgctaaaagaatggccatcctcggcgacaccgcatgggatttcgggtccctgggaggcgtgtttacatcaattggtaaggcccttcaccaagttttcggggctatctacggcgcggcatttagtggagtgagctggactatgaaaatattgatcggcgtaattatcacctggattgggatgaactccaggtctacgagcctgtcagtcagtctcgtgctggttggagtggtcacactttatctgggcgtgatggtacaggccgactccggttgtgtggttagctggaagaataaagaattgaagtgcgggtctggaatcttcataaccgataacgtccacacttggacagagcagtacaagtttcagcccgaatcaccaagtaaactcgctagcgccattcaaaaggcacatgaggaaggcatctgtggtattcggtccgtgacccgcctggagaatttaatgtggaaacagatcactcccgagctgaaccacatactatctgaaaatgaggtgaagctcaccatcatgacaggcgacattaaagggatcatgcaggccggaaagagatcgctgaggcctcagccaacggaacttaaatatagctggaagacctggggcaaggctaaaatgttgtccactgagtcacataaccaaacattcctgattgatgggccggaaaccgccgagtgccccaatacaaaccgtgcatggaatagtctcgaggtcgaagactacggatttggcgttttctctactaacatctggctgaagttacgggagaaacaggacgtgttttgtgatagcaagctgatgtccgcggctataaaagacaatcgagccgtgcacgcagatatgggttattggattgaatcagcccttaacgacacctggaagatggagaaggctagcttcatcgagatcaaatcttgccactggcctaagtcccatacgttgtggagtaatggggtactcgaaagcgagatgattatccccaagaacttcgccggacccgtctctcagcacaactacagacctggctatcatacacagaccgcaggtccatggcacctgggcaagctagaaatggattttgacttctgtgaggggactaccgtggttgtgacagaagattgcggaaataggggcccctccctgcgcactaccacagcttcagggaaactcattacggagtggtgctgtcggagttgcaccctgccgcctcttagatacaggggagaggacggctgttggtacggtatggaaatacgcccattgaaggagaaggaagagaacctggtcaatagcttagtgactgccgggcatggacaaatcgataacttttcgctcggcgttctgggtatggcgcttttcctggaagagatgttgcgaacacgggtgggcaccaaacacgccattctcctggtagctgtctcctttgtgactctaatcacagggaatatgtctttccgtgacctgggaagagtgatggtcatggttggcgcaaccatgacggatgacattgggatgggagtgacttatctcgccctgcttgctgcctttaaggtaaggcccaccttcgcagcgggcttgctgttacgcaaactcacaagcaaggagctgatgatggccaccatcggtatagcacttctgtcacagagtactatccctgaaacaattctagagctcaccgatgccctggcattggggatgatggtgctgaaaatcgtccggaacatggaaaagtaccagttagctgtgacaattatggccatctcctgcgttcccaatgcagtgatactccaaaacgcctggaaggtctcttgtactattctggctgcggtgagcgtttccccacttctgttgacctcaagccagcagaaagccgactggatccctctcgcactgacgatcaagggactaaatcccacagctatttttctgaccactcttagtagaacctctaaaaagaggtcctggccactcaacgaggccgtgatggccgtcggcatggtaagcatactggcttcgtcattgctgaaaaatgacatcccgatgacaggccctttagtggcagggggactcctgactgtttgctatgtgcttaccggtcgatctgccgatctggaattggagcgcgcggctgacgtcaagtgggaggatcaggccgaaattagtggctccagccccatcctctctattacgatcagcgaggacgggtccatgtcaatcaagaacgaagaggaggaacacacactgaccatcctaattcggactggactgcttgtgatcagtggcgtattcccagtgagcattcccatcacagcagccgcttggtacctctgggaggtcaagaagcaaagagctggtgttctgtgggatgtgccttctccaccccctgtggggaaagccgaattggaggacggagcgtataggataaagcagcgtggcatttttggctactcccagatcggggctggagtctataaagaaggtaccttccatactatgtggcacgtgacacgcggcgccgttttaatgcatcgggggaagagaatcgagccgtcatgggcagatgtcaaaaaggacctgattagttacggaggcggttggaagctcgagggggaatggaaagagggagaagaggtgcaggtcctggcccttgaaccaggcaagaatcccagggctgtgcaaaccaaacctggcctgtttaagacgaacactgggaccatcggagccgttagcttggatttctccccaggtacatctggctcgcccatagtggaccgaaaagggaaggtcgtgggactatacggcaatggtgtagtcacccggagcggggcatatgtgtcagctattgcccagacagagaagtccatcgaggataaccctgaaattgaggacgatatcttccgcaaaaagagactgactataatggacctccacccgggagcgggcaaaaccaagaggtacctgcccgccattgttcgggaagcaatcaaacgaggccttagaacgttaatcctggctccaacacgcgtggtcgccgctgagatggaagaggcactcagggggttgcctattcgttatcagactcccgccatccgggccgagcataccggaagagaaattgtggacctgatgtgtcacgctacatttaccatgaggctcctgagtccagttcgcgtgcctaactacaatcttataatcatggatgaggcgcacttcactgaccccgcatctattgccgctcgaggttatatcagcaccagagtcgaaatgggcgaggccgcagggatctttatgacagccacgccaccgggatcccgggatcctttcccccagtcaaacgctccaattatggacgaggaaagggagatacccgaacgctcttggaatagcggccatgagtgggtgactgattttaagggtaagaccgtatggttcgtgcctagtatcaaagcggggaacgacattgccgcatgcctgcgtaagaatggcaaaaaggttatccaattgtccagaaaaacatttgatagcgaatacgtcaagacccgggctaacgactgggatttcgtggtgactacagacatttctgagatgggcgccaattttagggcagagcgcgtcatcgatccacgaagatgtatgaagcccgtaatactaaccgacggcgaagaacgggtgatcctggccgggcctatgccggttacgcactcatccgctgcccagaggcgcggaagaattggtaggaaccccaaaaatgaaaacgaccagtatatctacatgggcgagcccctcgaaaatgatgaggactgcgcgcattggaaggaggcaaaaatgttactggataacattaatactcctgaagggatcatacccagtatgttcgagccagaacgggagaaggtggacgccattgatggagaataccgtcttcgcggcgaggctcgaaaaacatttgtcgacctgatgagaaggggtgatctccctgtgtggttggcctatcgggttgctgcagaggggatcaactacgccgaccgcagatggtgtttcgatggcattaagaataaccaaatcctggaagagaacgtggaagtcgagatatggaccaaagagggagaaaggaagaagctcaaaccccggtggctggacgctcgaatctatagcgatccacttgccctaaaggagttcaaagaatttgcagcgggcagaaagtcgctgaccttgaatttaattactgagatggggcgcctgcctacattcatgacccagaaagccagggacgctctcgataacctggccgtgcttcacacagcagaagtaggaggtcgggcttacaatcacgccctgtctgagctcccggagactttggaaacgctgctactgctcacccttctggcaacagtgactggcgggatctttttattcttgatgtccggaaagggcattggtaagatgaccctggggatgtgctgcatcataacagccagcattctcctgtggtatgctcagatccagccccattggatcgcggcctcaattatccttgagtttttcctgatagttctcttgattccagaacctgagaaacaacgtaccccacaggacaaccagctgacttacgtcgtgatcgcaattttaacggtggtcgctgccaccatggccaatgaaatgggctttctagagaagaccaaaaaggacctgggactcggcagtatcactacccaggagtctgaatccaacatacttgatatcgacctgagaccagcaagcgcttggacattgtatgccgttgcgaccactttcgtgacacctatgctgaggcactcaattgagaatagtagcgtaaacgtgtccctcacggctatcgccaatcaagcaaccgtcctgatggggcttggacgcggttggcccctctctaaaatggatattggcgtgccgctgttggccatcgggtgttacagccaggttaacccaattactctgacagctgcattactactgctcgtggcccattacgcgatcataggacctggccttcaggctaaggccacccgggaagcacagaagcgaaccgccgctggtattatgaaaaatcccacagtcgacgggatcactgtaatcgatctggagccaattccctatgaccctaagtttgaaaaacaattgggccaggtgatgctgctcgttctgtgcgtgacgcaggtccttatgatgagaaccacatgggccttatgtgaggcactgactctcgctaccggaccgatatccacattgtgggagggcaaccccgggaggttctggaataccactatcgccgtgtcaatggcgaacatttttcgcggatcttacctggccggcgcaggtctactgttcagtatcatgaagaatacgacaaacacccggagagggactggaaatatgggcgaaaccctcggtgagaaatggaagtcgcgtcttaacgctctgggcaagagcgaatttcagatttataaaaagtccgggatccaagaggtcgataggacattggccaaagagggaataaagcggggcgaaactgaccaccatgcagtgtctcgcgggtcagctaaactgcgatggttcgttgagagaaacatggtgaccccagaaggaaaggtagtggatctcggctgcggtagagggggatggagctactattgtggcggtctgaaaaatgtccgggaggttaagggcttaacaaaagggggacctggccacgaggaaccaatccctatgtccacgtacgggtggaaccttgtgcgcctgcagagtggagtcgacgtgttctttaccccacccgagaaatgcgatactctcctatgtgacattggcgaatctagccctaatccaacaatcgaggccggtagaaccctgagggtattgaacctggtggaaaattggctcaacaataacactcagttctgcattaaggttcttaatccctatatgccgtcagtgatcgagaaaatggaaacactgcaacgaaagtacgggggagccttggtccggaaccctctgtcccgtaatagtacccacgagatgtactgggtgagcaacgcgacgggcaatatagtctcttccgtgaacatgatttcaagaatgctcatcaatcgctttaccatgaaacataagaaggctacatatgagccagatgttgacttaggcagcgggactaggaacatcggaattgaaaacgagatacccaatctggacatcattggtaaacggatcgaaaagattaaacaggagcacgaaacctcgtggcattacgatcaggaccacccttataagacatgggcataccacggctcttatgagactaaacagaccgggagtgcctccagcatggtaaacggagtggtcaaacttctgacaaagccatgggatgtggttcccatggtgacccaaatggctatgactgacacgacaccgttcggccagcagagagtctttaaagagaaggtggatacccgcactcaggaacctaaagagggtaccaagaaactaatgaggatcacagccgaatggctctggaaggagctggggaagaaaaagacgccccgaatgtgtacccgggaggagttcactagaaaagtaaggtcaaatgcagccttgggagctatatttacagacgagaacaagtggaaatccgcgcgcgaagccgtggaggattctcgtttctgggaactggttgaccgggagagaaatctccatcttgagggcaagtgcgaaacctgtgtctacaacatgatgggcaaaagggagaagaagctgggggaatttggaaaagcaaagggtagccgcgctatctggtatatgtggttaggcgcccgattcctggagtttgaagcattggggttcctcaatgaggatcactggtttagtcggggaaactccctgagcggcgtggagggtgaagggctacataaacttggatacattctgagagacgtgtctaagaaagagggcggcgccatgtacgctgatgacactgccgggtgggacacaaggatcaccctcgaagatctgaagaatgaggaaatggtcacaaaccacatgaagggagagcataaaaagttggcggaggcaattttcaaactgacttatcaaaataaggttgtgcgcgtacagagaccaacccctcggggtacggtgatggacatcatttcaaggaaagatcagcgtggcagtgggcaggtcggaacctacggcctcaacacattcactaatatggaagcccaacttatacgacagatggagggtgaagggatctttaagtccattcagcgcctgaccgtgacagaggagatcgctgttcaaaactggttagccagagtgggacgggaaaggctgagccgcatggcaatctctggcgacgattgcgtcgtgaagcccttggacgatagattcgcttcggccctcactgctctgaatgacatgggcaaagtacggaaggatattcagcagtgggagccatcaagggggtggaacgactggacccaggttcccttttgcagccaccacttccatgagctagtgatgaaagatggacgagtccttgtggtgccttgtcgtaaccaagacgagctgataggtagagcccgcatctcccagggcgcagggtggagtctcaaggaaacggcgtgcctgggaaaatcttatgcccagatgtggacattgatgtactttcaccggagggatttaagactggctgccaatgcaatttgtagcgctgtcccatcccattgggttccgacctcacgcactacatggagtatccacgccaagcacgagtggatgaccactgaggacatgctcgcagtgtggaaccgggtatggattcaggaaaatccctggatggaggacaagacccctgtggaatcttgggaggaagtcccatatcttggcaaaagggaggatcaatggtgcggtagcctgatcgggctaacatcccgagccacgtgggcgaagaacatacagaccgctatcaatcaggtgagatcactgattggaaacgaggaatacactgactatatgcccagcatgaaacggttcaggaaggaggaagaggaagccggcgttctctggtga

SEQ ID NO: 14715 - RNA, 9876 nt, synthetic construct
  misc_feature 1..9876: note = derived and/or modified CDS sequence (opt3) from DENV-2__EU482724__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgacaccgggtgtgtggtttcctggaagaataaagaattgaagtgcggaagcggcatcttcataactgataacgtccacacatggaccgagcagtacaagtttcagcccgaatctccatcaaaactcgctagtgccattcaaaaggcacatgaggaaggtatctgtggcattaggagcgtgactcggctggagaatttaatgtggaaacagatcacccccgagctgaaccacatactatccgaaaatgaggtgaagctcacaatcatgacgggggacattaaaggaatcatgcaggccggcaagcgctctctgagacctcagccaaccgaacttaaatattcgtggaagacttgggggaaggctaaaatgttgagcacagagtcccataaccaaaccttcctgattgatggaccggaaacagccgagtgccccaatacttcaagggcatggaacagtctcgaggtcgaagactacggctttggtgttttctctaccaatatctggctgaagttacgtgagaaacaggacgtgttttgtgatagcaagctgatgtccgcggctataaaagacaaccgggccgtgcacgcagatatggggtattggattgaatcagcccttaatgacacgtggaagatggagaaggctagcttcatcgagatcaaatcttgccactggcctaagtcccatacattgtggagtaacggagtactcgaaagcgagatgattatcccaaaaaatttcgccggccccgtctctcagcacaactaccgacctggttatcatacccagactgcaggcccatggcacctggggaagctagaaatggattttgacttctgtgagggaaccacagtggttgtgactgaagattgcggcaacagagggccctccctgaggaccacaacggcttcaggaaaactcattaccgagtggtgctgtcgcagttgcactctgccgcctcttcggtacagaggcgaggacggttgttggtacgggatggaaataaggccattgaaggagaaggaagagaatctggtcaacagcttagtgacagccggacatggccaaatcgataatttttcgctcggtgttctgggcatggcgcttttcctggaagagatgttgcgcacccgagtggggactaaacacgccattctcctggtagctgtctcctttgtgacactaatcaccggaaacatgtctttccgggacctgggccgtgtgatggtcatggttggggcaacgatgactgatgacattggaatgggcgtgacctatctcgccctgcttgctgcctttaaggtaagacccacattcgcagcgggtttgctgttaaggaaactcaccagcaaggagctgatgatggccactatcgggatagctcttctgtcacagagtacaatccctgaaaccattctagagctcacagatgccctggcattgggaatgatggtgctgaaaatcgtccgcaatatggaaaagtaccagttagctgtgactattatggccatctcctgcgttcccaacgcagtgatactccaaaatgcctggaaggtctcttgtaccattctggctgcggtgagcgtttccccacttctgttgacgtcaagccagcagaaagccgactggatccctctcgcactgacaatcaagggcctaaaccccaccgctatttttctgactacccttagtcggacatctaaaaagagatcctggccactcaatgaggccgtgatggccgtcggcatggtaagcatactggcttcgtcattgctgaaaaacgacatcccgatgactgggcctttagtggcaggaggtctcctgaccgtttgctatgtgcttacgggcaggtctgccgatctggaattggagcgagcggctgacgtcaagtgggaggatcaggccgaaattagtgggtccagccccatcctctctattacaatcagcgaggacggatccatgtcaataaaaaatgaagaggaggaacacaccctgactatcctaattcgcacaggcctgcttgtgatcagtggtgtattcccagtgagcattcccatcaccgcagccgcttggtacctctgggaggtcaagaagcaacgggcaggggttctgtgggatgtgccttctccaccccctgtgggaaaagccgaattggaggacggcgcgtatagaataaagcagaggggcatttttgggtactcccagatcggagctggtgtctataaagaaggcactttccatacaatgtggcacgtgacccgtggggccgttttaatgcatcgcggaaagcggatcgagccgtcatgggcagatgtaaaaaaggacctgattagttacggcggtgggtggaagctcgagggagaatggaaagagggcgaagaggtgcaggtcctggcccttgaaccaggcaagaaccccagagctgtgcaaacgaaacctgggctgtttaagactaataccggaacaatcggtgccgttagcttggatttctccccaggcacctctgggtcgcccatagtggacaggaaaggaaaggtcgtgggcctatacggtaacggggtagtcacacgaagcggagcatatgtgtcagctattgcccagactgagaagtccatcgaggataatcctgaaattgaggacgatatcttccggaaaaagcgcctgaccataatggacctccacccgggcgcgggcaaaacgaagagatacctgcccgccattgttagggaagcaatcaaacgggggcttcgaacattaatcctggctccaactagagtggtcgccgctgagatggaagaggcactccgcggattgcctattaggtatcagacccccgccatccgtgccgagcatacaggtcgggaaattgtggacctgatgtgtcacgctacctttactatgagactcctgagtccagttagggtgcctaactacaaccttataatcatggatgaggcgcacttcaccgaccccgcatctattgccgctcgcggctatatcagcacacgagtcgaaatgggggaggccgcaggaatctttatgacggccactccaccgggctccagagatcctttcccccagtcaaatgctccaattatggacgaggaacgggagatacccgaaaggtcttggaacagcggtcatgagtgggtgaccgattttaaggggaagacagtatggttcgtgcctagtatcaaagcgggaaatgacattgccgcatgcctgcgcaagaacggcaaaaaggttatccaattgtcccgtaaaacctttgatagcgaatacgtcaagactagagctaatgactgggatttcgtggtgacaaccgacatttctgagatgggcgccaactttcgggcagagagggtcatcgatccacgccgatgtatgaagcccgtaatactaacggacggggaagagagagtgatcctggccggacctatgccggttactcactcatccgctgcccagcggaggggtcgcattggcagaaatccaaaaaacgaaaatgaccagtatatctacatgggggagcccctcgaaaacgatgaggactgcgcgcattggaaggaggcaaaaatgttactggataatattaacacacctgaaggaatcatacccagtatgttcgagccagaaagggagaaggtggacgccattgatggcgaataccggcttcgtggtgaggctcgcaaaacctttgtcgacctgatgcgaagaggggatctccctgtgtggttggcctatagggttgctgcagagggcatcaattacgccgaccggcgctggtgtttcgatggaattaagaacaatcaaatcctggaagagaacgtggaagtcgagatatggaccaaagagggcgaaagaaagaagctcaaacccaggtggctggacgctcggatctatagcgatccacttgccctaaaggagttcaaagaatttgcagcggggcgaaagtcgctgactttgaacttaattacagagatgggaagactgcctaccttcatgacacagaaagcccgcgacgctctcgataatctggccgtgcttcacactgcagaagtaggtggcagggcttacaaccacgccctgtctgagctcccggagacgttggaaaccctgctactgctcacacttctggcaactgtgaccgggggaatctttttattcttgatgtccggcaagggtattgggaagatgacactgggcatgtgctgcatcataaccgccagcattctcctgtggtatgctcagatccagccccattggatcgcggcctcaattatccttgagtttttcctgatagttctcttgattccagaacctgagaaacaacggactccccaggacaatcagctgacgtacgtcgtgatcgcaattttaaccgtggtcgctgccacaatggccaacgaaatgggatttctagagaagactaaaaaggacctgggcctcgggagtatcaccacacaggagtctgaatccaatatacttgatatcgacctgcgtccagcaagcgcttggaccttgtatgccgttgcgactacattcgtgacgcctatgctgagacactcaattgagaacagtagcgtaaatgtgtccctcaccgctatcgccaaccaagcaactgtcctgatgggacttggtaggggctggcccctctctaaaatggatattggggtgccgctgttggccatcggatgttacagccaggttaatccaattacactgaccgctgcattactactgctcgtggcccattacgcgatcataggccctggtcttcaggctaaggccacccgcgaagcacagaagcggacagccgctgggattatgaaaaaccccactgtcgacggcatcacggtaatcgatctggagccaattccctatgaccctaagtttgaaaaacaattgggacaggtgatgctgctcgttctgtgcgtgacccaggtccttatgatgcgaacaacttgggccttatgtgaggcactgaccctcgctacaggcccgatatccaccttgtgggaggggaatcccggaagattctggaacactacgatcgccgtgtcaatggcgaatatttttaggggctcttacctggccggtgcagggctactgttcagtatcatgaagaacacaaccaatactcgccggggaaccggcaacattggtgaaacactcggcgagaaatggaagtcgagacttaatgctctggggaagagcgaatttcagatctataaaaagtccggaatacaagaggtcgatcgtactttggccaaagagggcatcaagaggggggaaaccgaccaccatgcagtgtctcggggatcagctaaactgcgctggttcgttgagcgaaacatggtgacaccagaaggcaaggtagtggatctcggttgcgggagaggaggctggagctactattgtggtggcctgaaaaacgtcagggaggttaaggggttaacgaagggaggccctgggcacgaagagcccattcctatgtccacctacggatggaatcttgtgcggctgcagagtggcgtcgacgtgttctttactccacccgagaaatgcgatacactcctatgtgacatcggtgaatctagccctaacccaaccattgaggccgggcgcactctgagagtattgaatctggtggaaaactggctcaataacaatacacagttctgcgttaaggtgcttaacccctatatgccgtcagtcatcgagaaaatggaaaccctgcaaaggaagtacggaggcgccttggtgcgaaatcctctgtcccggaacagtacgcacgagatgtactgggtcagcaatgcgaccggcaacatagtgtcttccgttaatatgatttcacgtatgctcatcaacagatttacaatgaaacataagaaggctacttatgagccagatgtagacttagggagcggaacccgcaatatcggtattgaaaacgagatacccaacctggacatcattggcaaaaggatcgaaaagattaaacaggagcacgaaacatcgtggcattacgatcaggaccacccttataagacttgggcataccacgggtcttatgagaccaaacagacaggaagtgcctccagcatggtgaatggcgtcgtgaagcttctgaccaagccatgggatgttgtgcccatggtcactcaaatggctatgacggacacaaccccgttcggtcagcagcgggtgtttaaagagaaggtagatactagaacccaggaacctaaagaggggacaaagaaactaatgcgcatcacggccgaatggctctggaaggagctgggaaagaaaaagacccccaggatgtgtactcgagaggaattcacacggaaagtgagatcaaacgcagccttgggcgctatatttaccgacgagaataagtggaaatccgcgagggaagccgttgaggattctcgcttctgggaactggtcgaccgtgagcggaacctccatcttgagggcaagtgcgaaacttgtgtgtacaatatgatggggaaaagagagaagaagctgggagaatttggtaaagcaaagggcagcagggctatctggtatatgtggttaggggcccgcttcctggagtttgaagcattgggattcctcaacgaggatcactggtttagtcgaggcaattccctgagcggtgtggagggggaaggactacataaacttggctacattctgcgggacgtctctaagaaagagggcggggccatgtacgctgatgacacagccggatgggacaccagaatcacactcgaagatctgaagaacgaggaaatggttactaatcacatgaagggtgagcataaaaagttggcggaggcaattttcaaactgacctatcaaaacaaggtggtaagggtgcagcgcccaacgcctagaggcaccgtcatggacatcatttcacggaaagatcagagggggagtggacaggtgggcacatacggtctcaatactttcaccaacatggaagcccaacttatacgtcagatggagggggaaggaatctttaagtccattcagcgactgacagttactgaggagatcgctgtgcaaaattggttagcccgcgtcggcagagaacggctgagcaggatggcaatctctggcgacgattgcgtggtaaagcccttggacgatcgcttcgcttcggccctcaccgctctgaacgacatggggaaagttagaaaggatattcagcagtgggagccatcacggggatggaatgactggacgcaggtgcccttttgcagccaccacttccatgaactagtcatgaaagatggtagggtgcttgtggtcccttgtcgaaaccaagacgagctgataggccgtgccagaatctcccagggggcaggatggagtctcaaggaaacagcgtgcctgggcaaatcttatgcccagatgtggaccttgatgtactttcaccgccgggatttaaggctggctgccaacgcaatttgtagcgctgttccatcccattgggtgccgacttcaagaacaacctggagtatccacgccaagcacgagtggatgactaccgaggacatgctcgcagtatggaatcgcgtgtggattcaggaaaacccctggatggaggacaagacacctgtcgaatcttgggaggaagtgccatatcttggtaaacgggaggatcaatggtgcgggagcctgatcggactaacgtccagggccacctgggcgaagaatatacagactgctatcaaccaggttcgatcactgattggcaatgaggaatacacagactatatgcccagcatgaaaagattccggaaggaggaagaggaagccggcgtgctctggtga

SEQ ID NO: 14716 - RNA, 9876 nt, synthetic construct
  misc_feature 1..9876: note = derived and/or modified CDS sequence (opt3) from DENV-2__EU482725__SS-prME
  source 1..9876: mol_type = other RNA
accgccggcgtgataattatgctgatacccacagctatggctttccacctcactacgaggaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtcgcgctggtgccccatgtcggtatggggcttgagaccaggacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgcggtgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttatctgcaagcattctatggtggatagaggctggggtaacgggtgtggactattcggcaagggcgggattgtaacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgacaccgggtgtgtggtttcctggaagaataaagaattgaagtgcggaagcggcatcttcataactgataacgtccacacatggaccgagcagtacaagtttcagcccgaatctccatcaaaactcgctagtgccattcaaaaggcacatgaggaaggtatctgtggcattaggagcgtgactcggctggagaatttaatgtggaaacagatcacccccgagctgaaccacatactatccgaaaatgaggtgaagctcacaatcatgacgggggacattaaaggaatcatgcaggccggcaagcgctctctgagacctcagccaaccgaacttaaatattcgtggaagacttgggggaaggctaaaatgttgagcacagagtcccataaccaaaccttcctgattgatggaccggaaacagccgagtgccccaatactaacagggcatggaactcactcgaggtcgaagactacggctttggtgttttcagtaccaacatctggctgaagttacgtgagaaacaggacgtgttttgtgattctaagctgatgagcgcggctataaaagacaatcgggccgtgcacgcagatatggggtattggattgaatccgcccttaacgacacgtggaagatggagaaggcttcattcatcgagatcaaaagctgccactggcctaagtctcatacattgtggtccaatggagtactcgaaagtgagatgattatccccaagaatttcgccggccccgtcagccagcacaactaccgacctggttatcatacccagactgcaggcccatggcacctggggaagctagaaatggattttgacttctgtgagggaaccacagtggttgtgactgaagattgcggcaatagagggccctctctgaggaccacaacggcttccggaaaactcattaccgagtggtgctgtcgctcatgcactctgccgcctcttcggtacagaggcgaggacggttgttggtacgggatggaaataaggccattgaaggagaaggaagagaacctggtcaatagtttagtgacagccggacatggccaaatcgataactttagcctcggtgttctgggcatggcgcttttcctggaagagatgttgcgcacccgagtggggactaaacacgccattctcctggtagctgtctcgtttgtgacactaatcaccggaaatatgtccttccgggacctgggccgtgtgatggtcatggttggggcaacgatgactgatgacattggaatgggcgtgacctatctcgccctgcttgctgcctttaaggtaagacccacattcgcagcgggtttgctgttaaggaaactcacctctaaggagctgatgatggccactatcgggatagcacttctgagccagtcaacaatccctgaaaccattctagagctcacagatgccctggcattgggaatgatggtgctgaaaatcgtccgcaacatggaaaagtaccagttagctgtgactattatggccatcagttgcgttcccaatgcagtgatactccaaaacgcctggaaggtctcctgtaccattctggctgcggtgtctgttagcccacttctgttgacgtcctcacagcagaaagccgactggatccctctcgcactgacaatcaagggcctaaatcccaccgctatttttctgactacccttagccggacaagtaaaaagagatcttggccactcaacgaggccgtgatggccgtcggcatggtatccatactggctagctcgttgctgaaaaatgacatcccgatgactgggcctttagtggcaggaggtctcctgaccgtttgctatgtgcttacgggcaggtcagccgatctggaattggagcgagcggctgacgtcaagtgggaggatcaggccgaaatttctgggagttcccccatcctcagcattacaatctctgaggacggaagcatgtccatcaaaaatgaagaggaggaacacaccctgactatcctaattcgcacaggcctgcttgtgatctcaggtgtattcccagtgagtattcccatcaccgcagccgcttggtacctctgggaggtccggaagcaaagagcaggggttctgtgggatgtgcctagcccaccccctgtgggaaaggccgaattggaggacggcgcgtataggataaaacagcgtggcatttttgggtactctcagatcggagctggtgtctataaggaaggcactttccatacaatgtggcacgtgacccgcggggccgttttaatgcatcggggaaaaagaatcgagccgtcctgggcagatgtaaagaaagacctgatttcatacggcggtgggtggaagctcgagggagaatggaaggagggcgaagaggtgcaggtcctggcccttgaaccaggcaaaaatcccagggctgtgcaaacgaagcctgggctgtttaaaactaacaccggaacaatcggtgccgttagtttggatttcagcccaggcacctccgggtctcccatagtggaccgaaagggaaaagtcgtgggcctatacggtaatggggtagtcacacggtcgggagcatatgtgagcgctattgcccagactgagaagtcaatcgaggataaccctgaaattgaggacgatatcttccgcaagaaaagactgaccataatggacctccacccgggcgcgggcaagacgaaaaggtacctgcccgccattgttcgggaagcaatcaagcgagggcttagaacattaatcctggctccaactcgcgtggtcgccgctgagatggaagaggcactcaggggattgcctattcgttatcagacccccgccatccgggccgagcatacaggtagagaaattgtggacctgatgtgtcacgctacctttactatgaggctcctgtccccagttcgcgtgcctaactacaatcttataatcatggatgaggcgcacttcaccgaccccgcaagtattgccgctcgaggctatatctctacaagagtcgaaatgggggaggccgcaggaatctttatgacggccactccaccgggcagccgggatcctttcccccagtccaacgctccaattatggacgaggaaagggagatacccgaacgctcatggaactctggtcatgagtgggtgaccgattttaaagggaagacagtatggttcgtgcctagcatcaaggcgggaaacgacattgccgcatgcctgcgtaaaaatggcaagaaagttatccaattgagtagaaagacctttgattccgaatacgtcaaaactcgggctaacgactgggatttcgtggtgacaaccgacattagcgagatgggcgccaattttagggcagagcgcgtcatcgatccacgaagatgtatgaagcccgtaatactaacggacggggaagaacgggtgatcctggccggacctatgccggttactcactcttcagctgcccagaggcgcggtagaattggcaggaacccaaagaatgaaaacgaccagtatatctacatgggggagcccctcgaaaatgatgaggactgcgcgcattggaaagaggcaaagatgttactggataacattaatacacctgaaggaatcataccctccatgttcgagccagaacgggagaaagtggacgccattgatggcgaataccgtcttcgcggtgaggctcgaaagacctttgtcgacctgatgagaagaggggatctccctgtgtggttggcctatcgggttgctgcagagggcatcaactacgccgaccgcagatggtgtttcgatggaattaaaaataaccaaatcctggaagagaacgtggaagtcgagatatggaccaaggagggcgaaaggaaaaagctcaagccccggtggctggacgctcgaatctatagtgatccacttgccctaaaagagttcaaggaatttgcagcggggagaaaaagcctgactttgaatttaattacagagatgggacgcctgcctaccttcatgacacagaaggccagggacgctctcgataacctggccgtgcttcacactgcagaagtaggtggccgggcttacaatcacgccctgtcggagctcccggagacgttggaaaccctgctactgctcacacttctggcaactgtgaccgggggaatctttttattcttgatgtctggcaaaggtattgggaagatgacactgggcatgtgctgcatcataaccgcctccattctcctgtggtatgctcagatccagccccattggatcgcggccagcattatccttgagtttttcctgatagttctcttgattccagaacctgagaagcaacgtactccccaggacaaccagctgacgtacgtcgtgatcgcaattttaaccgtggtcgctgccacaatggccaatgaaatgggatttctagagaaaactaagaaagacctgggcctcgggtcaatcaccacacaggagagtgaatctaacatacttgatatcgacctgagaccagcatccgcttggaccttgtatgccgttgcgactacattcgtgacgcctatgctgaggcacagcattgaaaattcaagtgtaaacgtgagcctcaccgctatcgccaatcaagcaactgtcctgatgggacttggtcgcggctggcccctctccaagatggatattggggtgccgctgttggccatcggatgttactctcaggttaacccaattacactgaccgctgcattactactgctcgtggcccattacgcgatcataggccctggtcttcaggctaaagccacccgggaagcacagaagcgaacagccgctgggattatgaagaatcccactgtcgacggcatcacggtaatcgatctggagccaattccctatgaccctaaatttgaaaagcaattgggacaggtgatgctgctcgttctgtgcgtgacccaggtccttatgatgagaacaacttgggccttatgtgaggcactgaccctcgctacaggcccgataagcaccttgtgggaggggaaccccggaaggttctggaatactacgatcgccgtgtccatggcgaacatttttcgcggctcatacctggccggtgcagggctactgttctctatcatgaaaaatacaaccaacactcggagaggaaccggcaatattggtgaaacactcggcgagaagtggaaaagtcagcttaacgctctggggaagtcggaatttcaaatctataagaaaagcggaatacaggaggtcgatcgtactttggccaaggagggcatcaaaagaggggaaaccgaccaccatgcagtgtcccggggatctgctaagctgcgctggttcgttgagcgaaacatggtgacaccagaaggcaaagtagtggatctcggttgcgggagaggaggctggtcatactattgtggtggcctgaagaatgtcagggaggttaaagggttaacgaagggaggccctgggcacgaagaaccaattcctatgagcacctacggatggaaccttgtgcggctgcagtccggcgtcgacgtgttctttactccacccgagaagtgcgatacactcctatgtgacatcggtgaaagttctcctaatccaaccattgaggccgggcgcactctgagagtattgaacctggtggaaaattggctcaacaataacacacaattctgcgttaaagtgcttaatccctatatgccgagcgtcatcgagaagatggaaaccctgcagaggaaatacggaggcgccttggtgcgaaaccctctgtcaagaaattccacgcacgagatgtactgggtcagtaacgcgaccggcaatatagtgagctctgttaacatgatttcccgtatgctcatcaatagatttacaatgaagcataaaaaggctacttatgagccagatgtagacttagggtcaggaacccgcaacatcggtattgaaaacgagatacccaatctggacatcattggcaagaggatcgagaaaattaagcaggagcacgaaacaagctggcattacgatcaggaccacccttataaaacttgggcataccacgggtcgtatgagaccaagcaaacaggatctgccagttccatggtgaacggcgtcgtgaaacttctgaccaagccatgggatgttgtgcccatggtcactcagatggctatgacggacacaaccccgttcggtcagcagcgggtgtttaaggagaaagtagatactagaacccaagaacctaaggaggggacgaaaaagctaatgcgcatcacagccgaatggctctggaaagagctgggaaagaagaaaacccccaggatgtgtactcgagaggagttcacacggaaggtgagaagcaatgcagccttgggcgctatatttaccgacgagaacaaatggaagtcagcgagggaagccgttgaggattcccgcttctgggaactggtcgaccgtgagcggaatctccatcttgagggcaaatgcgaaacttgtgtgtacaacatgatggggaagagagagaaaaagctgggagaatttggtaaggcaaaaggctctagggctatctggtatatgtggttaggggcccgcttcctggagtttgaagcattgggattcctcaatgaggatcactggtttagccgaggcaacagtctgtccggtgtggagggggaaggactacataaacttggctacattctgcgggacgtcagcaaaaaggagggcggggccatgtacgctgatgacacagccggatgggacaccagaatcacactcgaagatctgaaaaatgaggaaatggttactaaccacatgaagggtgagcataagaaattggcggaggcaattttcaagctgacctatcagaataaagtggtaagggtgcagcgcccaacgcctagaggcaccgtcatggacatcatttctcggaaggatcagagggggtcaggacaagtgggcacatacggtctcaacactttcaccaatatggaagcccagcttatacgtcagatggagggggaaggaatctttaaaagtattcaacgactgacagttactgaggagatcgctgtgcagaactggttagcccgcgtcggcagagaacggctgtccaggatggcaatcagcggcgacgattgcgtggtaaagcccttggacgatcgcttcgcttctgccctcaccgctctgaatgacatggggaaggttagaaaagatattcagcagtgggagccatcgcggggatggaacgactggacgcaagtgcccttttgctcacaccacttccatgagctagtcatgaaggatggtagggtgcttgtggtcccttgtcgaaaccaggacgagctgataggccgtgccagaatcagccagggggcaggatggtccctcaaagaaacagcgtgcctgggcaagagttatgcccagatgtggaccttgatgtactttcaccgccgggatttaaggctggctgccaatgcaatttgttctgctgttccaagccattgggtgccgacttccagaacaacctggtcaatccacgccaaacacgagtggatgactaccgaggacatgctcgcagtatggaaccgcgtgtggattcaagaaaatccctggatggaggacaagacacctgtcgaaagttgggaggaagtgccatatcttggtaagcgggaggatcagtggtgcgggtctctgatcggactaacgagcagggccacctgggcgaaaaacatacagactgctatcaatcaggttcgatccctgattggcaacgaggaatacacagactatatgccctcaatgaagagattccggaaagaggaagaggaagccggcgtgctctggtga

SEQ ID NO: 14717 - RNA, 9876 nt, synthetic construct
  misc_feature 1..9876: note = derived and/or modified CDS sequence (opt3) from DENV-2__EU482726__SS-prME
  source 1..9876: mol_type = other RNA
accgcaggagtgatcgtcatgctgattcccacagttatggctttccacctcactacgaggaatggggagcctcatatgatagtgggaaggcaggaaaagggtaaaagccttctgtttaagaccgaggacggcgtgaatatgtgcacattgatggcaatcgatttaggggaactgtgtgaggacactattacctacaaatgcccattactccggcaaaacgaaccggaggatatcgactgttggtgcaattccacatctacctgggtgacttatggaacatgtaccacgactggcgagcaccgccgagaaaagcgttcagtcgccctggtgccccatgttggtatggggcttgagacccggacagaaacttggatgagtagcgagggagcgtggaaacacgtgcagaggattgagacctggatcctgcggcatcctggcttcacaataatggctgccatcttggcatacaccattggcacgactcactttcagcgcgccctcatcttcattctgctgacagctgtcgcaccatccatgaccatgagatgcatcgggatatctaacagggattttgtggaaggagtatcgggtggctcatgggttgacattgtgctcgagcacgggagctgtgtcactacaatggccaagaataagcccaccttagatttcgaactgatcaaaacggaggctaagcagcctgccacccttcggaaatattgcattgaagcgaagttgacaaacactaccacagagagtcgctgtccaactcaaggagagccctccctgaatgaagaacaggacaaacgatttatctgcaagcattctatggtggatagaggctggggtaacgggtgtggattattcggcaagggcgggatcgtgacctgcgcaatgtttacatgcaaaaagaatatggaaggaaaaattgtccagcctgagaacctcgaatacaccatagttatcactccacacagcggtgaggagcatgccgtgggcaatgacacggggaagcacggaaaagaaattaagatcacaccgcagtcctcaaccactgaggctgaactgaccggctatggtacagtaaccatggagtgtagtcccaggactgggcttgatttcaacgaaatggtgctgttgcaaatggaggacaaagcctggctcgtccaccggcagtggtttctggatttacctctgccatggctccccggcgcagacacacagggaagcaattggatacagaaggagacgcttgtgaccttcaagaaccctcatgctaaaaagcaagacgttgtggtcctgggctctcaggaaggggccatgcacactgcgttgacaggagccaccgagattcagatgtcctcaggtaatctactgtttacaggccatctcaaatgccgtctgcgcatggataaacttcaactgaaagggatgagctacagtatgtgtatcggaaagttcaagatcgtgaaagaaattgcagagactcagcacggcaccatcgtaattagagttcagtatgagggtgacgggtctccatgcaagatacccttcgaaatcacggatttggagaaaaggcatgtgctcggccggctgattaccgtcaacccgatcgtgacagaaaaggacgctcctgtcaacatcgaggccgaacccccatttggagattcctacattatagtgggcgttgagcctgggcagttaaaactgaattggttcaagaagggaagctcgatcggtcaaatgtttgagactaccatgcgaggcgctaaacgcatggccattctaggggacacagcatgggatttcggatctctcggcggtgtgtttacttccatcgggaaggccctgcaccaggtattcggcgctatttacggagcggcattttcaggcgtcagttggaccatgaaaatccttataggggtgatcattacgtggatcggaatgaacagcagatccacatctttgagcgtttcactggtgctcgtcggcgtggtaaccctgtatcttggtgccgtggttcaggctgacagtgggtgtgtcgtgtcctggaagaataaagaactgaagtgcggaagcggcattttcatcactgataacgtgcacacatggaccgagcagtacaagtttcaacccgaatctccatcaaaattggccagtgcaatacagaaggcccatgaggaaggtatttgtggcatcaggagcgtcactcggctcgagaatctgatgtggaaacagattacccccgagttaaaccacatcctgtccgaaaatgaggttaagctaacaataatgacgggggacatcaaaggaattatgcaggctggcaagcgctctctcagacctcaaccaaccgaactgaaatattcgtggaagacttgggggaaggccaaaatgcttagcacagagtcccataaccagaccttcttgatcgatggaccggaaacagcagagtgccccaatactaacagggcgtggaactcactggaggtggaagactacggctttggtgtgttcaccacgaacatttggctcaagctgcgtgagaaacaggacgtattttgtgatagtaagttaatgtctgctgccatcaaagacaatcgggcagtccacgccgatatggggtattggatagaaagcgctctgaacgacacatggaagatggagaaggcctccttcattgaggtgaaatcatgccactggcctaagagccataccctttggtctaatggagttttggaatccgagatgatcatccccaagaatttcgcaggccccgtgagtcagcacaactaccgacctggttatcatactcaaaccgctggcccatggcacctcgggaagctggaaatggattttgacttctgtgagggaacaactgtcgtggttaccgaagattgcggcaatagagggcccagcctaaggacaacgaccgcctctggaaaactgattactgagtggtgctgtcgctcctgcacactcccgcctctgcggtacagaggcgaggacggttgttggtacgggatggaaatcaggccacttaaggagaaggaagagaacttggtaaattcactggtaaccgcgggacatggccagattgataactttagtttaggtgtcctcggcatggccctgttccttgaagagatgctgcgcactcgagtggggacaaaacacgctaccttgctcgtggcactgagctttgtcacgctaataactggaaatatgtcgttccgggacctgggccgtgttatggtgatggtaggggccaccatgacagatgacatcggaatgggcgtgacctatctcgctctgcttgccgcatttaaggtcagacccactttcgcggccggtttgctgttaaggaaactcacatccaaggagctgatgatggctaccattgggatcgcccttctgtctcagagcacactacctgaaactattctcgagctgaccgatgcattggctctgggaatgatggtgttaaaaatcgttcgcaacatggaaaagtaccaactcgccgtgacgataatggcaatctcatgcgtccccaatgccgtgattctgcagaacgcttggaaggttagttgtacaatccttgcggccgtgtccgtctctccactgttgctcaccagctcccagcagaaagcagactggattcctctggctctaactatcaagggcctgaatcccaccgccatatttcttacaactctctcacggaccagcaaaaagagaagttggccactgaacgaggccattatggctgtaggcatggtgtctatcttggcatccagcctgctaaagaatgacatcccgatgacggggcctctcgttgccggaggtctgcttacagtgtgctatgtcctgaccggcaggtcggcggatttggaactcgagcgagctgccgacgtgaagtgggaggatcaagcagaaatttcagggtctagtcccatactgtccatcactattagcgaggacggatctatgagcatcaaaaacgaagaggaggaacagacactaaccattctgatccgcactggccttctcgtaatatccggtgtgttcccagtctcaatccccattacagccgctgcatggtacctgtgggaggttaagaagcagcgggccggggtgttgtgggatgtgcctagtccaccccctgtcggaaaagcggaattagaggacggcgcttatagaatcaagcagaggggcattctggggtacagccaaatcggagccggtgtgtataaagaaggcacctttcacacgatgtggcatgttactcgtggggcagtactcatgcaccgcggaaagcggatagagccgtcttgggccgatgtgaaaaaggacctgatttcctacggcggtgggtggaaacttgagggagaatggaaagagggcgaagaggtccaggtgctggctttggaaccaggcaagaatcccagagccgttcagaccaaacctgggatcttcaagacaaacaccggaacaatcggtgcagtgtcactagattttagtccaggcactagcgggtcccccattgtcgacaggaaaggaaaggtggtaggcctgtacggtaatggggtcgtgacccgatctggagcttatgtttcggccatcgcgcagacggaaaagagcatagaggataaccctgaaattgaggacgatatcttccggaaaaagcgcctcacaattatggacctgcatccgggcgccggcaaaactaagagataccttcccgcaatcgtgagggaagctataaaacgggggttacgaaccctgattctcgccccaacaagagtcgtggctgcagagatggaagaggccttgcgcggactgcctatcaggtatcaaacccccgccatccgtgctgagcacactggtcgggaaattgttgacctcatgtgtcatgcgaccttcacaatgagactgctttcaccagtgagggtccctaactacaatctgatcattatggatgaggcacactttacggaccccgcctccatagctgcccgcggctatatcagtactcgagtggaaatgggggaggcagccggaattttcatgaccgctacaccaccgggctctagagatccttttccccagagcaacgcgccaatcatggacgaggaacgggagatccccgaaaggtcctggaactcaggtcacgagtgggtaaccgatttcaaggggaagactgtgtggtttgttccttctattaaagccggaaacgacatagcagcttgcttgcgcaagaatggcaaaaaggtcatccagctaagccgtaaaacattcgatagtgaatacgtgaagaccagagccaacgactgggattttgtggtcacgactgacatttccgagatgggcgcaaatttccgggccgagagggtaatcgatccacgccgatgtatgaagcccgtgattctgacagacggggaagagagagttatcctcgctggacctatgccggtgacccatagctctgccgcgcaacggaggggtcgcataggcagaaaccccaaaaatgaaaacgaccagtatatctacatgggggagcccttagaaaatgatgaggactgcgcacactggaaggaggccaaaatgctgcttgataacattaatacccctgaaggaatcattccctcaatgtttgagccagaaagggagaaggtcgacgctatcgatggcgaataccggctgcgtggtgaggcccgcaaaactttcgtggacctcatgcgaagaggggatttgcctgtttggctggcttatagggtggcagccgagggcataaactacgctgaccggcgctggtgttttgatggaattaagaataaccagatcctcgaagagaacgtcgaagtggagatttggacaaaagagggcgaaagaaagaagctgaaacccaggtggcttgacgcccggatctattccgatccactagcactgaaggagttcaaagagttcgcggccgggcgaaagagtttgaccttaaatctgataacagagatgggaagactccctacttttatgacgcagaaagctcgcgacgccctggataaccttgcagtactgcataccgctgaagtgggtggcagggcctacaatcacgcactcagcgagttgccggagacactggaaactctactgctccttaccctgttagccacagttaccgggggaatcttcttgtttctgatgtcgggcaagggtattgggaagatgactctcggcatgtgctgcatcattacggcttctatcctgctttggtatgcgcaaatacagccccactggattgccgcatccatcatcctggagttctttctcattgtcttgctgatcccagaacctgagaaacagcggacaccacaggacaaccaattaacatacgtggtgatagctattctaactgtcgttgccgccaccatggcaaatgaaatgggattcctggagaagaccaaaaaggacctcggccttgggagcatcaccactcaggagtcagaaagtaacattctggatatcgacttgcgtccagcttctgcctggacactgtatgcggtggctacgacctttgtaactcctatgctcagacattccatagagaatagctcagtgaacgtcagtctgacagccatcgcaaatcaggccaccgtgcttatgggactcggtaggggctggcccctgagcaaaatggatattggggttccgttgctggctatcggatgttactcccaggtgaacccaattaccttaacagcagccctactgctccttgtcgcgcactacgctatcattggccctggtctgcaagccaaggcaactcgcgaagcccagaagcggacggctgccgggatcatgaaaaatcccaccgtagacggcataacagtgattgatttggagccaatcccctatgaccctaagttcgaaaaacagctgggacaggttatgctcctggtgctttgcgtcactcaagtgttaatgatgcgaaccacatgggcactgtgtgaggctctcaccttggccactggcccgatctctacgctgtgggaggggaaccccggaagattttggaatacaaccattgcggtcagcatggccaacatattcaggggctcctacctagccggtgctgggctgctcttttcaatcatgaagaatactaccaacacacgccggggaactggcaatattggtgaaacccttggcgagaaatggaagtctagactgaacgccttggggaagagtgagttccagatctataaaaagtcgggcattcaggaggtggatcgtacactggcaaaagagggcatcaagagaggggaaacggaccatcacgctgttagccggggatccgccaaactccgctggtttgtggagcgaaacatggtaaccccagaaggcaaggtggtcgatctgggttgcgggagaggaggctggtcttactattgtggtggccttaaaaatgttagggaggtgaaggggctaactaagggaggccctgggcatgaagaaccaatacctatgtcaacatacggatggaacctggtccggctccaaagcggcgtggacgtattcttcaccccacccgagaaatgcgatactctactgtgtgacatcggtgaatccagtcctaatccaacaattgaggccgggcgcaccttgagagtgctgaacctcgttgaaaattggcttaacaataacacgcagttttgcatcaaggtgctgaatccctatatgccgtctgtcattgagaaaatggaaaccttgcagaggaagtacggaggcgcgctggtgcgaaaccctctcagcagaaattcaacacacgagatgtactgggtctccaacgctactggcaatatcgtgagtagcgttaacatgatatctcgtatgttaattaatagattcaccatgaaacacaagaaggcaacatatgagccagatgtagacctggggtccggaactcgcaacatcggtatcgaatcagagattcccaaccttgacataatcggcaaaaggattgaaaagatcaaacaggagcatgaaaccagctggcactacgatcaagaccatccttataagacatgggcctaccacgggtcgtatgagaccaaacagactggatctgctagttccatggtgaatggcgtcgtgaagctgctaacgaagccatgggatgttgtgcccatggtcacacagatggccatgaccgacactaccccgtttggtcagcaacgggtgttcaaagagaaggtagatacaagaacgcaggaacctaaagaggggaccaagaaactcatgcgcattactgcagaatggctgtggaaggagttgggaaagaaaaagacacccaggatgtgtacccgagaggaatttactcggaaagtgagaagcaacgccgctctgggcgcgatcttcacagacgagaataagtggaaatcagccagggaagcagttgaggattcccgcttttgggaactcgtcgaccgtgagcggaaccttcacctggagggcaagtgcgaaacctgtgtgtacaatatgatggggaaaagagagaagaagttaggagagttcggtaaagctaagggctctagggccatatggtatatgtggctgggggcacgctttttggagttcgaagccctcggatttctgaacgaggatcattggttcagccgaggcaatagtctatccggtgtggagggggaaggacttcaccggctgggctacatcctcagagaggtcggcaaaaaggaagggggagctatgtacgccgacgatacagcgggttgggacactaggattaccctggaggacttgaaaaacgaagagatggttacgaatcatatgaagggcgagcacaagaaactggcagaagccatctttaagctcacctatcagaacaaagtggtacgcgtgcagagaccaacacctcgggggactgtcatggatattatcagcaggaaggaccaacgtggatctggccaggtgggtacctacgggcttaatacattcactaacatggaggctcagctgattcgacaaatggaaggagagggcatattcaaatcaatccagcatttaaccgccacggaggaaattgcagttcagaattggctggctcgcgtgggcagagagcggttgagtaggatggccatctccggggatgactgcgtcgtgaagcccatcgatgaccgctttgctagcgccctcacagcactgaacgatatgggaaaggtaagaaaagacattcagcaatgggaaccatctcggggttggaatgattggacccaggttcccttctgctcgcaccactttcatgagctagtgatgaaggacggcagggtccttgtggtgccttgtcgaaaccaggatgaactgatagggcgtgcgagaatctcacagggagccggctggagcctcaaagagactgcttgcctgggtaagtcctatgcccaaatgtggacattgatgtacttccaccgccgggacttaaggctggcagctaacgccatttgtagtgcagtcccatctcattgggttccgaccagcagaactacctggtccatccacgccaaacacgagtggatgacaacggaagatatgctcgcggtgtggaatcgcgtatggattcaggagaacccctggatggaagacaagacccctgtggagtcatgggaagaggtcccatatcttgggaagcgggaggaccagtggtgcggaagtctgatcggcctaacttctagggctacatgggccaaaaatatacagaccgcaatcaaccaagtgcgaagcctgattggcaatgaagagtacactgattatatgccctccatgaagagatttcggagggaagaggaagaggccggggttctctggtga

SEQ ID NO: 14718 - RNA, 9876 nt, synthetic construct
  misc_feature 1..9876: note = derived and/or modified CDS sequence (opt3) from DENV-2__EU482727__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgaggtaaaatcttgccactggcctaagtcccatacgttgtggagtaatggagtcctcgaaagcgagatgatcattccaaaaaacttcgccggccccgtgtctcagcacaactaccgacctggttatcatacacagaccgcaggcccatggcacctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtacgggatggaaattaggccattgaaggagaaggaagagaacctggtgaatagcttagttactgccggacatggccaaatagataacttttcgctcggtgtgctgggcatggcgcttttcctggaagagatgttgcgcacacgagtagggaccaaacacgccatcctcctggtcgctgtgtcctttgtgactctaattacaggaaatatgtctttccgggacctgggccgtgtcatggttatggtgggggcaaccatgacggatgacatcggaatgggcgtaacttatctcgccctgcttgctgcctttaaggtgagacccaccttcgcagcgggtttgctgttaaggaaactcacaagcaaggagctgatgatggccaccattgggatcgctcttctgtcacagagtactatacctgaaacaatcctagagctcaccgatgccctggcattgggaatgatggtcctgaaaattgtgcgcaacatggaaaagtaccagttagctgttacaatcatggccatttcctgcgtgcccaatgcagtcatcctccaaaacgcctggaaggtgtcttgtactatactggctgcggttagcgtgtccccacttctgttgacctcaagccagcagaaagccgactggattcctctcgcactgacgatcaagggcctaaatcccacagctatctttctgaccactcttagtcggacctctaaaaagagatcctggccactcaacgaggccgtcatggccgtaggcatggtgagcattctggcttcgtcattgctgaaaaatgacataccgatgacagggcctttagttgcaggaggtctcctgactgtgtgctatgtccttaccggcaggtctgccgatctggaattggagcgagcggctgacgtgaagtgggaggatcaggccgaaatcagtgggtccagccccattctctctatcacgattagcgaggacggatccatgtcaatcaaaaacgaagaggaggaacaaacactgaccatactaatccgcactggcctgcttgtaattagtggtgtgttcccagtcagcatccccattacagcagccgcttggtacctctgggaggttaagaagcagcgggcaggggtgctgtgggatgtgccttctccaccccctgtcggaaaagccgaattggaggacggcgcgtatagaatcaagcagaggggcatatttgggtactcccagattggagctggtgtgtataaagaaggcaccttccacactatgtggcatgttacacgtggggccgtattaatgcaccgcggaaagcggatcgagccgtcatgggcagatgtgaaaaaggacctgatcagttacggcggtgggtggaagctcgagggagaatggaaagagggcgaagaggtccaagtgctggcccttgaaccaggcaagaatcccagagctgttcagaccaaacctgggctgtttaagacgaacactggaaccattggtgccgtgagcttggatttctccccaggcacatctgggtcgcccatcgtcgacaggaaaggaaaggtggtaggcctatacggtaatggggtcgtgacccgaagcggagcatatgtttcagctatagcccagacagagaagtccattgaggataaccctgaaatcgaggacgatattttccggaaaaagcgcctgactatcatggacctccatccgggcgcgggcaaaaccaagagatacctgcccgccatagtgagggaagcaattaaacgggggcttcgaacgttaatcctggctccaacaagagtcgtggccgctgagatggaagaggcactccgcggattgcctatcaggtatcagactcccgccattcgtgccgagcacaccggtcgggaaatcgttgacctgatgtgtcatgctacatttaccatgagactcctgagtccagtgagggtccctaactacaatcttattataatggatgaggcgcacttcactgaccccgcatctatcgccgctcgcggctatattagcacccgagtggaaatgggggaggccgcaggaatctttatgacagccacgccaccgggctccagagatcctttcccccaatcaaacgctccaatcatggacgaggaacgggagattcccgaaaggtcttggaatagcggtcacgagtgggtaactgattttaaggggaagaccgtgtggttcgttcctagtataaaagcgggaaacgacatcgccgcatgcctgcgcaagaatggcaaaaaggtcattcagttgtcccgtaaaacatttgatagcgaatacgtgaagaccagagctaacgactgggatttcgtggtcactacagacatctctgagatgggcgccaattttcgggcagagagggtaattgatccacgccgatgtatgaagcccgtgatcctaaccgacggggaagagagagttatactggccggacctatgccggtgacgcattcatccgctgcccagcggaggggtcgcatcggcagaaacccaaaaaatgaaaacgaccaatatatttacatgggggagcccctcgaaaatgatgaggactgcgcgtactggaaggaggcaaaaatgttactggataacatcaatactcctgaaggaattatccccagtatgttcgagccagaaagggagaaggtcgacgccatagatggcgaatatcggcttcgtggtgaggctcgcaaaacatttgtggacctgatgcgaagaggggatctccctgtttggttggcctacagggtggctgcagagggcattaactatgccgaccggcgctggtgtttcgatggaatcaagaataaccagattctggaagagaacgtcgaagtggagatctggaccaaagagggcgaaagaaagaagctcaaacccaggtggctggacgctcggatatacagcgatccacttgccctaaaggagttcaaagaatttgcagcggggcgaaagtcgctgaccttgaatttaatcactgagatgggaagactgcctacattcatgacccagaaagcccgcgacgctctcgataacctggccgtacttcacacagcagaagtgggtggcagggcttataatcatgccctgtctgagctcccggagactttggaaacgctgctactgctcacccttctggcaacagttactgggggaatttttttattcttgatgtccggcaagggtatcgggaagatgaccctgggcatgtgctgcattatcacagccagcatactcctgtggtacgctcagattcaaccccactggatcgcggcctcaatcattcttgagtttttcctgatcgtcctcttgataccagaacctgagaaacagcggaccccccaggacaaccagctgacttatgtggtgattgcaatcttaacggtcgttgctgccaccatggccaatgaaatgggatttctagagaagacaaaaaaggacctgggcctcgggagtattactacccaagagtctgaatccaacatccttgatatagacctgcgtccagcaagcgcttggacattgtacgccgtggcgaccactttcgtaacacctatgctgagacactcaatcgagaatagtagcgtgaacgtctccctcacggctattgccaatcaggcaaccgtgctgatgggacttggtaggggctggcccctctctaaaatggatatcggggttccgctgttggccattggatgttacagccaggtgaacccaatcactctgacagctgcattactactgctcgtcgcccattatgcgattatcggccctggtcttcaggctaaggccacccgcgaagcacaaaagcgggccgctgccgggataatgaaaaatcccaccgtagacggcattacagtgatcgatctggagccaatcccctacgaccctaagtttgaaaaacagttgggacaggttatgctgctcgtgctgtgcgtcactcaggtgcttatgatgcgaacgacctgggcattatgtgaggctctgacactcgccactggcccgatttccaccttgtgggaggggaaccccggaagattctggaatacaaccatagcggtctcaatggccaacatctttaggggctcttatctggcaggtgctgggctactgttcagtattatgaagaatactacgaacacacgccggggaaccggcaatatcggtgaaactctcggcgagaaatggaagtcgagacttaacgccctggggaagagcgaatttcaaatttacaaaaagtccggaatccaggaggtggatcgtaccttggcaaaagagggcataaagaggggggaaacagaccaccatgctgtttctcggggatcagccaaactgcgctggttcgtggagcgaaacatggtaactccagaaggcaaggtggtcgatctcggttgcgggagaggaggctggagctattactgtggtggcctgaaaaatgttagggaggtgaaggggttaaccaagggaggccctgggcacgaagagcccatccctatgtccacatatggatggaaccttgtccggctgcagagtggcgtggacgtattctttacgccacccgagaaatgcgataccctcctatgtgacattggtgaatctagccctaatccaactatcgaggccgggcgcacactgagagtgttgaacctggttgaaaattggctcaacaataacacccaattctgcattaaggtgcttaatccctacatgccgtcagtcatcgagaaaatggaaactctgcagaggaagtacggaggcgcgttggtgcgaaaccctctgtcccggaatagtacacatgagatgtattgggtcagcaacgctaccggcaatatagtgtcttccgttaacatgatttcacgtatgctcatcaatagatttacgatgaaacacaagaaggcaacctacgagccagatgtagacttagggagcggaacacgcaacatcggtattgaaaacgagatacccaatctggacatcattggcaaaaggatcgaaaagattaaacaggagcacgaaacttcgtggcattatgatcaggaccacccttacaagacctgggcctatcatgggtcttacgagacaaaacaaactggaagtgcttccagcatggtgaacggcgtcgtgcggcttctgaccaagccatgggatgttgtgcccatggtcacacagatggccatgaccgacactacgccgttcggtcagcagagagtgtttaaggagaaagtagatacacgcacccaagaacctaaggaggggactaaaaagctaatgaggatcaccgcagaatggctctggaaagagctgggaaagaagaaaacaccccgaatgtgtacgcgggaggaattcaccagaaaggtgaggtcaaatgccgctttgggcgcgatatttactgacgagaacaaatggaagtccgcccgcgaagcagttgaggattctcgtttctgggaactggtcgaccgggagagaaatctccaccttgagggcaaatgcgaaacatgtgtgtataacatgatggggaagagggagaaaaagctgggagaatttggtaaggctaaaggcagccgcgccatctggtacatgtggttaggggcacgattcctggagtttgaagccttgggattcctcaatgaggatcactggtttagtcggagaaactccctgagcggcgtggagggtgaagggctacataagcttggatacattctgagggacgtctctaaaaaggagggcggcgctatgtatgccgatgacaccgcggggtgggacactcgcatcacactcgaagatctgaaaaatgaggaaatggttaccaaccacatgaagggagagcataagaaattggcagaggccattttcaagctgacataccagaataaagtggtaagagtgcagcggccaactcctaggggtaccgtcatggacatcatttcacgtaaggatcagcgaggcagtgggcaagtgggaacgtatggcctcaacaccttcacaaatatggaagctcagcttatacgccagatggagggtgaagggatctttaaatccattcaaagactgactgttaccgaggagatcgccgtgcagaactggttagcacgggtcggaagggaacgcctgagcagaatggctatctctggcgacgattgcgtggtaaagcccttggacgatcggttcgcctcggctctcacagccctgaatgacatgggcaaggttaggaaagatattcagcagtgggagccatcacgagggtggaacgactggactcaagtgcccttttgcagccaccatttccacgaactagtcatgaaggatggacgtgtgcttgtggtcccttgtagaaaccaggacgagctgataggtcgcgcacggatctcccagggcgcggggtggagtctcaaagaaaccgcctgcctgggaaagtcttacgctcagatgtggacgttgatgtattttcacaggagagatttacgcctggccgcaaatgctatttgtagcgccgttccatcccattgggtgccgacatcacggaccacttggagtatccacgcaaaacatgagtggatgacaaccgaggacatgctcgccgtatggaacagggtgtggattcaagaaaatccctggatggaggacaagactcctgtcgaatcttgggaggaagtgccataccttggcaagcgagaggatcagtggtgcggtagcctgatcgggctaacctccagagcgacatgggctaaaaacatacagacggccatcaatcaggttcggtcactgattggaaacgaggaatataccgactacatgcccagcatgaagaggttccgcaaagaggaagaggaagcaggcgtgctctggtga

SEQ ID NO: 14719 - RNA, 9876 nt, synthetic construct
  misc_feature 1..9876: note = derived and/or modified CDS sequence (opt3) from DENV-2__EU482728__SS-prME
  source 1..9876: mol_type = other RNA
accgcaggcgtgatcattatgctgatacccacagctatggcattccacctcactacgaggaacggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggattctgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctttagtggatagaggctggggtaacgggtgtggactcttcggcaagggcgggattgtcacatgcgccatgtttacatgcaaaaagaatatggaaggaaaagtggtgctgcctgagaaccttgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggttggatttcaacgaaatggtactcctgcagatggaggacaaagcatggttagtgcaccggcaatggtttctggatctccctcttccatggctgcccggcgctgacactcagggaagcaattggattcagaaggagacattggtcacgttcaagaaccctcatgccaaaaagcaggacgtggttgtgctgggctctcaagaaggggcgatgcacaccgccctgactggagcaacagagatccagatgtcctcaggtaatctcctgtttaccggccatcttaaatgccgtctgcgcatggataagttgcagctcaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctggagaaaaggcatgttttaggccggctgattacggtgaacccgatcgtcaccgaaaaggactcccctgtgaacatcgaggccgaacccccatttggagatagctacattataatcggcgtcgagcctgggcagctaaaactcaattggttcaagaagggatcgtctattggtcagatgtttgagacaactatgcgaggcgctaaacgcatggccatcctgggggacaccgcatgggatttcggatcccttggcggtgtgtttacatcaattgggaaggccttgcaccaagttttcggcgctatctacggagcggcatttagtggcgtgagctggactatgaaaatactgatcggggtaattatcacctggattggaatgaactccagatctacgagcctctcagtcagtctggtgcttgttggcgtggtcacactgtatttgggtgtgatggtacaggccgactccgggtgtgtggttagctggaagaataaagaactcaagtgcggatctggcatcttcataaccgataacgtccacacttggacagagcagtacaagtttcagcccgaatcaccaagtaaactggctagcgccattcaaaaggcacatgaggaaggtatctgtggcattaggtccgtgacccggttagagaatctgatgtggaaacagatcactcccgagctaaaccacatactctctgaaaatgaggtgaagctgaccatcatgacaggggacattaaaggaatcatgcaggccggcaagcgctcgcttagacctcagccaacggaattgaaatatagctggaagacctgggggaaggctaaaatgctgtccactgagtcacataaccaaacattcctcattgatggaccggaaaccgccgagtgccccaatacaaacagggcatggaatagtctggaggtcgaagactacggctttggtgttttctctactaacatctggttaaagctgcgtgagaaacaggacgtgttttgtgatagcaaacttatgtccgcggctataaaagacaatcgggccgtgcacgcagatatggggtattggattgaatcagccttgaacgacacctggaagatggagaaggctagcttcatcgaggtaaaatcttgccactggcctaagtcccatacgctctggagtaatggagtcctggaaagcgagatgatcattcccaagaacttcgccggccccgtgtctcagcacaactaccgacctggttatcatacacagaccgcaggcccatggcacctagggaagctggaaatggattttgacttctgtgagggaactaccgttgtggtcacagaagattgcggcaatagagggccctccctcaggactaccacagcttcaggaaaactgatcacggagtggtgctgtcgcagttgcacccttccgcctttgcggtacagaggcgaggacggttgttggtacgggatggaaattaggccactgaaggagaaggaagagaacttagtgaatagcctcgttactgccggacatggccaaatagataacttttcgctgggtgtgcttggcatggcgctgttcttggaagagatgctccgcacacgagtagggaccaaacacgccatcctgctagtcgctgtgtcctttgtgactctgattacaggaaatatgtctttccgggacctcggccgtgtcatggttatggtgggggcaaccatgacggatgacatcggaatgggcgtaacttatctggcccttttggctgcctttaaggtgagacccaccttcgcagcgggtctgttactcaggaaactgacaagcaaggagcttatgatggccaccattgggatcgctctgctatcacagagtactatacctgaaacaatcctcgagctgaccgatgccttggcactgggaatgatggtcttaaaaattgtgcgcaacatggaaaagtaccagctcgctgttacaatcatggccatttcctgcgtgcccaatgcagtcatcctgcaaaacgcctggaaggtgtcttgtactatacttgctgcggttagcgtgtccccactgttgctcacctcaagccagcagaaagccgactggattcctctggcactaacgatcaagggcctgaatcccacagctatctttcttaccactctcagtcggacctctaaaaagagatcctggccactgaacgaggccgtcatggccgtaggcatggtgagcattttggcttcgtcactgctcaaaaatgacataccgatgacagggcctctagttgcaggaggtctgcttactgtgtgctatgtcctgaccggcaggtctgccgatttggaactcgagcgagcggctgacgtgaagtgggaggatcaggccgaaatcagtgggtccagccccattctgtctatcacgattagcgaggacggatccatgtcaatcaaaaacgaagaggaggaacaaacactaaccatactgatccgcactggccttctcgtaattagtggtgtgttcccagtcagcatccccattacagcagccgcttggtacctgtgggaggttaagaagcagcgggcaggggtgttgtgggatgtgccttctccaccccctgtcggaaaagccgaattagaggacggcgcgtatagaatcaagcagaggggcatatttgggtactcccagattggagctggtgtgtataaagaaggcaccttccacactatgtggcatgttacacgtggggccgtactgatgcaccgcggaaagcggatcgagccgtcatgggcagatgtgaaaaaggacctcatcagttacggcggtgggtggaagctggagggagaatggaaagagggcgaagaggtccaagtgcttgccctggaaccaggcaagaatcccagagctgttcagaccaaacctgggttgtttaagacgaacactggaaccattggtgccgtgagcctagatttctccccaggcacatctgggtcgcccatcgtcgacaggaaaggaaaggtggtaggcctgtacggtaatggggtcgtgacccgaagcggagcatatgtttcagctatagcccagacagagaagtccattgaggataaccctgaaatcgaggacgatattttccggaaaaagcgcctcactatcatggacctgcatccgggcgcgggcaaaaccaagagataccttcccgccatagtgagggaagcaattaaacgggggttacgaacgctgatcctcgctccaacaagagtcgtggccgctgagatggaagaggcattgcgcggactgcctatcaggtatcagactcccgccattcgtgccgagcacaccggtcgggaaatcgttgacctcatgtgtcatgctacatttaccatgagactgcttagtccagtgagggtccctaactacaatctgattataatggatgaggcgcacttcactgaccccgcatctatcgccgctcgcggctatattagcacccgagtggaaatgggggaggccgcaggaatctttatgacagccacgccaccgggctccagagatcctttcccccaatcaaacgctccaatcatggacgaggaacgggagattcccgaaaggtcttggaatagcggtcacgagtgggtaactgattttaaggggaagaccgtgtggttcgttcctagtataaaagcgggaaacgacatcgccgcatgcttgcgcaagaatggcaaaaaggtcattcagctatcccgtaaaacatttgatagcgaatacgtgaagaccagagctaacgactgggatttcgtggtcactacagacatctctgagatgggcgccaattttcgggcagagagggtaattgatccacgccgatgtatgaagcccgtgatcctgaccgacggggaagagagagttatactcgccggacctatgccggtgacgcattcatccgctgcccagcggaggggtcgcatcggcagaaaccccaaaaatgaaaacgaccaatatatttacatgggggagcccttagaaaatgatgaggactgcgcgcactggaaggaggcaaaaatgctgcttgataacatcaatactcctgaaggaattatccccagtatgttcgagccagaaagggagaaggtcgacgccatagatggcgaataccggctgcgtggtgaggctcgcaaaacatttgtggacctcatgcgaagaggggatttgcctgtttggctggcctatagggtggctgcagagggcattaactacgccgaccggcgctggtgtttcgatggaatcaagaataaccagattctcgaagagaacgtcgaagtggagatctggaccaaagagggcgaaagaaagaagctgaaacccaggtggcttgacgctcggatatatagcgatccactagccctgaaggagttcaaagaatttgcagcggggcgaaagtcgttgaccttaaatctgatcactgagatgggaagactccctacattcatgacccagaaagcccgcgacgctctggataaccttgccgtactgcatacagcagaagtgggtggcagggcttacaatcacgccctctctgagttgccggagactctggaaacgctactgctccttaccctgttagcaacagttactgggggaatatttttgttcctgatgtccggcaagggtatcgggaagatgaccctcggcatgtgctgcattatcacagccagcatactgctttggtatgctcagattcaaccccactggatcgcggcctcaatcattctggagtttttcctcatcgtcttgctgataccagaacctgagaaacagcggaccccacaggacaaccagttaacttacgtggtgattgcaatcctaacggtcgttgctgccaccatggccaatgaaatgggatttctggagaagaccaaaaaggacctcggccttgggagtattactacccaagagtctgaatccaacatcctggatatagacttgcgtccagcaagcgcttggacactgtatgccgtggcgaccactttcgtaacacctatgctcagacattcaatcgagaatagtagcgtgaacgtctccctgacggctattgccaatcaggcaaccgtgcttatgggactcggtaggggctggcccctgtctaaaatggatatcggggttccgttgctggccattggatgttacagccaggtgaacccaatcactttaacagctgcactactgctccttgtcgcccactacgcgattatcggccctggtctgcaggctaaggccacccgcgaagcacaaaagcgggccgctgccgggataatgaaaaatcccaccgtagacggcattacagtgatcgatttggagccaatcccctatgaccctaagtttgaaaaacagctgggacaggttatgctcctggtgctttgcgtcactcaggtgttaatgatgcgaacgacctgggcactgtgtgaggctctcacattggccactggcccgatttccaccctgtgggaggggaaccccggaagattctggaatacaaccatagcggtctcaatggccaacatctttaggggctcttacctagccggtgctgggctactcttcagtattatgaagaatactacgaacacacgccggggaaccggcaatatcggtgaaactcttggcgagaaatggaagtcgagactgaacgccttgggaaagagcgaatttcaaatttataaaaagtccggaatccaggaggtggatcgtaccctggcaaaagagggcataaagagaggggaaacagaccatcacgctgtttctcggggatcagccaaactccgctggttcgtggagcgaaacatggtaactccagaaggcaaggtggtcgatctgggttgcgggagaggaggctggagctactattgtggtggccttaaaaatgttagggaggtgaaggggctaaccaagggaggccctgggcatgaggaaccaatccctatgtccacatacggatggaacctggtccggctccagagtggcgtggacgtattctttacgccacccgagaaatgcgataccctactgtgtgacattggtgaatctagccctaatccaactatcgaggccgggcgcacattgagagtgctgaacctcgttgaaaattggcttaacaataacacccaattctgcattaaggtgctgaatccctatatgccgtcagtcatcgagaaaatggaaactttgcagaggaagtacggaggcgcgctggtgcgaaaccctctctcccggaatagtacacacgagatgtactgggtcagcaacgctaccggcaatatagtgtcttccgttaacatgatttcacgtatgttaatcaatagatttacgatgaaacacaagaaggcaacctatgagccagatgtagacctggggagcggaacacgcaacatcggtattgaaaacgagatacccaatcttgacatcattggcaaaaggatcgaaaagattaaacaggagcatgaaacttcgtggcactacgatcaggaccatccttataagacctgggcctaccacgggtcttatgagacaaaacaaactggaagtgcttccagcatggtgaacggcgtcgtgcggctgctaaccaagccatgggatgttgtgcccatggtcacacagatggccatgaccgacactacgccgttcggtcagcagagagtgtttaaggagaaagtagatacacgcacccaagaacctaaggaggggactaaaaagctcatgaggatcaccgcagaatggctgtggaaagagttgggaaagaagaaaacaccccgaatgtgtacgcgggaggagttcaccagaaaggtgaggtcaaatgccgctctgggcgcgatatttactgacgagaacaaatggaagtccgcccgcgaagcagttgaggattctcgtttctgggaactcgtcgaccgggagagaaatcttcacctggagggcaaatgcgaaacatgtgtgtacaacatgatggggaagagggagaaaaagttaggagaatttggtaaggctaaaggcagccgcgccatctggtatatgtggctgggggcacgattcttggagtttgaagccctcggattcctgaatgaggatcattggtttagtcggggcaactccctaagcggtgtggagggggaaggacttcacaagctgggctacattctcagagacgtctctaaaaaggagggcggggctatgtacgccgatgacaccgcgggatgggacactaggatcacactggaagatttgaaaaatgaggaaatggttaccaaccatatgaagggtgagcacaagaaactggcagaggccattttcaagctcacatatcagaataaagtggtacgcgtgcagagaccaactcctcggggcaccgtcatggacatcatttcaaggaaggatcagcgtgggagtggacaagtgggcacgtacggtcttaacaccttcacaaatatggaagctcagctgatacgacagatggagggggaaggaatctttaaatccattcaacgcttaactgttaccgaggagatcgccgtgcagaactggctggcaagagtcggccgggaaaggttgagccgcatggctatctctggcgacgattgcgtggtaaagcccctcgacgatagattcgcctcggctctgacagccctaaatgacatggggaaggttcggaaagatattcagcagtgggagccatcaaggggatggaacgactggactcaagtgcccttttgcagccatcacttccacgaacttgtcatgaaggatggtcgagtgctggtggtcccttgtcgtaaccaggacgagctcataggcagagcacgcatctcccagggggcgggatggagtctgaaagaaaccgcctgcttgggcaagtcttatgctcagatgtggacgttaatgtactttcatcggagggatctgagactcgccgcaaatgctatttgtagcgccgttccatcccactgggtgccgacatcacgcaccacttggagtatccatgcaaaacacgagtggatgacaaccgaggacatgcttgccgtatggaaccgggtgtggattcaagaaaatccctggatggaggacaagactcctgtcgaatcttgggaggaagtgccatatctgggtaagagggaggatcagtggtgcgggagcctaatcggactgacctcccgagcgacatgggctaaaaacatacagacggccatcaatcaggttagatcactcattggcaacgaggaatacaccgactatatgcccagcatgaagcggttcaggaaagaggaagaggaagcaggcgtgttgtggtga

SEQ ID NO: 14720 - RNA, 9876 nt, synthetic construct
  misc_feature 1..9876: note = derived and/or modified CDS sequence (opt3) from DENV-2__EU482729__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggaaattaaaggaatcatgcaggccggcaagcgctcgctgagacctcagccaacggagcttaaatatagctggaagacctgggggaaggctaaaatgttgtccactgaatcacataaccaaacattcctgattgacggaccggagaccgccgagtgccccaatacaaacagggcatggaatagtctcgaagtcgaggattacggctttggtgttttctctactaacatctggctgaagttacgtgaaaaacaggacgtgttttgtgacagcaagctgatgtccgcggctataaaagataatcgggccgtgcacgcagacatggggtattggattgagtcagcccttaacgatacctggaagatggagaaggctagcttcatcgaagtaaaatcttgccactggcctaagtcccatacgttgtggagtaatggagtcctcgagagcgaaatgatcattccaaaaaacttcgccggccccgtgtctcagcacaactaccgacctggttatcatacacagatcgcaggcccatggcacctggggaagctagagatggactttgatttctgtgaaggaaccactgttgtggtcaccgaggactgcggcaatagagggccctccctgaggacaactaccgcttcaggaaaactcattacagagtggtgctgtcgcagttgcacgctgccgcctcttcggtacagaggcgaagatggttgttggtacgggatggagataaggccattgaaggaaaaggaggaaaacctggtgaatagcttagttaccgccggacatggccaaatcgacaacttttcgctcggtgtgctgggcatggcgcttttcctggaggagatgttgcgcactcgagtagggacaaaacacgccattctcctgatcgctgtctcctttgtgaccctaattactggaaatatgtctttccgggatctgggccgtgtgatggtcatggttggggcaacaatgaccgacgatatcggaatgggcgtgacgtatctcgccctgcttgctgcctttaaggtaagacccactttcgcagcgggtttgctgttaaggaaactcaccagcaaggaactgatgatggccacaatagggatcgctcttctgtcacagagtaccattcctgagactatcctagaactcacagacgccctggcattgggaatgatggtgctgaaaattgtccgcaacatggagaagtaccagttagctgtgaccatcatggccatatcctgcgttcccaatgcagtgattctccaaaacgcctggaaggtctcttgtacaatcctggctgcggtgagcgtttccccacttctgttgacttcaagccagcagaaagccgattggatccctctcgcactgaccattaagggcctaaatcccacggctatatttctgacaacccttagtcggacttctaaaaagagatcctggccactcaacgaagccgtgatggccgtcggcatggtaagcatcctggcttcgtcattgctgaaaaatgacattccgatgaccgggcctttagtggcaggaggtctcctgacagtttgctatgtgcttactggcaggtctgccgacctggagttggagcgagcggctgatgtcaagtgggaagaccaggccgagatcagtgggtccagccccattctctctatcaccataagcgaagatggatccatgtcaatcaaaaacgaggaggaagagcaaacgctgacaattctaatccgcaccggcctgcttgtgattagtggtgtattcccagtgagcatccccataactgcagccgcttggtacctctgggaagtcaagaagcagcgggcaggggttctgtgggacgtgccttctccaccccctgtgggaaaagccgagttggaagatggcgcgtatagaattaagcagaggggcatctttgggtactcccagatcggagctggtgtctataaagagggcacattccacaccatgtggcatgtgactcgtggggccgttttaatgcaccgcggaaagcggattgagccgtcatgggcagacgtaaaaaaggatctgatcagttacggcggtgggtggaagctcgaaggagagtggaaagaaggcgaggaagtgcaagtcctggcccttgagccaggcaagaatcccagagctgtgcagacaaaacctgggctgtttaagaccaacacgggaactataggtgccgttagcttggacttctccccaggcacctctgggtcgcccattgtggataggaaaggaaaggtcgtgggcctatacggtaatggggtagtcacacgaagcggagcatatgtgtcagctatcgcccagaccgagaagtccattgaagacaaccctgagatcgaagatgacatattccggaaaaagcgcctgacaattatggatctccatccgggcgcgggcaaaactaagagatacctgcccgccatcgttagggaggcaatcaaacgggggcttcgaaccttaattctggctccaacgagagtggtcgccgctgaaatggaggaggcactccgcggattgcctatcaggtatcagacacccgccattcgtgccgaacacactggtcgggagatagtggacctgatgtgtcatgctacctttacaatgagactcctgagtccagttagggtgcctaactacaatcttatcattatggacgaagcgcacttcaccgatcccgcatctatcgccgctcgcggctatatcagcactcgagtcgagatgggggaggccgcaggaatttttatgaccgccacaccaccgggctccagagaccctttcccccaatcaaacgctccaataatggatgaagagcgggaaatccccgagaggtcttggaatagcggtcacgaatgggtgacggactttaaggggaagactgtatggttcgtgcctagtattaaagcgggaaacgatatcgccgcatgcctgcgcaagaatggcaaaaaggttattcagttgtcccgtaaaacctttgacagcgagtacgtcaagacaagagctaacgattgggacttcgtggtgaccactgatatctctgagatgggcgccaattttcgggcagaaagggtcatagacccacgccgatgtatgaagcccgtaatcctaacagatggggaggaaagagtgattctggccggacctatgccggttacccattcatccgctgcccagcggaggggtcgcatcggcagaaacccaaaaaatgagaacgaccaatatatttacatgggggaacccctcgagaatgacgaggattgcgcgtactggaaggaagcaaaaatgttactggacaacatcaatacgcctgagggaataattcccagtatgttcgaaccagagagggaaaaggtggatgccatcgacggcgagtatcggcttcgtggtgaggctcgcaaaacttttgtcgatctgatgcgaagaggggacctccctgtgtggttggcctacagggttgctgcagaaggcattaactatgccgatcggcgctggtgtttcgacggaatcaagaataaccagatactggaggaaaacgtggaggtcgagatctggacaaaagaaggcgagagaaagaagctcaaacccaggtggctggatgctcggatttacagcgacccacttgccctaaaggaattcaaagagtttgcagcggggcgaaagtcgctgaccttgaatttaatcaccgaaatgggaagactgcctactttcatgacacagaaagcccgcgatgctctcgacaacctggccgtgcttcacaccgcagaggtaggtggcagggcttataatcatgccctgtctgagctcccggaaacattggagactctgctactgctcacgcttctggcaaccgtgacagggggaatttttttattcttgatgtccggcaagggtatcgggaagatgactctgggcatgtgctgcataattaccgccagcatcctcctgtggtacgctcagatccaaccccactggattgcggcctcaatcatacttgaatttttcctgattgttctcttgatcccagagcctgaaaaacagcggacaccccaggataaccagctgacctatgtcgtgattgcaatcttaactgtggtcgctgccacgatggccaatgagatgggatttctagagaagaccaaaaaggacctgggcctcgggagtataacaactcaagaatctgagtccaacatccttgacattgatctgcgtccagcaagcgcttggaccttgtacgccgttgcgacaaccttcgtgactcctatgctgagacactcaatcgaaaatagtagcgtaaacgtgtccctcacagctattgccaatcaggcaacggtcctgatgggacttggtaggggctggcccctctctaaaatggacatcggggtgccgctgttggccattggatgttacagccaggttaacccaatcaccctgactgctgcattactactgctcgtggcccattatgcgataattggccctggtcttcaggctaaggccacacgcgaggcacaaaagcgggccgctgccgggatcatgaaaaatcccaccgtcgatggcatcaccgtaattgacctggaaccaataccctacgatcctaagtttgagaaacagttgggacaggtgatgctgctcgttctgtgcgtgacacaggtccttatgatgcgaactacgtgggcattatgtgaggctctgaccctcgccacaggcccgatctccactttgtgggaagggaaccccggaagattctggaataccacaattgcggtgtcaatggccaacatctttaggggctcttatctggcaggtgctgggctactgttcagtattatgaagaataccactaacacgcgccggggaacaggcaataccggtgagactctcggcgaaaaatggaagtcgagacttaacgccctggggaagagcgagtttcaaatctacaaaaagtccggaatacaggaggtcgaccgtaccttggcaaaagaaggcatcaagaggggggagacagatcaccatgctgtgtctcggggatcagccaaactgcgctggttcgttgaacgaaacatggtgactccagagggcaaggtagtggacctcggttgcgggagaggaggctggagctattactgtggtggcctgaaaaatgtcagggaagttaaggggttaaccaagggaggccctgggcacgaggagcccattcctatgtccacatatggatggaaccttgtgcggctgcagagtggcgtcgatgtgttctttacgccacccgaaaaatgcgacaccctcctatgtgatatcggtgagtctagccctaatccaactattgaagccgggcgcacactgagagtattgaacctggtggagaattggctcaacaataacacccaattctgcatcaaggttcttaatccctacatgccgtcagtgatagaaaaaatggagactctgcagaggaagtacggaggcgcgttggtccgaaaccctctgtcccggaatagtacacatgagatgtattgggtgagcaacgctaccggcaatattgtctcttccgtgaacatgatctcacgtatgctcatcaatagatttacgatgaaacacaagaaggcaacctacgaaccagacgttgatttagggagcggaacacgcaacattggtatagagaacgaaatccccaatctggacattatcggcaaaaggattgagaagatcaaacaggaacacgagacttcgtggcattatgaccaggatcacccttacaagacctgggcctatcatgggtcttacgagacaaaacaaactggaagtgcttccagcatggtaaacggcgtggtccggcttctgaccaagccatgggacgtggttcccatggtgacacagatggccatgaccgatactacgccgttcggtcagcagagagtctttaaggaaaaagtggacacacgcacccaagagcctaaggaagggactaaaaagctaatgaggataaccgcagagtggctctggaaagagctgggaaagaagaaaacaccccgaatgtgtacgcgggaagagttcaccagaaaggtaaggtcaaatgccgctttgggcgcgatctttactgatgaaaacaaatggaagtccgcccgcgaggcagtggaagactctcgtttctgggagctggttgatcgggagagaaatctccaccttgaaggcaaatgcgagacatgtgtctataacatgatggggaagagggaaaaaaagctgggagagtttggtaaggctaaaggcagccgcgccatttggtacatgtggttaggggcacgattcctggaatttgaggccttgggattcctcaatgaggaccactggtttagtcggagaaactccctgagcggcgtggaaggtgaggggctacataagcttggatacatcctgagggatgtgtctaaaaaggaaggcggcgctatgtatgccgacgataccgcggggtgggacactcgcattacactcgaggacctgaaaaatgaagagatggtcaccaaccacatgaagggagagcataagaaattggcagaagccatcttcaagctgacataccagaataaagttgtgagagtacagcggccaactcctaggggtaccgtgatggatattatatcacgtaaggaccagcgaggcagtgggcaagtcggaacgtatggcctcaacaccttcacaaatatggaggctcagcttatccgccagatggaaggtgaggggatttttaaatccatccaaagactgactgtgaccgaggaaatcgccgttcagaactggttagcacgggtgggaagggagcgcctgagcagaatggctatttctggcgatgactgcgtcgtgaagcccttggatgaccggttcgcctcggctctcacagccctgaatgatatgggcaaggtaaggaaagacatacagcagtgggaaccatcacgagggtggaacgattggactcaagttcccttttgcagccaccatttccacgagctagtgatgaaggacggacgtgtccttgtggtgccttgtagaaaccaggatgaactgatcggtcgcgcacggatttcccagggcgcggggtggagtctcaaagagaccgcctgcctgggaaagtcttacgctcagatgtggacgttgatgtattttcacaggagagacttacgcctggccgcaaatgctatctgtagcgccgtcccatcccattgggttccgacatcacggaccacttggagtattcacgcaaaacatgagtggatgacaaccgaagatatgctcgccgtgtggaacagggtatggatccaagagaatccctggatggaagacaagactcctgtggagtcttgggaagaggtcccataccttggcaagcgagaggaccagtggtgcggtagcctgatagggctaacctccagagcgacatgggctaaaaacatccagacggccattaatcaggtgcggtcactgatcggaaacgaagagtataccgattacatgcccagcatgaagaggttccgcaaagaagaggaagaggcaggcgttctctggtga

SEQ ID NO: 14721 - RNA, 9876 nt, synthetic construct
  misc_feature 1..9876: note = derived and/or modified CDS sequence (opt3) from DENV-2__EU482731__SS-prME
  source 1..9876: mol_type = other RNA
accgccggagtgatcgtaatgctgattcccactgttatggctttccacctcactacgagaaacggggagcctcatatgatagtgggaaggcaggaaaagggtaaaagccttctgtttaagaccgaggacggcgtaaatatgtgcacattgatggcaatcgatttaggggaactgtgtgaggacactattacctacaaatgcccattactccggcaaaacgaaccggaggatatcgactgttggtgcaattccacatctacctgggtgacttatggaacatgtaccacgactggcgagcaccgccgagaaaagcgttcagtcgccctggtgccccatgttggtatggggcttgagaccagaacagaaacttggatgagtagcgagggagcgtggaaacacgtgcagaggattgagacctggatcctgcggcatcctggcttcacaataatggctgccatcttggcatacaccattggcacgactcactttcagcgcgccctcatcttcattctgctgacagctgtcgcaccatccatgaccatgagatgcatcgggatatctaacagggattttgtggaaggagtatcgggtggctcatgggttgacattgtgctcgagcacgggagctgtgtcactacaatggccaagaataagcccaccttagatttcgaactgatcaaaacggaggctaagcagcctgccacccttcggaaatattgcattgaagcgaagttgacaaacactaccacagagagtcgctgtccaactcaaggagagccctccctgaatgaagaacaggacaaacgatttatctgcaagcattctatggtggatagaggctggggtaacgggtgtggactattcggcaagggcgggatcgtgacctgcgcaatgtttacatgcaaaaagaatatggaaggaaaaattgtccagcctgagaacctcgaatacaccatagttatcactccacacagcggtgaggagcatgccgtgggcaatgacacggggaagcacggaaaagaaattaagatcacaccgcagtcctcaaccactgaggctgaactgaccggctatggtacagtaaccatggagtgtagtcccaggactgggcttgatttcaacgaaatggtgctgttgcaaatggaggacaaagcctggctcgtccaccggcagtggtttctggatttacctctgccatggctccccggcgcagacacacagggaagcaattggatacagaaggagacgcttgtgaccttcaagaaccctcatgctaaaaagcaagacgttgtggtcctgggctctcaggaaggggccatgcacactgcgttgacaggagccaccgagattcagatgtcctcaggtaatctactgtttacaggccatctcaaatgccgtctgcgcatggataaacttcaactgaaagggatgagctacagtatgtgtactggaaagttcaagatcgtgaaagaaatcgcagagacccagcacggcacgattgtaatcagagttcagtatgagggtgacgggtctccatgcaagattcccttcgaaataaccgatttggagaaaaggcatgtgctcggccggctgatcacagtcaacccgattgtgactgaaaaggacgctcctgtcaacatcgaggccgaacccccatttggagattcctacatcattgtgggcgttgagcctgggcagttaaaactgaattggttcaagaagggaagctcgataggtcaaatgtttgagaccacaatgcgaggcgctaaacgcatggccatcctaggggacactgcatgggatttcggatctctcggcggtgtgtttacctccattgggaaggccctgcaccaggtattcggcgctatctacggagcggcattttcaggcgtcagttggacgatgaaaattcttatcggggtgataatcacatggattggaatgaacagcagatccacctctttgagcgtttcactggtgctcgtcggcgtggtaactctgtatcttggtgccatggtgcaggctgacagtgggtgtgttgtctcctggaagaataaagaactgaagtgcggaagcggcatcttcattacagataacgtgcacacctggactgagcagtacaagtttcaacccgaatctccatcaaaattggccagtgcaatccagaaggcccatgaggaaggtatatgtggcattaggagcgtgacccggctcgagaatctgatgtggaaacagatcacacccgagttaaaccacattctgtccgaaaatgaggtcaagctaacgatcatgaccggggacataaaaggaatcatgcaggctggcaagcgctctctcagacctcaaccaactgaactgaaatattcgtggaagacatgggggaaggccaaaatgcttagcaccgagtcccataaccagacattcttgattgatggaccggaaactgcagagtgccccaataccaacagggcgtggaactcactggaggttgaagactacggctttggtgtgttcacgacaaacatctggctcaagctgcgtgagaaacaggacgtgttttgtgatagtaagttaatgtctgctgccattaaagacaatcgggcagtacacgccgatatggggtattggatcgaaagcgctctgaacgacacctggaagatggagaaggcctccttcatagaggtcaaatcatgccactggcctaagagccatactctttggtctaatggagtgttggaatccgagatgattatccccaagaatttcgcaggccccgttagtcagcacaactaccgacctggttatcatacccaaacagctggcccatggcacctcgggaagctggaaatggattttgacttctgtgagggaactaccgtggtcgtgacagaagattgcggcaatagagggcccagcctaaggacgaccactgcctctggaaaactgatcacagagtggtgctgtcgctcctgcaccctcccgcctctgcggtacagaggcgaggacggttgttggtacgggatggaaattaggccacttaaggagaaggaagagaacttggttaattcactggtgactgcgggacatggccagatcgataactttagtttaggtgtactcggcatggccctgttccttgaagagatgctgcgcacacgagtcgggaccaaacacgctacgttgctcgtggcactgagctttgtgactctaattaccggaaatatgtcgttccgggacctgggccgtgtcatggttatggtgggggccacaatgaccgatgacataggaatgggcgtaacttatctcgctctgcttgccgcatttaaggtgagacccacattcgcggccggtttgctgttaaggaaactcacctccaaggagctgatgatggctacaatcgggattgcccttctgtctcagagcactctacctgaaaccatcctcgagctgacggatgcattggctctgggaatgatggtcttaaaaattgtgcgcaacatggaaaagtaccaactcgccgttacaatcatggcaatatcatgcgtgcccaatgccgtcatcctgcagaacgcttggaaggtgagttgtaccattcttgcggccgtttccgtgtctccactgttgctcactagctcccagcagaaagcagactggatccctctggctctaaccattaagggcctgaatcccacagccatctttcttactaccctctcacggacgagcaaaaagagaagttggccactgaacgaggccataatggctgtcggcatggtatctattttggcatccagcctgctaaagaatgacatcccgatgacagggcctctcgtggccggaggtctgcttaccgtttgctatgtgctgactggcaggtcggcggatttggaactcgagcgagctgccgacgtcaagtgggaggatcaagcagaaatctcagggtctagtcccattctgtccataacaatcagcgaggacggatctatgagcattaaaaacgaagaggaggaacagaccctaactatcctgattcgcacaggccttctcgtgatctccggtgtattcccagtgtcaatacccatcaccgccgctgcatggtacctgtgggaggtcaagaagcagcgggccggggttttgtgggatgtgcctagtccaccccctgtgggaaaagcggaattagaggacggcgcttatagaattaagcagaggggcatcctggggtacagccaaattggagccggtgtctataaagaaggcacgtttcacactatgtggcatgtgacccgtggggcagttctcatgcaccgcggaaagcggatcgagccgtcttgggccgatgtcaaaaaggacctgatatcctacggcggtgggtggaaacttgagggagaatggaaagagggcgaagaggtgcaggtcctggctttggaaccaggcaagaatcccagagccgtgcagacaaaacctgggattttcaagaccaacacaggaactatcggtgcagtttcactagattttagtccaggcaccagcgggtcccccatcgtggacaggaaaggaaaggtcgtgggcctgtacggtaatggggtagtcacgcgatctggagcttatgtgtcggccattgcgcagacagaaaagagcatcgaggataaccctgaaatagaggacgatattttccggaaaaagcgcctcactatcatggacctgcatccgggcgccggcaaaaccaagagataccttcccgcaattgttagggaagctatcaaacgggggttacgaacactgatactcgccccaaccagagtggtcgctgcagagatggaagaggccttgcgcggactgcctattaggtatcaaactcccgccatccgtgctgagcacaccggtcgggaaatcgtggacctcatgtgtcatgcgacattcacgatgagactgctttcaccagttagggtgcctaactacaatctgattatcatggatgaggcacactttactgaccccgcctccattgctgcccgcggctatataagtacccgagtcgaaatgggggaggcagccggaatcttcatgacagctaccccaccgggctctagagatccttttccccagagcaacgcgccaattatcgacgaggaacgggagatccccgaaaggtcctggaactcaggtcacgagtgggtgactgatttcaaggggaagacagtatggtttgtgccttctattaaagccggaaacgacatagcagcttgcttgcgcaagaatggcaaaaaggttatccagctaagccgtaaaaccttcgatagtgaatacgtcaagacgagagccaacgactgggattttgtggtgactacagacatttccgagatgggcgcaaatttcaaggccgagcgggtcatcgatccaaggcgctgtatgaaacccgtaattctgaccgacggggaagaacgagtgatcctcgctggacctatgccggttacccatagctctgccgcgcaaagacggggtaggataggccgcaacccaaagaatgaaaacgaccagtatatctacatgggggagcccttagaaaatgatgaggactgcgcacactggaaagaggccaagatgctgcttgataacattaatactcctgaaggaatcattccctcaatgtttgagccagaaagagagaaagtggacgctatcgatggcgaatacaggctgcggggtgaggcccgtaagacattcgtcgacctcatgcgccgaggggatttgcctgtgtggctggcttataaagttgcagccgagggcataaactacgctgacagaaagtggtgttttgatggaattaagaataaccagatcctcgaagagaacgtggaagtcgagatttggaccaaagagggcgaaaggaagaaactgaagccccggtggcttgacgcccgcatctattccgatccactagcactgaaagagttcaaggagttcgcggccgggagaaagagtttgacattaaatctgataactgagatgggaaggctccctacgtttatgacccagaaagctcggaacgccctggacaatcttgcagtgctgcatacagctgaagtaggtggccgagcccacaaccacgcactcagcgagttgccggagactctggaaaccctactgctccttacactgttagccaccgtgactgggggaatcttcttgtttctgatgtcgggcaagggtattgggaaaatgacgctcggcatgtgctgcatcattaccgcttctatcctgctttggtacgcgcaaatacagccccattggattgccgcatccatcatcctggagttctttctcattgttttgctgatcccagaacctgagaagcagagaacaccccaggataatcaattaacttatgtcgtgatagctattctaaccgtggtcgccgccacaatggcaaacgaaatgggattcctggagaaaaccaagaaggacctcggctttgggagcatcactacacaggagtcagaaagtaatattcttgacatcgatctgcgcccagcttctgcctggacgttgtacgcggttgctaccactttcgtgacacctatgctgaggcactccatagagaacagctcagtaaatgtgagtctcaccgccatcgcaaaccaggccaccgtcctgatgggacttggtaaaggctggcccctcagcaagatggacattggggtgccgctgttggctatcggatgttattcccaggttaatccaattacactgactgcagccttactactgctcgtggcgcattacgctatcattggccctggtcttcaagccaaagcaacgcgggaagcccagaagcgtgctgccgcagggatcatgaaaaaccccaccgtcgatggcataacagtaattgacctggagccaatcccctacgatcctaagtttgaaaagcagttgggacaggtgatgctgctcatcctgtgcgttactcaagtgcttatgatgagaaccacatgggctttatgtgaggccctgaccctcgcgactggcccgatttctacgttgtgggaggggaatcccggaaggttctggaacacaaccatagccgtcagcatggcaaatatctttcgcggctcctatctggctggtgccgggctactgttctcaattatgaaaaacactaccaatacacggcgaggaactggcaacgtgggtgaaaccctcggcgagaagtggaaatctagacttaacgcactggggaagagtgaatttcagatctacaaaaagtcgggcattcaggaggtcgacaggacattggctaaagagggcatcaagcgcggggaaacggatcaccatgccgtgagccggggatccgccaagctgagatggttcgttgagcgtaatatggtgaccccagaaggcaaagtagtggacctcggttgcgggaggggaggctggtcttattactgtggtggcctgaagaacgtccgggaggttaaagggttaactaagggaggccctgggcacgaggaaccaatacctatgtcaacatatggatggaatcttgtgcgcctgcaaagcggcgtcgatgtgttctttaccccacccgagaaatgcgacactctcctatgtgatatcggtgaatccagtcctaacccaacaattgaggcggggcgaaccctgagagtattgaatctggtggaaaactggctcaataacaatacgcagttctgcatcaaggttcttaacccctacatgccgtctgtgattgagaagatggaaaccctgcagaggaaatatggaggcgctttggtccggaatcctctgagccgcaactcaacacacgagatgtactgggtgtccaatgcaactggcaacatcgtcagtagcgtgaatatgatatctagaatgctcattaacaggtttaccatgaagcataaaaaggccacatacgagccagacgttgatttagggtccggaactcgaaacatcggtatcgaatcagagattcccaatctggacataatcggcaaacggattgaaaagatcaagcaggagcacgaaaccagctggcattatgaccaagatcacccttacaaaacatgggcttatcacgggtcgtacgagaccaagcagactggatctgccagttccatggtaaacggcgtggtccgtcttctgacgaaaccatgggacgtggttcccatggtgacacagatggcaatgaccgatactaccccgttcggtcagcaaagagtctttaaggagaaagtggacacacgcacgcaggaacctaaggaggggaccaagaaactaatgaagattactgccgaatggctctggaaagagctgggaaagaaaaagacacccaggatgtgtacccgggaggagttcactagaaaagtacgcagcaatgctgcgttgggcgccatctttacagatgagaacaagtggaagtcagcaagggaagctgtggaggacggccgattctgggaactggttgatcgggagagaaatctccatcttgaggggaaatgcgaaacctgtgtctataacatgatgggaaagagggagaaaaagctgggtgaatttggcaaagccaaggggtcccgcgcaatatggtacatgtggttaggagcccgtttcctggagtttgaggctttgggcttcctcaatgaggaccactggttttctcggggtaacagcctgagtggggtggagggagaaggcctacatagacttggctatatcctgagggaggtggggaagaaagaaggaggtgccatgtacgcggatgacacagcaggctgggatactcgcattaccctcgaggacctgaagaatgaagagatggtcacgaaccacatgaaaggggagcataagaaattggccgaagctatcttcaagctgacctaccagaataaggttgtgcgagtacagcggccaacacctagaggaactgtgatggacattatctccaggaaagatcaacgcggcagcggtcaggtcgggacctatggactcaacacattcactaatatggaggcccagcttattagacaaatggaaggcgagggcatatttaagtctatccagcacctgaccgcaacggaggaaattgctgtgcagaactggttagcccgggttgggagggagcgtctgtcacgaatggctatcagtggagacgattgcgtggtcaaacccatcgacgatcgcttcgcctccgcattgacagcgctcaatgacatgggtaaggtgagaaaagatattcagcaatgggaaccaagccggggctggaacgactggacccaggtacccttttgctctcaccatttccacgagctggttatgaaggatgggagggtgctagtcgtgccttgtcgcaaccaggacgaacttataggcagagcacggatctcgcagggagctggttggtcactgaaggagactgcctgcctcgggaaaagctacgcacaaatgtggacactgatgtattttcataggcgagatttgcgtttagctgccaatgcaatttgttccgccgtgccaagtcactgggtcccgacctctagaactacctggagcatccacgcgaagcatgagtggatgacaacggaagacatgctggctgtttggaaccgcgtgtggattcaggagaatccctggatggaagataaaacccctgtagagtcctgggaagaggtgccatacctcggaaagcgggaggaccagtggtgcggctcacttatcggcctgacaagtagggccacatgggccaaaaatatacagaccgccatcaatcaagtcagatctctaattgggaacgaagagtatactgactacatgcccagcatgaagcgcttccggagggaagaggaagaggctggagtgctgtggtga

SEQ ID NO: 14722 - RNA, 9876 nt, synthetic construct
  misc_feature 1..9876: note = derived and/or modified CDS sequence (opt3) from DENV-2__EU482732__SS-prME
  source 1..9876: mol_type = other RNA
accgtgggcgtcatcattatgctgatacccacagccatggctttccacctcactacgagaaacggggagcctcatatgatcgttggaaggcaggaaaagggtaaaagccttctgtttaagaccgaggacggcgtgaatatgtgcacattgatggcaattgatttaggggaactgtgtgaggacactatcacctacaaatgcccactactccggcaaaacgaaccggaggatattgactgttggtgcaattccacatctacctgggtaacttatggaacatgtaccacgactggcgagcaccgccgagaaaagcgttcagtggccctggtcccccatgtgggtatggggcttgagaccagaacagaaacttggatgagtagcgagggagcgtggaaacacgttcagaggatcgagacctggatactgcggcatcctggcttcacaatcatggctgccattttggcatacaccatcggcacgactcactttcagcgcgccctcattttcatcctgctgacagctgtggcaccatccatgaccatgagatgcatagggatttctaacagggattttgtcgaaggagtgtcgggtggctcatgggtagacatcgttctcgagcacgggagctgtgtgactacaatggccaagaataagcccaccttagatttcgaactgattaaaacggaggctaagcagcctgccacccttcggaaatattgcatcgaagcgaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggattgtgacctgcgcaatgtttacatgcaaaaagaatatggaaggaaaagtggtcctccctgagaacctggaatacaccatagttatcactccacacagcggtgaggagcatgccgtgggcaatgacacggggaagcacggaaaagaaattaagatcacaccgcagtcctcaataaccgaggctgaacttactggctatggtaccgtaacaatggagtgtagtcccaggaccgggctggatttcaacgaaatggtgttgctccagatggaggacaaagcctggctggtccaccggcaatggtttttagatctgcctctcccatggcttcccggcgcagacactcagggaagcaattggattcagaaggagacactggtgacgttcaagaaccctcatgctaaaaagcaggacgttgtggtcttgggctctcaagaaggggccatgcacaccgcgctaactggagccacagagatccagatgtcctcaggtaatctgctctttaccggccatctgaaatgccgtcttcgcatggataagctgcagttgaaagggatgagctacagtatgtgtacaggaaagttcaagatcgtgaaagaaattgcagagactcaacacggcaccatcgtaattagagttcagtatgagggtgacgggtctccatgcaagatacccttcgaaatcatggatctcgagaaaaggcatgtgctgggccggttaattacggtcaacccgatcgtgaccgaaaaggactcccctgtcaacatcgaggctgaacccccatttggagatagctacattataatcggcgtggagcctgggcagctgaaactaaattggttcaagaagggatcgtctattggtcagatgtttgagacaactatgcgaggcgccaaacgcatggctatcctcggggacaccgcctgggatttcggatccctgggcggtgcatttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgaggtaaaatcttgccactggcctaagtcccatacgttgtggagtaatggagtcctcgaaagcgagatgatcattccaaaaaacttcgccggccccgtgtctcagcacaactaccgacctggttatcatacacagaccgcaggcccatggcacctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtacgggatggaaattaggccattgaaggagaaggaagagaacctggtgaatagcttagttactgccggacatggccaaatagataacttttcgctcggtgtgctgggcatggcgcttttcctggaagagatgttgcgcacacgagtagggaccaaacacgccatcctcctggtcgctgtgtcctttgtgactctaattacaggaaatatgtctttccgggacctgggccgtgtcatggttatggtgggggcaaccatgacggatgacatcggaatgggcgtaacttatctcgccctgcttgctgcctttaaggtgagacccaccttcgcagcgggtttgctgttaaggaaactcacaagcaaggagctgatgatggccaccattgggatcgctcttctgtcacagagtactatacctgaaacaatcctagagctcaccgatgccctggcattgggaatgatggtcctgaaaattgtgcgcaacatggaaaagtaccagttagctgttacaatcatggccatttcctgcgtgcccaatgcagtcatcctccaaaacgcctggaaggtgtcttgtactatactggctgcggttagcgtgtccccacttctgttgacctcaagccagcagaaagccgactggattcctctcgcactgacgatcaagggcctaaatcccacagctatctttctgaccactcttagtcggacctctaaaaagagatcctggccactcaacgaggccgtcatggccgtaggcatggtgagcattctggcttcgtcattgctgaaaaatgacataccgatgacagggcctttagttgcaggaggtctcctgactgtgtgctatgtccttaccggcaggtctgccgatctggaattggagcgagcggctgacgtgaagtgggaggatcaggccgaaatcagtgggtccagccccattctctctatcacgattagcgaggacggatccatgtcaatcaaaaacgaagaggaggaacacacactgaccatactaatccgcactggcctgcttgtaattagtggtgtgttcccagtcagcatccccattacagcagccgcttggtacctctgggaggttaagaagcaacgggcaggggtgctgtgggatgtgccttctccaccccctgtcggaaaagccgaattggaggacggcgcgtatagaatcaagcagaggggcatatttgggtactcccagattggagctggtgtgtataaagaaggcaccttccatactatgtggcacgttacacgtggggccgtattaatgcatcgcggaaagcggatcgagccgtcatgggcagatgtgaaaaaggacctgatcagttacggcggtgggtggaagctcgagggagaatggaaagagggcgaagaggtccaggtgctggcccttgaaccaggcaagaatcccagagctgttcaaaccaaacctgggctgtttaagacgaacactggaaccattggtgccgtgagcttggatttctccccaggcacatctgggtcgcccatcgtcgacaggaaaggaaaggtggtaggcctatacggtaatggggtcgtgacccgaagcggagcatatgtttcagctatagcccagacagagaagtccattgaggataaccctgaaatcgaggacgatattttccggaaaaagcgcctgactatcatggacctccacccgggcgcgggcaaaaccaagagatacctgcccgccatagtgagggaagcaattaaacgggggcttcgaacgttaatcctggctccaacaagagtcgtggccgctgagatggaagaggcactccgcggattgcctatcaggtatcagactcccgccattcgtgccgagcataccggtcgggaaatcgttgacctgatgtgtcacgctacatttaccatgagactcctgagtccagtgagggtccctaactacaatcttattataatggatgaggcgcacttcactgaccccgcatctatcgccgctcgcggctatattagcacccgagtggaaatgggggaggccgcaggaatctttatgacagccacgccaccgggctccagagatcctttcccccagtcaaacgctccaatcatggacgaggaacgggagattcccgaaaggtcttggaatagcggtcatgagtgggtaactgattttaaggggaagaccgtgtggttcgttcctagtataaaagcgggaaacgacatcgccgcatgcctgcgcaagaatggcaaaaaggtcattcaattgtcccgtaaaacatttgatagcgaatacgtgaagaccagagctaacgactgggatttcgtggtcactacagacatctctgagatgggcgccaattttcgggcagagagggtaattgatccacgccgatgtatgaagcccgtgatcctaaccgacggggaagagagagttatactggccggacctatgccggtgacgcactcatccgctgcccagcggaggggtcgcatcggcagaaacccaaaaaatgaaaacgaccagtatatttacatgggggagcccctcgaaaatgatgaggactgcgcgcattggaaggaggcaaaaatgttactggataacatcaatactcctgaaggaattatccccagtatgttcgagccagaaagggagaaggtcgacgccatagatggcgaataccggcttcgtggtgaggctcgcaaaacatttgtggacctgatgcgaagaggggatctccctgtttggttggcctatagggtggctgcagagggcattaactacgccgaccggcgctggtgtttcgatggaatcaagaataaccaaattctggaagagaacgtcgaagtggagatctggaccaaagagggcgaaagaaagaagctcaaacccaggtggctggacgctcggatatatagcgatccacttgccctaaaggagttcaaagaatttgcagcggggcgaaagtcgctgaccttgaatttaatcactgagatgggaagactgcctacattcatgacccagaaagcccgcgacgctctcgataacctggccgtacttcacacagcagaagtgggtggcagggcttacaatcacgccctgtctgagctcccggagactttggaaacgctgctactgctcacccttctggcaacagttactgggggaatttttttattcttgatgtccggcaagggtatcgggaagatgaccctgggcatgtgctgcattatcacagccagcatactcctgtggtatgctcagattcagccccattggatcgcggcctcaatcattcttgagtttttcctgatcgtcctcttgataccagaacctgagaaacaacggaccccccaggacaaccagctgacttacgtggtgattgcaatcttaacggtcgttgctgccaccatggccaatgaaatgggatttctagagaagacaaaaaaggacctgggcctcgggagtattactacccaggagtctgaatccaacatccttgatatagacctgcgtccagcaagcgcttggacattgtatgccgtggcgaccactttcgtaacacctatgctgagacactcaatcgagaatagtagcgtgaacgtctccctcacggctattgccaatcaagcaaccgtgctgatgggacttggtaggggctggcccctctctaaaatggatatcggggttccgctgttggccattggatgttacagccaggtgaacccaatcactctgacagctgcattactactgctcgtcgcccattacgcgattatcggccctggtcttcaggctaaggccacccgcgaagcacagaagcgggccgctgccgggataatgaaaaatcccaccgtagacggcattacagtgatcgatctggagccaatcccctatgaccctaagtttgaaaaacaattgggacaggttatgctgctcgtgctgtgcgtcactcaggtgcttatgatgcgaacgacctgggcattatgtgaggctctgacactcgccactggcccgatttccaccttgtgggaggggaaccccggaagattctggaatacaaccatagcggtctcaatggccaacatctttaggggctcttacctggcaggtgctgggctactgttcagtattatgaagaatactacgaacacacgccggggaaccggcaatatcggtgaaactctcggcgagaaatggaagtcgagacttaacgccctggggaagagcgaatttcagatttataaaaagtccggaatccaagaggtggatcgtaccttggcaaaagagggcataaagaggggggaaacagaccaccatgctgtttctcggggatcagccaaactgcgctggttcgtggagcgaaacatggtaactccagaaggcaaggtggtcgatctcggttgcgggagaggaggctggagctactattgtggtggcctgaaaaatgttagggaggtgaaggggttaaccaagggaggccctgggcacgaagagcccatccctatgtccacatacggatggaaccttgtccggctgcagagtggcgtggacgtattctttacgccacccgagaaatgcgataccctcctatgtgacattggtgaatctagccctaatccaactatcgaggccgggcgcacactgagagtgttgaacctggttgaaaattggctcaacaataacacccagttctgcattaaggtgcttaatccctatatgccgtcagtcatcgagaaaatggaaactctgcaaaggaagtacggaggcgcgttggtgcgaaaccctctgtcccggaatagtacacacgagatgtactgggtcagcaacgctaccggcaatatagtgtcttccgttaacatgatttcacgtatgctcatcaatagatttacgatgaaacataagaaggcaacctatgagccagatgtagacttagggagcggaacacgcaacatcggtattgaaaacgagatacccaatctggacatcattggcaaaaggatcgaaaagattaaacaggagcacgaaacttcgtggcattacgatcaggaccacccttataagacctgggcctaccacgggtcttatgagacaaaacagactggaagtgcttccagcatggtgaacggcgtcgtgaagcttctgaccaagccatgggatgttgtgcccatggtcacacaaatggccatgaccgacactacgccgttcggtcagcagcgggtgtttaaagagaaggtagatacaagaacccaggaacctaaagaggggactaagaaactaatgcgcatcaccgcagaatggctctggaaggagctgggaaagaaaaagacacccaggatgtgtacgcgagaggaattcacccggaaagtgagatcaaatgccgctttgggcgcgatatttactgacgagaacaagtggaaatccgccagggaagcagttgaggattctcgcttctgggaactggtcgaccgtgagcggaatctccatcttgagggcaagtgcgaaacatgtgtgtacaacatgatggggaaaagagagaagaagctgggagaatttggtaaagctaagggcagcagggccatctggtatatgtggttaggggcacgcttcctggagtttgaagccttgggattcctcaatgaggatcactggtttagtcgaggcaactccctgagcggtgtggagggggaaggactacataaacttggctacattctgcgggacgtctctaagaaagagggcggggctatgtacgccgatgacaccgcgggatgggacactagaatcacactcgaagatctgaagaatgaggaaatggttaccaaccacatgaagggtgagcataaaaagttggcagaggccattttcaaactgacatatcaaaataaggtggtaagggtgcagcgcccaactcctagaggcaccgtcatggacatcatttcacggaaagatcagagggggagtggacaggtgggcacgtacggtctcaacaccttcacaaatatggaagctcaacttatacgtcagatggagggggaaggaatctttaagtccattcagcgactgactgttaccgaggagatcgccgtgcaaaactggttagcacgcgtcggcagagaacggctgagcaggatggctatctctggcgacgattgcgtggtaaagcccttggacgatcgcttcgcctcggctctcacagccctgaatgacatggggaaagttagaaaggatattcagcagtgggagccatcacggggatggaacgactggactcaggtgcccttttgcagccaccacttccatgaactagtcatgaaagatggtagggtgcttgtggtcccttgtcgaaaccaagacgagctgataggccgtgcaagaatctcccagggggcgggatggagtctcaaggaaaccgcctgcctgggcaaatcttatgctcagatgtggacgttgatgtactttcaccgccgggatttaaggctggccgcaaatgctatttgtagcgccgttccatcccattgggtgccgacatcaagaaccacttggagtatccacgcaaagcacgagtggatgacaaccgaggacatgctcgccgtatggaaccgcgtgtggattcaggaaaatccctggatggaggacaagactcctgtcgaatcttgggaggaagtgccatatcttggtaaacgggaggatcaatggtgcgggagcctgatcggactaacctccagggcgacatgggctaagaacatacagacggccatcaatcaggttcgatcactgattggcaacgaggaatacaccgactatatgcccagcatgaaaagattccggaaggaggaagaggaagcaggcgtgctctggtga

SEQ ID NO: 14723 - RNA, 9876 nt, synthetic construct
  misc_feature 1..9876: note = derived and/or modified CDS sequence (opt3) from DENV-2__EU482733__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctaactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgaggtaaaatcttgccactggcctaagtcccatacgttgtggagtaatggagtcctcgaaagcgagatgatcattccaaaaaacttcgccggccccgtgtctcagcacaactaccgacctggttatcatacacagaccgcaggcccatggcacctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtacgggatggaaattaggccattgaaggagaaggaagagaacctggtgaatagcttagttactgccggacatggccaaatagataacttttcgctcggtgtgctgggcatggcgcttttcctggaagagatgttgcgcacacgagtagggaccaaacacgccatcctcctggtcgctgtgtcctttgtgactctaattacaggaaatatgtctttccgggacctgggccgtgtcatggttatggtgggggcaaccatgacggatgacatcggaatgggcgtaacttatctcgccctgcttgctgcctttaaggtgagacccaccttcgcagcgggtttgctgttaaggaaactcacaagcaaggagctgatgatggccaccattgggatcgctcttctgtcacagagtactatacctgaaacaatcctagagctcaccgatgccctggcattgggaatgatggtcctgaaaattgtgcgcaacatggaaaagtaccagttagctgttacaatcatggccatttcctgcgtgcccaatgcagtcatcctccaaaacgcctggaaggtgtcttgtactatactggctgcggttagcgtgtccccacttctgttgacctcaagccagcagaaagccgactggattcctctcgcactgacgatcaagggcctaaatcccacagctatctttctgaccactcttagtcggacctctaaaaagagatcctggccactcaacgaggccgtcatggccgtaggcatggtgagcattctggcttcgtcattgctgaaaaatgacataccgatgacagggcctttagttgcaggaggtctcctgactgtgtgctatgtccttaccggcaggtctgccgatctggaattggagcgagcggctgacgtgaagtgggaggatcaggccgaaatcagtgggtccagccccattctctctatcacgattagcgaggacggatccatgtcaatcaaaaacgaagaggaggaacaaacactgaccatactaatccgcactggcctgcttgtaattagtggtgtgttcccagtcagcatccccattacagcagccgcttggtacctctgggaggttaagaagcagcgggcaggggtgctgtgggatgtgccttctccaccccctgtcggaaaagccgaattggaggacggcgcgtatagaatcaagcagaggggcatatttgggtactcccagattggagctggtgtgtataaagaaggcaccttccacactatgtggcatgttacacgtggggccgtattaatgcaccgcggaaagcggatcgagccgtcatgggcagatgtgaaaaaggacctgatcagttacggcggtgggtggaagctcgagggagaatggaaagagggcgaagaggtccaagtgctggcccttgaaccaggcaagaatcccagagctgttcagaccaaacctgggctgtttaagacgaacactggaaccattggtgccgtgagcttggatttctccccaggcacatctgggtcgcccatcgtcgacaggaaaggaaaggtggtaggcctatacggtaatggggtcgtgacccgaagcggagcatatgtttcagctatagcccagacagagaagtccattgaggataaccctgaaatcgaggacgatattttccggaaaaagcgcctgactatcatggacctccatccgggcgcgggcaaaaccaagagatacctgcccgccatagtgagggaagcaattaaacgggggcttcgaacgttaatcctggctccaacaagagtcgtggccgctgagatggaagaggcactccgcggattgcctatcaggtatcagactcccgccattcgtgccgagcacaccggtcgggaaatcgttgacctgatgtgtcatgctacatttaccatgagactcctgagtccagtgagggtccctaactacaatcttattataatggatgaggcgcacttcactgaccccgcatctatcgccgctcgcggctatattagcacccgagtggaaatgggggaggccgcaggaatctttatgacagccacgccaccgggctccagagatcctttcccccaatcaaacgctccaatcatggacgaggaacgggagattcccgaaaggtcttggaatagcggtcacgagtgggtaactgattttaaggggaagaccgtgtggttcgttcctagtataaaagcgggaaacgacatcgccgcatgcctgcgcaagaatggcaaaaaggtcattcagttgtcccgtaaaacatttgatagcgaatacgtgaagaccagagctaacgactgggatttcgtggtcactacagacatctctgagatgggcgccaattttcgggcagagagggtaattgatccacgccgatgtatgaagcccgtgatcctaaccgacggggaagagagagttatactggccggacctatgccggtgacgcattcatccgctgcccagcggaggggtcgcatcggcagaaacccaaaaaatgaaaacgaccaatatatttacatgggggagcccctcgaaaatgatgaggactgcgcgcactggaaggaggcaaaaatgttactggataacatcaatactcctgaaggaattatccccagtatgttcgagccagaaagggagaaggtcgacgccatagatggcgaataccggcttcgtggtgaggctcgcaaaacatttgtggacctgatgcgaagaggggatctccctgtttggttggcctatagggtggctgcagagggcattaactacgccgaccggcgctggtgtttcgatggaatcaagaataaccagattctggaagagaacgtcgaagtggagatctggaccaaagagggcgaaagaaagaagctcaaacccaggtggctggacgctcggatatatagcgatccacttgccctaaaggagttcaaagaatttgcagcggggcgaaagtcgctgaccttgaatttaatcactgagatgggaagactgcctacattcatgacccagaaagcccgcgacgctctcgataacctggccgtacttcatacagcagaagtgggtggcagggcttacaatcacgccctgtctgagctcccggagactttggaaacgctgctactgctcacccttctggcaacagttactgggggaatttttttattcttgatgtccggcaagggtatcgggaagatgaccctgggcatgtgctgcattatcacagccagcatactcctgtggtatgctcagattcaaccccactggatcgcggcctcaatcattcttgagtttttcctgatcgtcctcttgataccagaacctgagaaacagcggaccccccaggacaaccagctgacttacgtggtgattgcaatcttaacggtcgttgctgccaccatggccaatgaaatgggatttctagagaagacaaaaaaggacctgggcctcgggagtattactacccaagagtctgaatccaacatccttgatatagacctgcgtccagcaagcgcttggacattgtatgccgtggcgaccactttcgtaacacctatgctgagacattcaatcgagaatagtagcgtgaacgtctccctcacggctattgccaatcaggcaaccgtgctgatgggacttggtaggggctggcccctctctaaaatggatatcggggttccgctgttggccattggatgttacagccaggtgaacccaatcactctgacagctgcattactactgctcgtcgcccactacgcgattatcggccctggtcttcaggctaaggccacccgcgaagcacaaaagcgggccgctgccgggataatgaaaaatcccaccgtagacggcattacagtgatcgatctggagccaatcccctatgaccctaagtttgaaaaacagttgggacaggttatgctgctcgtgctgtgcgtcactcaggtgcttatgatgcgaacgacctgggcattatgtgaggctctgacactcgccactggcccgatttccaccttgtgggaggggaaccccggaagattctggaatacaaccatagcggtctcaatggccaacatctttaggggctcttacctggcaggtgctgggctactgttcagtattatgaagaatactacgaacacacgccggggaaccggcaatatcggtgaaactctcggcgagaaatggaagtcgagacttaacgccctggggaagagcgaatttcaaatttataaaaagtccggaatccaggaggtggatcgtaccttggcaaaagagggcataaagaggggggaaacagaccatcacgctgtttctcggggatcagccaaactgcgctggttcgtggagcgaaacatggtaactccagaaggcaaggtggtcgatctcggttgcgggagaggaggctggagctactattgtggtggcctgaaaaatgttagggaggtgaaggggttaaccaagggaggccctgggcatgaagagcccatccctatgtccacatacggatggaaccttgtccggctgcagagtggcgtggacgtattctttacgccacccgagaaatgcgataccctcctatgtgacattggtgaatctagccctaatccaactatcgaggccgggcgcacactgagagtgttgaacctggttgaaaattggctcaacaataacacccaattctgcattaaggtgcttaatccctatatgccgtcagtcatcgagaaaatggaaactctgcagaggaagtacggaggcgcgttggtgcgaaaccctctgtcccggaatagtacacacgagatgtactgggtcagcaacgctaccggcaatatagtgtcttccgttaacatgatttcacgtatgctcatcaatagatttacgatgaaacacaagaaggcaacctatgagccagatgtagacttagggagcggaacacgcaacatcggtattgaaaacgagatacccaatctggacatcattggcaaaaggatcgaaaagattaaacaggagcatgaaacttcgtggcactacgatcaggaccatccttataagacctgggcctaccacgggtcttatgagacaaaacaaactggaagtgcttccagcatggtgaacggcgtcgtgcggcttctgaccaagccatgggatgttgtgcccatggtcacacagatggccatgaccgacactacgccgttcggtcagcagagagtgtttaaggagaaagtagatacacgcacccaagaacctaaggaggggactaaaaagctaatgaggatcaccgcagaatggctctggaaagagctgggaaagaagaaaacaccccgaatgtgtacgcgggaggaattcaccagaaaggtgaggtcaaatgccgctttgggcgcgatatttactgacgagaacaaatggaagtccgcccgcgaagcagttgaggattctcgtttctgggaactggtcgaccgggagagaaatctccaccttgagggcaaatgcgaaacatgtgtgtacaacatgatggggaagagggagaaaaagctgggagaatttggtaaggctaaaggcagccgcgccatctggtatatgtggttaggggcacgattcctggagtttgaagccttgggattcctcaatgaggatcattggtttagtcggggcaactccctgagcggtgtggagggggaaggactacacaagcttggctacattctgagagacgtctctaaaaaggagggcggggctatgtacgccgatgacaccgcgggatgggacactaggatcacactcgaagatctgaaaaatgaggaaatggttaccaaccatatgaagggtgagcacaagaaattggcagaggccattttcaagctgacatatcagaataaagtggtacgcgtgcagagaccaactcctcggggcaccgtcatggacatcatttcaaggaaggatcagcgtgggagtggacaagtgggcacgtacggtctcaacaccttcacaaatatggaagctcagcttatacgacagatggagggggaaggaatctttaaatccattcaacgcctgactgttaccgaggagatcgccgtgcagaactggttagcaagagtcggccgggaaaggctgagccgcatggctatctctggcgacgattgcgtggtaaagcccttggacgatagattcgcctcggctctcacagccctgaatgacatggggaaggttcggaaagatattcagcagtgggagccatcaaggggatggaacgactggactcaagtgcccttttgcagccatcacttccacgaactagtcatgaaggatggtcgagtgcttgtggtcccttgtcgtaaccaggacgagctgataggcagagcacgcatctcccagggggcgggatggagtctcaaagaaaccgcctgcctgggcaagtcttatgctcagatgtggacgttgatgtactttcatcggagggatttaagactggccgcaaatgctatttgtagcgccgttccatcccactgggtgccgacatcacgcaccacttggagtatccatgcaaaacacgagtggatgacaaccgaggacatgctcgccgtatggaaccgggtgtggattcaagaaaatccctggatggaggacaagactcctgtcgaatcttgggaggaagtgccatatcttggtaagagggaggatcagtggtgcgggagcctgatcggactaacctcccgagcgacatgggctaaaaacatacagacggccatcaatcaggttagatcactgattggcaacgaggaatacaccgactatatgcccagcatgaagcggttcaggaaagaggaagaggaagcaggcgtgctctggtga

SEQ ID NO: 14724 - RNA, 9876 nt, synthetic construct
  misc_feature 1..9876: note = derived and/or modified CDS sequence (opt3) from DENV-2__EU482734__SS-prME
  source 1..9876: mol_type = other RNA
accgcaggcgtgatcgtcatgctgattcccacggctatggcattccacctcactacgcgtaacggggagcctcatatgatagttggaaggcaggaaaagggtaagagccttctgtttaagaccgaggacggcgtgaatatgtgcacattgatggcaatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccataatgatcactccacacagcggtgaggagcatgctgtcggcaatgacacggggaagcacggaaaagaaattaagatcacaccgcagtcctcaataaccgaggccgaactgactggctatggtaccgttacaatggagtgtagtcccaggaccgggcttgatttcaacgaaatggtgctgttgcaaatggaggacaaagcatggctcgtacaccggcagtggtttctggatttacctctgccatggctccccggcgctgacactcagggaagcaattggattcagaaggagacacttgtgacgttcaagaaccctcatgccaaaaagcaagacgtcgtggttctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtgaaagaaattgctgagactcagcacggcaccatcgtcattagagtgcagtatgagggtgacgggtctccatgcaagatacccttcgaaatcatggatttggagaaaaggcatgtactcggccggctgattacggttaacccgatcgtgaccgaaaaggactcccctgtcaacatcgaggccgaacccccatttggagatagctacattataatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtctttacatcagtggggaaggccctgcaccaggttttcggcgctatttacggagcggcatttagtggcgtgagctggactatgaaaatccttataggggtaatcattacctggatcggaatgaactccagatctacgagcttgtcagtcagtctggtgctcgttggcgtggtcacactgtatcttggtgccatggtgcaggctgactccgggtgtgtagtgagctggaagaataaagaactgaagtgcggatctggcattttcatcaccgataacgttcacacttggacagagcagtacaagtttcaacccgaatcaccaagtaaattggccagcgcaatacagaaggcccatgaggaaggtatttgtggcatcaggtccgtcacccggctcgagaatctgatgtggaaacagattactcccgagttaaaccacatcctgtctgaaaatgaggtgaagctaaccataatgacaggggacatcaaaggaattatgcaggctggcaagcgctcgctcagacctcaaccaacggaactgaaatatagctggaagacctgggggaaggccaaaatgctttccactgagtcacataaccagacattcttgatcgatggaccggaaaccgcagagtgccccaatacaaacagggcgtggaatagtctggaggtggaagactacggctttggtgtcttcactaccaacatttggctcaagctgcgtgagaaacaggacgtattttgtgattctaagttaatgagcgctgccatcaaagacaatcgggcagtgcacgccgatatggggtattggatagaatccgctctgaacgacacgtggaagatggagaaggcctcattcattgaggtgaaaagctgccactggcctaagtctcatacactttggtccaatggagtattggaaagtgagatgatcatccccaagaatttcgcaggccccgtcagccagcacaactaccgacctggttatcatacccaaactgctggcccatggcacctcgggaagctggaaatggattttgacttctgtgagggaaccacagtggttgtgactgaagattgcggcaatagagggccctctctaaggaccacaacggcctccggaaaactgattaccgagtggtgctgtcgctcatgcactctcccgcctctgcggtacagaggcgaggacggttgttggtacgggatggaaatcaggccacttaaggagaaggaagagaacttggtcaatagtctggtgacagcgggacatggccagattgataactttagcttaggtgttctcggcatggccctgttccttgaagagatgctgcgcacccgagtggggactaaacacgctatattgctcgtagcagtctcgtttgtgacactgatcaccggaaatatgtccttccgggacctaggccgtgtgatggtcatggttggggccacgatgactgatgacattggaatgggcgtgacctatctggctctcctggccgcatttaaggtaagacccacattcgcggccggtcttttgctgaggaaattaacctctaaggagctcatgatggctactatcgggattgccctgcttagccagtcaacaatccctgaaaccatactggagctaacagatgcactcgctctgggaatgatggccttgaaaatcgtgaagaacatggaaaagtaccaactggcagtcactattatggccatcagttgcgtgcccaatgctgttattttacagaacgcgtggaaagtgtcctgtaccatcctcgccgcagtctctgtgagcccactgcttctgacgtcctcacagcagaaggctgactggatacctttggccctcacaattaaaggcctgaatcccaccgccatctttctaactaccctgagccgcacaagtaagaaacggtcttggccacttaacgaggctatcatggcagttggcatggtgtccattctcgccagctcgctgttgaagaatgacataccgatgactgggcctctggtcgcgggaggtttactcaccgtatgctatgtgctgacgggcagatcagctgatcttgaactggagagggccgcagacgttaaatgggaggatcaagccgaaatctctgggagttcccccattttgagcatcacaatttctgaggacggaagcatgtccatccgaaacgaagaggaggaacagaccctcactatactgatccgcacaggcctactggtgatttcaggtgtcttcccagtgagtatccccgtaaccgctgcagcctggtacctttgggaggtgaagaagcagcgggcgggggtcctctgggatgttcctagcccaccccctgtgggaaaagctgaactggaggacggcgcctatagaattaagcagaggggcatcttggggtactctcaaataggagccggtgtgtataaagaaggcacttttcacacaatgtggcatgtcacccgtggggcagtgttaatgcaccgcggaaagcggattgagccgtcctgggctgatgttaaaaaggacctggtatcatacggcggtgggtggaagctcgagggagaatggaaagagggcgaagaggtgcaggtcctggcccttgaaccaggcaagaatcccagagcagtgcagacgaaacctgggatcttcaagactaacaccggaacaatcggtgctgttagtctggattttagcccaggcacctccgggtctcccattgtggacaggaaaggaaaggtcgtgggcttgtacggtaatggggtagtcacacgatcgggagcctatgtgagcgcgatcgcccagactgagaagtcaatagaggataaccctgaaattgaggacgatatcttccggaaaaagcgcctaaccattatggacctgcatccgggcgcaggcaaaacgaagagatacctccccgctatcgttagggaagccataaaacgggggctgcgaacacttattttagctccaactagagtggtcgcagccgagatggaagaggccctgcgcggactccctatcaggtatcaaacccccgctatccgtgcggagcacacaggtcgggaaattgtggacttgatgtgtcatgcaaccttcactatgagactgctctccccagttagggtgcctaactacaatctgatcattatggatgaggcccactttaccgaccccgctagtatagccgcacgcggctatatctctacacgagtcgaaatgggggaggccgctggaattttcatgacggcgactccaccgggcagcagagatccttttccccagtccaacgccccaatcatggacgaggaacgggagatccccgaaaggtcatggaactctggtcacgagtgggtgaccgatttcaaggggaagacagtatggtttgtgcctagcattaaagcaggaaacgacatagctgcctgccttcgcaagaatggcaaaaaggttatccagctgagtcgtaaaaccttcgattccgaatacgtcaagactagagcaaacgactgggattttgtggtgacaaccgacattagcgagatgggcgccaatttcaaggctgagcgggtcatcgatccaaggcgctgtatgaaacccgtaattttgacggacggggaagaacgagtgatcctagccggacctatgccggttactcattcttcagcggcacaaagacggggtaggataggccgcaacccaaagaatgaaaacgaccagtatatctacatgggggagcccctggaaaatgatgaggactgcgcccactggaaagaggctaagatgctcttagataacattaatacacctgaaggaatcattccctccatgtttgagccagaaagagagaaagtggacgccatcgatggcgaatacaggctgcggggtgaggctcgtaagaccttcgtcgaccttatgcgccgaggggatctgcctgtgtggctcgcatataaagttgccgctgagggcataaactacgccgacagaaggtggtgttttgatggaattaagaataaccagatcttggaagagaacgtggaagtcgagatttggaccaaggagggcgaacggaaaaagctgaaaccccgctggctcgacgcaagaatctatagtgatccactggcgcttaaggagttcaaagagttcgccgctgggagaaagagcctaactctgaatttgataacagagatgggacggttacctacctttatgacacagaaggcccgaaacgcactggacaatctcgctgtgctgcatactgccgaagccggtggcaaagcctacaaccacgctctttcggagctgccggagacgctcgaaaccttgctgctactgacactccttgcgactgtaaccgggggaatcttcctgtttttaatgtctggcaagggtattgggaaaatgacattgggcatgtgctgcatcattaccgcctccatcctgctctggtatgcacaaatacagccccactggattgctgccagcatcatcctggagttctttcttattgtgctgctcatcccagaacctgagaagcagagaactccccaggataatcaattgacgtacgttgtcatagccattctgaccgtggtggcagctacaatggccaacgaaatgggattcttagagaaaactaagaaggacctaggcctggggtcaatcaccacacaggagagtgaatctaatattctcgacatcgatcttcgcccagcgtccgcttggaccctgtatgccgtcgcaactacatttgttacgcctatgttgaggcatagcatagagaactcaagtgtgaatgtaagcctgaccgccatcgctaaccaggcaactgtgctcatgggactgggtaaaggctggcccctttccaagatggacattggggtcccgctcctggccatcggatgttactctcaggtgaatccaattacattgaccgcggctctgttactactggttgcccactacgcaatcattggccctggtctccaagccaaagctacccgggaagcccagaagcgtgcagctgccgggatcatgaaaaaccccacagtggatggcataactgtcattgaccttgagccaatcccctatgatcctaagttcgaaaagcagctgggacaggtaatgttgctgatcctctgcgtgacgcaagttctgatgatgagaaccacatgggcgctttgtgaggccttaactctggcaaccggcccgattagcacactctgggaggggaatcccggaaggttttggaacaccactatagctgtgtccatggccaatatcttccgcggctcatacttggccggtgctgggctgctattttctattatgaaaaacacgacaaatacccggcgaggaactggcaacatcggtgaaaccctgggcgagaagtggaaaagtagactcaacgcccttgggaagtcggagttccagatttataaaaagagcggaatccaggaggtcgacaggacactggccaaagagggcataaagcgcggggaaactgatcatcacgcggtgtcccggggatctgctaagttgagatggtttgtcgagcgtaatatggtgaccccagaaggcaaagttgtggacctgggttgcgggaggggaggctggtcatactattgtggtggcctcaagaacgtacgggaggtgaaagggctgacaaagggaggccctgggcatgaagaaccaatcacgatgagcacctacggatggaatttagtccgccttcaatccggcgttgatgtgttcttcactcctccagagaaatgcgacacactgctctgtgatattggtgaaagttctcccaaccctaccatcgaggcagggcgaactctaagagtcctgaatttggtggaaaactggctgaataacaatacacagttttgcattaaggtactcaacccatatatgcccagcgtgatcgagaagatggaaacccttcagaggaaatacggaggcgccctggttcggaatccgttgtcacgcaactccacgcacgagatgtactgggtgagtaatgctaccggcaacatagtcagctctgtgaatatgatttccagaatgctgatcaacaggttcacaatgaagcacaaaaaggccacttatgagcctgacgtcgatctcgggtcaggaacccgaaacatcggtattgaaagcgagataccaaatttagacatcattggcaaacggatcgaaaagattaagcaggagcatgaaacatcgtggcactacgaccaagatcatccctataaaacttgggcataccacgggtcttatgagaccaagcagacaggaagtgcctccagcatggtgaacggcgttgtacgtctgcttaccaaaccttgggacgtggtcccaatggtgactcagatggctatgacggatacaaccccctttggtcagcaaagagttttcaaggagaaagtggacactcgcacccaggaaccgaaggaggggacaaagaaactgatgaagatcacggcggaatggctatggaaagagctcggaaagaaaaagacccctaggatgtgtactcgggaggaatttacaagaaaagtccgctcaaatgccgcactgggcgctatattcaccgatgagaacaagtggaagtccgccagggaagcagtggaggacggccgattttgggaattggtagatcgggagagaaatctgcacctcgaggggaaatgcgaaacttgtgtgtacaacatgatgggaaagagggagaagaaacttggtgagttcggcaaagccaaagggtctcgcgctatctggtatatgtggctgggagccagatttttagagttcgaagcgctgggctttttgaatgaggaccattggttcagccggggtaacagtctctccggggttgagggagaaggcctgcacagactaggctacattcttagggatgtcagcaagaaagaagggggagcaatgtacgccgacgatacagctggttgggacacccgcatcacactggaagacctcaagaatgaggaaatggtgactaaccatatgaaaggcgagcacaagaaactggccgaggcaatttttaagttgacctatcagaataaggtggtccgagttcagcggcccacgccaagagggaccgtgatggatatcatttctaggcgcgaccaaagaggatcaggccaggtaggtacatacgggctgaacactttcaccaatatggaagctcagctcatacggcaaatggagggagaaggcatcttcaaaagtattcagcatcttacagtgactgaggagatcgccgtccagaactggctggctagggtgggccgtgaacgattatcccgcatggccatcagcggggatgactgcgttgtgaagcctattgatgacagatttgcatctgcgctgaccgccttgaatgatatgggaaaagtccggaaggacatacagcaatgggagccctcgaggggttggaacgattggacacaggtgccattctgctcacaccactttcatgaactcgtaatgaaagacggccgcgttctggtggtcccctgtagaaaccaggatgagctaatcgggcgggctaggattagccagggagccggctggtcccttaaggaaacagcatgcctgggtaagagttatgctcaaatgtggaccctcatgtacttccaccgacgtgacctgagattggccgcaaatgccatctgttctgcggtgcctagccattgggtgccaacttcccgcacaacctggtcaattcacgctaaacacgagtggatgactaccgaggatatgttagccgtctggaaccgggtttggatccaggaaaatccgtggatggaggacaagacacccgtggaaagttgggaggaagtaccttatctggggaaaagggaggaccagtggtgcggatctctcataggccttacgagcagagcaacctgggccaagaacatccagactgctattaatcaagtgcgctccctgatcggcaacgaggaatacacagattatatgccatcaatgaaacggtttaggcgagaggaagaggaagccggggtcctatggtga

SEQ ID NO: 14725 - RNA, 9876 nt, synthetic construct
  misc_feature 1..9876: note = derived and/or modified CDS sequence (opt3) from DENV-2__EU482735__SS-prME
  source 1..9876: mol_type = other RNA
accgcaggcgtgatcgtcatgctgattcccacggctatggcattccacctcactacgcgtaacggggagcctcatatgatagttggaaggcaggaaaagggtaagagccttctgtttaagaccgaggacggcgtgaatatgtgcacattgatggcaatcgatttaggggaactgtgtgaggacactattacctacaaatgcccactactccggcaaaacgaaccggaggatatcgactgttggtgcaattccacatctacctgggttacttatggaacatgtaccacgactggcgagcaccgccgagaaaagcgttcagtggcgctggtcccccatgtgggtatggggcttgagaccaggacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaggaacaggacaaacgatttatctgcaagcattctatggtcgatagaggctggggtaacgggtgtggactattcggcaagggcgggatcgtgacctgcgccatgtttacatgcaaaaagaatatggaaggaaaaattgtgcagcctgagaacctcgaatacaccataatgatcactccacacagcggtgaggagcatgctgtcggcaatgacacggggaagcacggaaaagaaattaagatcacaccgcagtcctcaataaccgaggccgaactgactggctatggtaccgttacaatggagtgtagtcccaggaccgggcttgatttcaacgaaatggtgctgttgcaaatggaggacaaagcatggctcgtacaccggcagtggtttctggatttacctctgccatggctccccggcgctgacactcagggaagcaattggattcagaaggagacacttgtgacgttcaagaaccctcatgccaaaaagcaagacgtcgtggttctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtgaaagaaattgctgagactcagcacggcaccatcgtcattagagtgcagtatgagggtgacgggtctccatgcaagatacccttcgaaatcatggatttggagaaaaggcatgtactcggccggctgattacggttaacccgatcgtgaccgaaaaggactcccctgtcaacatcgaggccgaacccccatttggagatagctacattataatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtctttacatcagtggggaaggccctgcaccaggttttcggcgctatttacggagcggcatttagtggcgtgagctggactatgaaaatccttataggggtaatcattacctggatcggaatgaactccagatctacgagcttgtcagtcagtctggtgctcgttggcgtggtcacactgtatcttggtgccatggtgcaggctgactccgggtgtgtagtgagctggaagaataaagaactgaagtgcggatctggcattttcatcaccgataacgttcacacttggacagagcagtacaagtttcaacccgaatcaccaagtaaattggccagcgcaatacagaaggcccatgaggaaggtatttgtggcatcaggtccgtcacccggctcgagaatctgatgtggaaacagattactcccgagttaaaccacatcctgtctgaaaatgaggtgaagctaaccataatgacaggggacatcaaaggaattatgcaggctggcaagcgctcgctcagacctcaaccaacggaactgaaatatagctggaagacctgggggaaggccaaaatgctttccactgagtcacataaccagacattcttgatcgatggaccggaaaccgcagagtgccccaatacaaacagggcgtggaatagtctggaggtggaagactacggctttggtgtcttcactaccaacatttggctcaagctgcgtgagaaacaggacgtattttgtgattctaagttaatgagcgctgccatcaaagacaatcgggcagtgcacgccgatatggggtattggatagaatccgctctgaacgacacgtggaagatggagaaggcctcattcattgaggtgaaaagctgccactggcctaagtctcatacactttggtccaatggagtattggaaagtgagatgatcatccccaagaatttcgcaggccccgtcagccagcacaactaccgacctggttatcatacccaaactgctggcccatggcacctcgggaagctggaaatggattttgacttctgtgagggaaccacagtggttgtgactgaagattgcggcaatagagggccctctctaaggaccacaacggcctccggaaaactgattaccgagtggtgctgtcgctcatgcactctcccgcctctgcggtacagaggcgaggacggttgttggtacgggatggaaatcaggccacttaaggagaaggaagagaacttggtcaatagtctggtgacagcgggacatggccagattgataactttagcttaggtgttctcggcatggccctgttccttgaagagatgctgcgcacccgagtggggactaaacacgctatattgctcgtagcagtctcgtttgtgacactgatcaccggaaatatgtccttccgggacctaggccgtgtgatggtcatggttggggccacgatgactgatgacattggaatgggcgtgacctatctggctctcctggccgcatttaaggtaagacccacattcgcggccggtcttttgctgaggaaattaacctctaaggagctcatgatggctactatcgggattgccctgcttagccagtcaacaatccctgaaaccatactggagctaacagatgcactcgctctgggaatgatggccttgaaaatcgtgaagaacatggaaaagtaccaactggcagtcactattatggccatcagttgcgtgcccaatgctgttattttacagaacgcgtggaaagtgtcctgtaccatcctcgccgcagtctctgtgagcccactgcttctgacgtcctcacagcagaaggctgactggatacctttggccctcacaattaaaggcctgaatcccaccgccatctttctaactaccctgagccgcacaagtaagaaacggtcttggccacttaacgaggctatcatggcagttggcatggtgtccattctcgccagctcgctgttgaagaatgacataccgatgactgggcctctggtcgcgggaggtttactcaccgtatgctatgtgctgacgggcagatcagctgatcttgaactggagagggccgcagacgttaaatgggaggatcaagccgaaatctctgggagttcccccattttgagcatcacaatttctgaggacggaagcatgtccatccgaaacgaagaggaggaacagaccctcactatactgatccgcacaggcctactggtgatttcaggtgtcttcccagtgagtatccccgtaaccgctgcagcctggtacctttgggaggtgaagaagcagcgggcgggggtcctctgggatgttcctagcccaccccctgtgggaaaagctgaactggaggacggcgcctatagaattaagcagaggggcatcttggggtactctcaaataggagccggtgtgtataaagaaggcacttttcacacaatgtggcatgtcacccgtggggcagtgttaatgcaccgcggaaagcggattgagccgtcctgggctgatgttaaaaaggacctggtatcatacggcggtgggtggaagctcgagggagaatggaaagagggcgaagaggtgcaggtcctggcccttgaaccaggcaagaatcccagagcagtgcagacgaaacctgggatcttcaagactaacaccggaacaatcggtgctgttagtctggattttagcccaggcacctccgggtctcccattgtggacaggaaaggaaaggtcgtgggcttgtacggtaatggggtagtcacacgatcgggagcctatgtgagcgcgatcgcccagactgagaagtcaatagaggataaccctgaaattgaggacgatatcttccggaaaaagcgcctaaccattatggacctgcatccgggcgcaggcaaaacgaagagatacctccccgctatcgttagggaagccataaaacgggggctgcgaacacttattttagctccaactagagtggtcgcagccgagatggaagaggccctgcgcggactccctatcaggtatcaaacccccgctatccgtgcggagcacacaggtcgggaaattgtggacttgatgtgtcatgcaaccttcactatgagactgctctccccagttagggtgcctaactacaatctgatcattatggatgaggcccactttaccgaccccgctagtatagccgcacgcggctatatctctacacgagtcgaaatgggggaggccgctggaattttcatgacggcgactccaccgggcagcagagatccttttccccagtccaacgccccaatcatggacgaggaacgggagatccccgaaaggtcatggaactctggtcacgagtgggtgaccgatttcaaggggaagacagtatggtttgtgcctagcattaaagcaggaaacgacatagctgcctgccttcgcaagaatggcaaaaaggttatccagctgagtcgtaaaaccttcgattccgaatacgtcaagactagagcaaacgactgggattttgtggtgacaaccgacattagcgagatgggcgccaatttcaaggctgagcgggtcatcgatccaaggcgctgtatgaaacccgtaattttgacggacggggaagaacgagtgatcctagccggacctatgccggttactcattcttcagcggcacaaagacggggtaggataggccgcaacccaaagaatgaaaacgaccagtatatctacatgggggagcccctggaaaatgatgaggactgcgcccactggaaagaggctaagatgctcttagataacattaatacacctgaaggaatcattccctccatgtttgagccagaaagagagaaagtggacgccatcgatggcgaatacaggctgcggggtgaggctcgtaagaccttcgtcgaccttatgcgccgaggggatctgcctgtgtggctcgcatataaagttgccgctgagggcataaactacgccgacagaaggtggtgttttgatggaattaagaataaccagatcttggaagagaacgtggaagtcgagatttggaccaaggagggcgaacggaaaaagctgaaaccccgctggctcgacgcaagaatctatagtgatccactggcgcttaaggagttcaaagagttcgccgctgggagaaagagcctaactctgaatttgataacagagatgggacggttacctacctttatgacacagaaggcccgaaacgcactggacaatctcgctgtgctgcatactgccgaagccggtggcaaagcctacaaccacgctctttcggagctgccggagacgctcgaaaccttgctgctactgacactccttgcgactgtaaccgggggaatcttcctgtttttaatgtctggcaagggtattgggaaaatgacattgggcatgtgctgcatcattaccgcctccatcctgctctggtatgcacaaatacagccccactggattgctgccagcatcatcctggagttctttcttattgtgctgctcatcccagaacctgagaagcagagaactccccaggataatcaattgacgtacgttgtcatagccattctgaccgtggtggcagctacaatggccaacgaaatgggattcttagagaaaactaagaaggacctaggcctggggtcaatcaccacacaggagagtgaatctaatattctcgacatcgatcttcgcccagcgtccgcttggaccctgtatgccgtcgcaactacatttgttacgcctatgttgaggcatagcatagagaactcaagtgtgaatgtaagcctgaccgccatcgctaaccaggcaactgtgctcatgggactgggtaaaggctggcccctttccaagatggacattggggtcccgctcctggccatcggatgttactctcaggtgaatccaattacattgaccgcggctctgttactactggttgcccactacgcaatcattggccctggtctccaagccaaagctacccgggaagcccagaagcgtgcagctgccgggatcatgaaaaaccccacagtggatggcataactgtcattgaccttgagccaatcccctatgatcctaagttcgaaaagcagctgggacaggtaatgttgctgatcctctgcgtgacgcaagttctgaccatgagaacaacttgggcgctttgtgaggccttaaccctggcaacaggcccgattagcaccctctgggaggggaatcccggaaggttttggaacactacgatagctgtgtccatggccaatatcttccgcggctcatacttggccggtgctgggctgctattttctattatgaaaaacacaaccaatactcggcgaggaaccggcaacatcggtgaaacactgggcgagaagtggaaaagtagactcaacgcccttgggaagtcggagttccagatttataaaaagagcggaatccaggaggtcgacaggactctggccaaagagggcataaagcgcggggaaaccgatcatcacgcggtgtcccggggatctgctaagttgagatggtttgtcgagcgtaatatggtgacaccagaaggcaaagttgtggacctgggttgcgggaggggaggctggtcatactattgtggtggcctcaagaacgtacgggaggtgaaagggctgacgaagggaggccctgggcatgaagaaccaatccctatgagcacctacggatggaatttagtccgccttcaatccggcgttgatgtgttcttcactccacccgagaaatgcgacacactgctctgtgatattggtgaaagttctcctaacccaaccatcgaggcagggcgaactctaagagtcctgaatttggtggaaaactggctgaataacaatacacagttttgcattaaggtactcaacccctatatgccgagcgtgatcgagaagatggaaacccttcagaggaaatacggaggcgccctggttcggaatcctttgtcacgcaactccacgcacgagatgtactgggtgagtaatgctaccggcaacatagtcagctctgtgaatatgatttccagaatgctgatcaacaggttcacaatgaagcacaaaaaggccacttatgagccagacgtcgatctcgggtcaggaacccgaaacatcggtattgaaagcgagatacccaatttagacatcattggcaaacggatcgaaaagattaagcaggagcatgaaacatcgtggcactacgaccaagatcatccttataaaacttgggcataccacgggtcttatgagaccaagcagacaggaagtgcctccagcatggtgaacggcgttgtacgtctgcttaccaaaccatgggacgtggtccccatggtgactcagatggctatgacggatacaaccccgtttggtcagcaaagagttttcaaggagaaagtggacactcgcacccaggaacctaaggaggggacaaagaaactgatgaagatcacggcggaatggctatggaaagagctcggaaagaaaaagacccccaggatgtgtactcgggaggaatttacaagaaaagtccgctcaaatgccgcactgggcgctatattcaccgatgagaacaagtggaagtccgccagggaagcagtggaggacggccgattttgggaattggtagatcgggagagaaatctgcacctcgaggggaaatgcgaaacttgtgtgtacaacatgatgggaaagagggagaagaaacttggtgagttcggcaaagccaaagggtctcgcgctatctggtatatgtggctgggagccagatttttagagttcgaagcgctgggctttttgaatgaggaccattggttcagccggggtaacagtctctccggggttgagggagaaggcctgcacagactaggctacattcttagggatgtcagcaagaaagaagggggagcaatgtacgccgacgatacagctggttgggacacccgcatcacactggaagacctcaagaatgaggaaatggtgactaaccatatgaaaggcgagcacaagaaactggccgaggcaatttttaagttgacctatcagaataaggtggtccgagttcagcggccaacgcctagagggaccgtgatggatatcatttctaggcgcgaccaaagaggatcaggccaggtaggtacatacgggctgaacactttcaccaatatggaagctcagctcatacggcaaatggagggagaaggcatcttcaaaagtattcagcatcttacagtgactgaggagatcgccgtccagaactggctggctagggtgggccgtgaacgattatcccgcatggccatcagcggggatgactgcgttgtgaagcccattgatgacagatttgcatctgcgctgaccgccttgaatgatatgggaaaagtccggaaggacatacagcaatgggagccatcgaggggttggaacgattggacacaggtgcccttctgctcacaccactttcatgaactcgtaatgaaagacggccgcgttctggtggtcccttgtagaaaccaggatgagctaatcgggcgggctaggattagccagggagccggctggtcccttaaggaaacagcatgcctgggtaagagttatgctcaaatgtggaccctcatgtacttccaccgacgtgacctgagattggccgcaaatgccatctgttctgcggtgccaagccattgggtgccgacttcccgcacaacctggtcaattcacgctaaacacgagtggatgactaccgaggatatgttagccgtctggaaccgggtttggatccaggaaaatccctggatggaggacaagacacctgtggaaagttgggaggaagtaccatatctggggaaaagggaggaccagtggtgcggatctctcataggccttacgagcagagcaacctgggccaagaacatccagactgctattaatcaagtgcgctccctgatcggcaacgaggaatacacagattatatgccctcaatgaaacggtttaggcgagaggaagaggaagccggggtcctatggtga

SEQ ID NO: 14726 - RNA, 9876 nt, synthetic construct
  misc_feature 1..9876: note = derived and/or modified CDS sequence (opt3) from DENV-2__EU482736__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtggccgaaaaggactcccctgtcaacatcgaggctgaacccccatttggagatagctacatcattataggcgtggagcctgggcagctgaaactaaattggttcaagaagggatcgtctatcggtcagatgtttgagaccacaatgcgaggcgccaaacgcatggcaattctcggggacactgcctgggatttcggatccctgggcggtgtttttacctcaatcgggaaggctcttcaccaagtgttcggcgcgatttacggagcagcctttagtggcgtaagctggacaatgaaaatcttgataggggtcatcattacttggatcggaatgaactccagatctaccagcctgtcagtgagtctcgttctggtgggcgtcgtgacgctttatctgggtgctatggtacaggccgactccgggtgtgtggttagctggaagtctaaagaattgaagtgcggatcaggcattttcatcacagataatgtccacacctggactgagcagtacaagtttcagcccgaaagtccaagcaaactcgcatccgccatacaaaaggctcatgaggaaggtatttgtggcatcaggtctgtgacacggctggagaacttaatgtggaaacagattacccccgagctgaatcacatcctatcggaaaacgaggtgaagctcactataatgaccggggacatcaaaggaattatgcaggccggcaagcgcagcctgagacctcagccaacagaacttaaatattcctggaagacgtgggggaaggcaaaaatgttgtcaaccgagagtcataatcaaactttcctgatcgatggaccggaaacagcggagtgccccaacaccaatagggcttggaactctctcgaggtcgaagactacggctttggtgttttcacaactaatatttggctgaagttacgtgagaaacaggacgtgttttgtgatagcaagctgatgtccgccgcaatcaaagacaaccgggccgtgcacgctgatatggggtattggatagaatcagcccttaatgacacctggaagatggagaaggcaagcttcattgaggtaaaatcttgccactggcctaagtcccatacgttgtggagtaacggagtcctcgaaagcgagatgatcatcccaaaaaatttcgctggccccgtgtctcagcacaactaccgacctggttatcatacacagaccgccggcccatggcacctggggaagctagaaatggattttgacttctgtgagggaactaccgttgtggtcacagaagattgcggcaacagagggccctccctgaggactaccacagcgtcaggaaaactcattacggagtggtgctgtcgcagttgcaccctgccgcctcttcggtacagaggcgaggacggttgttggtacgggatggaaatcaggccattgaaggagaaggaagagaatctggtgaacagcttagttactgccggacatggccaaattgataatttttcgctcggtgtgctgggcatggctcttttcctggaagagatgttgcgcacacgagtagggaccaaacacgcaatgctcctggtcgtggtgtcctttgtcactctaataacaggaaacatgtctttccgggacctgggccgtgttatggtgatggtaggggccaccatgacggatgacatcggaatgggcattacttatctcgctctgcttgccgcatttaaggtgagacccaccttcgcggccggtttgctgttaaggaaactcacaagcaaggagctgatgatggctaccatcgggattgcccttctgtcacagagtactatccctgaaacaatactagagctcaccgatgcactggctttgtccatgatggtcctgaaaatcgtgcgcaatatggaaaagtaccagttagccgttacaattatggcaatctcttgcgtgcccaacgccgtcattctccaaaatgcttggaaggtgagctgtactatcctggcggccgtttccgtgtcaccacttctgttgaccagcagtcagcagaaagcagactggatacctctcgctctgacgattaagggactaaaccccacagccatctttctgaccactctttctcggacctccaaaaagagaagctggccactcaatgaggccatcatggctgtcggcatggtatcgattctggcatcatctttgctgaaaaacgacataccgatgacaggccctttagtggccgggggactcctgactgtttgctatgtgcttaccggtaggagtgcggatctggaattggagcgagctgccgacgtcaagtgggaggatcaggcagaaatctccggcagctctcccattctcagcatcacgatttccgaggacgggtcaatgagtatcaaaaatgaagaggaggaacaaacactgaccatactaatccgcactggactgcttgtgattagcggcgtattcccagtgtctatccccattacagccgctgcatggtacctctgggaggtcaagaagcagcgggccggtgttctgtgggatgtgccttccccaccccctgtggggaaagcggaattggaggacggagcttatagaatcaagcagaggggcatattaggctactcacagattggggccggagtctataaagaaggtacctttcacactatgtggcatgtgacacgtggcgcagttctgatgcaccgcgggaagcggatcgagccgagttgggccgatgtaaaaaaggacctcatcagctacggaggcggttggaagctggagggggaatggaaagagggagaagaggtgcaagtccttgctctggaaccaggcaagaaccccagagccgtgcagaccaaacctggcttgttcaagacgaatactgggaccattggagcagtttccctagatttttctccaggtacatcgggcagccccatcgtggacaggaaagggaaggtcgtgggactgtacggcaacggtgtagtcacccgatcaggggcttatgtgtccgccatagcgcagacagagaagagtattgaggataatcctgaaatcgaggacgatattttccggaaaaagcgcctcactatcatggacctgcatccgggagccggcaaaaccaagagataccttcccgcaatagttagggaagctattaaacggggcttacgaacgctgatcctcgccccaacaagagtggtcgctgcagagatggaagaggccttgcgcgggctgcctatcaggtatcagactcccgccattcgtgctgagcacaccggacgggaaatcgtggacctcatgtgtcatgcgacattcaccatgagactgctttctccagttagggtgcctaactacaacctgattataatggatgaggcacactttactgaccccgccagcatcgctgcccgcggttatatttccacccgagtcgaaatgggcgaggcagccgggatcttcatgacagctacgccaccgggatcaagagatccttttccccaatctaatgcgccaatcatggacgaggaacgggagattcccgaaaggagctggaacagtggccacgagtgggtgactgatttcaagggtaagaccgtatggtttgtgccttccataaaagccgggaatgacatcgcagcttgcttgcgcaagaacggaaaaaaggttattcagctaagccgtaaaacattcgattctgaatacgtcaagaccagagccaatgactgggattttgtggtgactacagacatctcagagatgggcgcaaacttcaaggccgagcgggtcattgatccaaggcgctgtatgaaacccgtaatcctgaccgacggcgaagagcgagtgatactcgctgggcctatgccggttacgcattccagtgccgcgcagagacggggaaggatcggtcgcaatccaaagaacgaaaatgaccaatatatttacatgggcgagcccttagaaaacgatgaggactgcgcacactggaaagaggccaagatgctgcttgataatatcaacactcctgaagggattatccccagcatgtttgagccagaaagagagaaagtggacgctatagatggagaatacaggctgcggggcgaggcccgtaagacattcgtcgacctcatgcgccgaggtgatttgcctgtgtggctggcttatagagttgcagccgaggggattaattacgctgacaggcggtggtgttttgatggcatcaaaaacaatcagattctcgaagagaacgtggaagtcgagatctggaccaaggagggagaacgcaagaaactgaagcccagatggcttgacgccaggatatattcggatccactagcactgaaagagttcaaggaattcgcggccggccggaaatctttgaccttaaacctgatcactgagatggggcgactccctacatttatgacccagaaggctagagacgccctggataatcttgcagtgctgcatacagctgaagccggaggtcgcgcatacaaccacgccctctccgagttgccggagactctggaaacgctactgctccttaccctgttagctacagtaactggcgggattttcttgtttctgatgagcggaaagggcatcggtaaaatgaccctcgggatgtgctgcattatcacagcgtcaatactgctttggtatgcccagattcaaccccactggatcgcagctagtatcattctggagttctttctcatcgtgttgctgataccagaacctgagaagcagaggaccccccaggacaatcagttaacttacgttgtcattgccatcctaacggtggtggccgcaaccatggctaacgaaatgggcttcctggagaaaacaaagaaagacctcggacttggctctattgccactcaagagtccgaaagcaatatcctggatatagacttgcggccagcgtcagcttggaccctgtatgccgtcgcaacaacctttgttactcctatgctccgtcatagtatcgagaacagctccgtgaatgtatctctgacagccattgctaaccaggcaacggtgcttatggggctcggaaagggttggcccctgagcaagatggatatcggcgtcccgttgctggccattgggtgttactcccaggtgaatccaatcaccttaactgcggctctactgctccttgttgcccactacgcaattatcggacctggcctgcaggccaaagctacaagagaagcccaaaagagggcagctgccggtataatgaaaaaccccaccgtggacgggattaccgtcatcgatttggagccaatcccctatgaccctaagttcgaaaaacagctgggccaggtaatgctcctgattctttgcgtgacacaggttttaatgatgcgcactacgtgggcgctgtgtgaggccctcaccttggcaacaggaccgatatcaactctgtgggagggcaatcccgggcggttttggaacaccacaatcgctgtgtctatggccaatattttccgaggaagttacctagcaggcgctggtctgctcttttcgatcatgaagaacaccactaatacgagaagggggacaggaaacattggcgaaacccttggtgagaagtggaaaagccgcctgaatgccttgggcaagtccgaattccaaatctataaaaagtctgggatacaggaggtcgatcggactctggccaaagagggaatcaagagaggcgaaaccgaccatcacgcggtgtcacgtgggagcgctaaactcaggtggtttgtcgagcggaacatggtgacaccagaaggaaaggttgtggatctgggctgcggtcgcgggggatggtcctactattgtggcggtttaaagaacgtacgagaggtgaaaggccttactaaggggggacctggccatgaagagcccattcctatgagtacctacgggtggaatctggtcagactccagtctggagttgacgtgttcttcacaccacccgagaaatgcgatacgctactgtgtgacatcggcgaaagctcacctaacccaaccattgaggcaggtaggactttgcgggtcctgaatctcgtggaaaactggcttaataacaatacacaattttgcatcaaggtactgaacccctatatgccgtccgtgatagagaaaatggaaaccttgcagcgcaagtacgggggagccctggttagaaatcctctcagtaggaacagcactcacgagatgtactgggtgtctaatgctacaggcaacattgtctcctcagtgaatatgatcagccgaatgttaatcaaccggttcaccatgaagcacaaaaaggccacgtatgagccagatgtcgacctgggctcggggacccgtaatattggaatagaatctgagatccccaaccttgacattatcggtaaaagaattgaaaagatcaaacaggagcatgaaacaagttggcactacgatcaggaccatccttataagacttgggcataccacggctcctatgagaccaagcaaacagggagcgcctcatccatggtgaacggagttgtacgcctgctaactaaaccatgggatgtggtccccatggtgacccagatggctatgacagacaccactccgtttggccagcagagggttttcaaggagaaagtggatacgcggacacaagaacctaaggagggtaccaaaaagctcatgaagataactgcggaatggctgtggaaagagttggggaagaaaaagacccccagaatgtgtacacgcgaggaatttacgaggaaagtccgatctaatgccgcactgggagctatcttcaccgacgagaacaagtggaaaagcgcccgggaagcagtggaggatagtagattttgggaactcattgacagggagcgcaatcttcacctggagggcaagtgcgaaacttgtgtatacaacatgatgggcaagcgtgagaaaaagttaggggaattcggaaaagccaagggttcccgggctatctggtatatgtggctgggcgccagatttttggagttcgaagcgctcgggtttctgaatgaggatcattggttcagcaggggaaactctctatcaggcgtggagggtgaagggcttcaccgcctgggatacattctccgagacgttagtaaaaaggagggcggcgcaatgtacgccgatgacacagctgggtgggacacccggatcactctggaagatttgaagaatgaggaaatggtcacaaaccatatgaaaggagagcacaagaaactggccgaggcaatttttaagctcacctatcagaataaagtggtgagagtccagaggccaacacctcgcggtactgttatggacataatctccagacgggatcagaggggcagcgggcaagtgggaacctacggccttaacacgttcaccaatatggaagctcagctgattcgtcagatggagggtgaagggatcttcaagtctatccaacatttaacagtaactgaggagattgccgtgcagaactggctggctcgagtcggacgcgaaagattgtcgcggatggccatatcaggcgacgattgcgtggttaagcccctcgacgataggtttgcaagcgcgctgaccgccctaaatgacatgggcaaagtgcgcaaggatatccagcagtgggagccatccagagggtggaacgactggacacaagtccccttctgcagtcaccactttcatgaacttgtgatgaaagatggacgggtactggttgtgccttgtaggaatcaggacgagctcattggtcgagctcgtatctctcagggcgccgggtggagcctgaaggaaactgcatgcttgggaaaatcctatgctcagatgtggaccttaatgtacttccacagacgcgatctgcggctcgccgcaaacgccatttgttcagcggtcccaagtcattgggtgccgacgtctaggacaacctggagcatccacgctaagcacgagtggatgactacagaggacatgcttgccgtgtggaacagagtctggatacaagaaaatccctggatggaggacaagacccctgttgaatcctgggaggaagtgccatatctgggcaaacgcgaggatcagtggtgcggttcactaatcgggctgactagccgggcaacctgggccaagaacattcagacagctatcaatcaggtaaggtctctcattggaaacgaggaatacacggactatatgccctccatgaaacgatttagacgggaggaagaggaagccggcgtgttgtggtga

SEQ ID NO: 14727 - RNA, 9876 nt, synthetic construct
  misc_feature 1..9876: note = derived and/or modified CDS sequence (opt3) from DENV-2__EU482737__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagagcaggacaaacgatttgtctgcaagcattctatggtggatagaggctggggtaacgggtgtggactattcggcaagggcgggatcgtgacctgcgccatgtttacatgcaaaaagaatatggaaggaaaagtcgttctccctgagaacctggaatacaccatcgtgattactccacacagcggtgaggagcatgctgtaggcaatgacacggggaagcacggaaaagaaataaagatcacaccgcagtcctcaattaccgaggccgaacttactggctatggtaccgtgacaatggagtgtagtcccaggaccgggctggatttcaacgaaatggtcttgctccagatggaggacaaagcatggctggtgcaccggcaatggtttttagatctgcctctcccatggcttcccggcgctgacactcagggaagcaattggatccagaaggagacactggttacgttcaagaaccctcatgccaaaaagcaggacgtggtcgtgttgggctctcaagaaggggcgatgcacaccgccctaactggagcaacagagatacagatgtcctcaggtaatctgctctttaccggccatctgaaatgccgtcttcgcatggataagctgcagttgaaagggatgagctacagtatgtgtacaggaaagttcaagattgtaaaagaaatcgctgagactcaacacggcaccatcgttattagagtgcagtatgagggtgacgggtctccatgcaagatccccttcgaaattatggatctcgagaaaaggcatgtcctgggccggttaataacggtgaacccgatcgtcgccgaaaaggactcccctgtgaacattgaggctgaacccccatttggagatagctacatcatcattggcgttgagcctgggcagctgaaactaaattggttcaagaagggatcgtctataggtcagatgtttgagaccacaatgcgaggcgccaaacgcatggcaatcctcggggacactgcctgggatttcggatccctgggcggtgtgtttacctcaattgggaaggctcttcaccaagtattcggcgcgatctacggagcagcctttagtggcgtcagctggacaatgaaaattttgatcggggtgataatcacttggattggaatgaactccagatctaccagcctgtcagttagtctcgtgctggtcggcgtggtaacgctttatctgggtgctatggtgcaggccgactccgggtgtgttgtcagctggaagtctaaagaattgaagtgcggatcaggcatcttcattacagataatgtgcacacctggactgagcagtacaagtttcagcccgaaagtccaagcaaactcgcatccgccatccaaaaggctcatgaggaaggtatatgtggcattaggtctgtgacacggctggagaacttaatgtggaaacagatcacccccgagctgaatcacattctatcggaaaacgaggtcaagctcactatcatgaccggggacataaaaggaatcatgcaggccggcaagcgcagcctgagacctcagccaacagaacttaaatattcctggaagacgtgggggaaggcaaaaatgttgtcaaccgagagtcataatcaaactttcctgattgatggaccggaaacagcggagtgccccaacaccaatagggcttggaactctctcgaggttgaagactacggctttggtgtgttcacaactaatatctggctgaagttacgtgagaaacaggacgtgttttgtgatagcaagctgatgtccgccgcaattaaagacaaccgggccgtacacgctgatatggggtattggatcgaatcagcccttaatgacacctggaagatggagaaggcaagcttcatagaggtcaaatcttgccactggcctaagtcccatacgttgtggagtaacggagtgctcgaaagcgagatgattatcccaaaaaatttcgctggccccgtttctcagcacaactaccgacctggttatcatacacagaccgccggcccatggcacctggggaagctagaaatggattttgacttctgtgagggaactaccgtggtcgtgacagaagattgcggcaacagagggccctccctgaggactaccacagcgtcaggaaaactcatcacggagtggtgctgtcgcagttgcaccctgccgcctcttcggtacagaggcgaggacggttgttggtacgggatggaaattaggccattgaaggagaaggaagagaatctggttaacagcttagtgactgccggacatggccaaatcgataatttttcgctcggtgtactgggcatggctcttttcctggaagagatgttgcgcacacgagtcgggaccaaacacgcaatgctcctggtggtggtctcctttgttactctaattacaggaaacatgtctttccgggacctgggccgtgtgatggtaatggtgggggccaccatgacggatgacataggaatgggcatcacttatctcgctctgcttgccgcatttaaggtcagacccaccttcgcggccggtttgctgttaaggaaactcacaagcaaggagctgatgatggctaccattgggatcgcccttctgtcacagagtactattcctgaaacaatcctagagctcaccgatgcactggctttgtccatgatggtgctgaaaatagttcgcaatatggaaaagtaccagttagccgtgacaatcatggcaatttcttgcgtccccaacgccgtgatcctccaaaatgcttggaaggttagctgtactattctggcggccgtgtccgtctcaccacttctgttgaccagcagtcagcagaaagcagactggatccctctcgctctgacgataaagggactaaaccccacagccatttttctgaccactctttctcggacctccaaaaagagaagctggccactcaatgaggccatcatggctgtaggcatggtgtcgatcctggcatcatctttgctgaaaaacgacattccgatgacaggccctttagttgccgggggactcctgactgtgtgctatgtccttaccggtaggagtgcggatctggaattggagcgagctgccgacgtgaagtgggaggatcaggcagaaatatccggcagctctcccatcctcagcattacgatctccgaggacgggtcaatgagtattaaaaatgaagaggaggaacaaacactgaccatcctaatacgcactggactgcttgtaatcagcggcgtgttcccagtctctattcccatcacagccgctgcatggtacctctgggaggttaagaagcagcgggccggtgtgctgtgggatgtgccttccccaccccctgtcgggaaagcggaattggaggacggagcttatagaattaagcagaggggcatcttaggctactcacagataggggccggagtgtataaagaaggtacctttcacactatgtggcatgttacacgtggcgcagtactgatgcaccgcgggaagcggattgagccgagttgggccgatgtgaaaaaggacctcatcagctacggaggcggttggaagctggagggggaatggaaagagggagaagaggtccaagtgcttgctctggaaccaggcaagaaccccagagccgttcagaccaaacctggcttgttcaagacgaatactgggaccatcggagcagtgtccctagatttttctccaggtacatcgggcagccccattgtcgacaggaaagggaaggtggtaggactgtacggcaacggtgtcgtgacccgatcaggggcttatgtttccgccatcgcgcagacagagaagagtatagaggataatcctgaaattgaggacgatatcttccggaaaaagcgcctcactattatggacctgcatccgggagccggcaaaaccaagagataccttcccgcaatcgtgagggaagctataaaacggggcttacgaacgctgattctcgccccaacaagagtcgtggctgcagagatggaagaggccttgcgcgggctgcctatcaggtatcagactcccgccatccgtgctgagcacaccggacgggaaattgttgacctcatgtgtcatgcgacattcaccatgagactgctttctccagtgagggtccctaactacaacctgatcattatggatgaggcacactttactgaccccgccagcatagctgcccgcggttatatctccacccgagtggaaatgggcgaggcagccgggattttcatgacagctacgccaccgggatcaagagatccttttccccaatctaatgcgccaatcatggacgaggaacgggagatccccgaaaggagctggaacagtggccacgagtgggtaactgatttcaagggtaagaccgtgtggtttgttccttccattaaagccgggaatgacatagcagcttgcttgcgcaagaacggaaaaaaggtcatccagctaagccgtaaaacattcgattctgaatacgtgaagaccagagccaatgactgggattttgtggtcactacagacatttcagagatgggcgcaaacttcaaggccgagcgggtaatcgatccaaggcgctgtatgaaacccgtgattctgaccgacggcgaagagcgagttatcctcgctgggcctatgccggtgacgcattccagtgccgcgcagagacggggaaggataggtcgcaatccaaagaacgaaaatgaccaatatatctacatgggcgagcccttagaaaacgatgaggactgcgcacactggaaagaggccaagatgctgcttgataatattaacactcctgaagggatcattcccagcatgtttgagccagaaagagagaaagtcgacgctatcgatggagaatacaggctgcggggcgaggcccgtaagacattcgtggacctcatgcgccgaggtgatttgcctgtttggctggcttatagagtggcagccgaggggataaattacgctgacaggcggtggtgttttgatggcattaaaaacaatcagatcctcgaagagaacgtcgaagtggagatttggaccaaggagggagaacgcaagaaactgaagcccagatggcttgacgccaggatctattcggatccactagcactgaaagagttcaaggaattcgcggccggccggaaatctttgaccttaaacctgataactgagatggggcgactccctacatttatgacccagaaggctagagacgccctggataatcttgcagtactgcatacagctgaagccggaggtcgcgcatacaaccacgccctctccgagttgccggagactctggaaacgctactgctccttaccctgttagctacagtgactggcgggatcttcttgtttctgatgagcggaaagggcattggtaaaatgaccctcgggatgtgctgcatcattacagcgtcaatcctgctttggtatgcccagatacaaccccactggattgcagctagtatcatcctggagttctttctcattgttttgctgatcccagaacctgagaagcagaggaccccccaggacaatcagttaacttacgtcgtgatagccattctaacggtggtcgccgcaaccatggctaacgaaatgggcttcctggagaaaacaaagaaagacctcggacttggctctatcgccactcaagagtccgaaagcaatattctggatatcgacttgcggccagcgtcagcttggaccctgtatgccgttgcaacaacctttgtgactcctatgctccgtcatagtatagagaacagctccgtaaatgtgtctctgacagccatcgctaaccaggcaacggtccttatggggctcggaaagggttggcccctgagcaagatggatattggcgtgccgttgctggccatcgggtgttactcccaggttaatccaattaccttaactgcggctctactgctccttgtggcccactacgcaatcattggacctggcctgcaggccaaagctacaagagaagcccaaaagagggcagctgccggtatcatgaaaaaccccaccgtcgacgggataaccgtaattgatttggagccaatcccctatgaccctaagttcgaaaaacagctgggccaggtgatgctcctgatcctttgcgttacacaggtgttaatgatgcgcactacgtgggcgctgtgtgaggccctcaccttggcaacaggaccgatttcaactctgtgggagggcaatcccgggcggttttggaacaccacaatagctgtctctatggccaatatcttccgaggaagttacctagcaggcgctggtctgctcttttcgattatgaagaacaccactaatacgagaagggggacaggaaacatcggcgaaacccttggtgagaagtggaaaagccgcctgaatgccttgggcaagtccgaattccaaatttataaaaagtctgggatccaggaggtggatcggactctggccaaagagggaataaagagaggcgaaaccgaccatcacgcggtctcacgtgggagcgctaaactcaggtggtttgtggagcggaacatggttacaccagaaggaaaggtggtagatctgggctgcggtcgcgggggatggtcctactattgtggcggtttaaagaacgtgcgagaggtcaaaggccttactaaggggggacctggccatgaagagcccatccctatgagtacctacgggtggaatctggttagactccagtctggagtggacgtcttcttcacaccacccgagaaatgcgatacgctactgtgtgacattggcgaaagctcacctaacccaaccatcgaggcaggtaggactttgcgggtgctgaatctcgtagaaaactggcttaataacaatacacaattttgcattaaggtgctgaacccctatatgccgtccgttatcgagaaaatggaaaccttgcagcgcaagtacgggggagccctggtgagaaatcctctcagtaggaacagcactcacgagatgtactgggtctctaatgctacaggcaacatagtgtcctcagtcaatatgattagccgaatgttaatcaaccggttcaccatgaagcacaaaaaggccacgtatgagccagatgtggacctgggctcggggacccgtaatatcggaattgaatctgagatacccaaccttgacatcattggtaaaagaatcgaaaagattaaacaggagcatgaaacaagttggcactacgatcaggaccatccttataagacttgggcataccacggctcctatgagaccaagcaaacagggagcgcctcatccatggttaacggagtagtgcgcctgctaactaaaccatgggatgtcgtgcccatggttacccagatggctatgacagacaccactccgtttggccagcagagggtgttcaaggagaaagtcgatacgcggacacaagaacctaaggagggtaccaaaaagctcatgaagatcactgcggaatggctgtggaaagagttggggaagaaaaagacccccagaatgtgtacacgcgaggaatttacgaggaaagtgcgatctaatgccgcactgggagctatattcaccgacgagaacaagtggaaaagcgcccgggaagcagtagaggatagtagattttgggaactcatcgacagggagcgcaatcttcacctggagggcaagtgcgaaacttgtgtgtacaacatgatgggcaagcgtgagaaaaagttaggggaattcggaaaagccaagggttcccgggctatttggtatatgtggctgggcgccagatttttggagttcgaagcgctcgggtttctgaatgaggatcattggttcagcaggggaaactctctatcaggcgttgagggtgaagggcttcaccgcctgggatacatcctccgagacgtcagtaaaaaggagggcggcgcaatgtacgccgatgacacagctgggtgggacacccggattactctggaagatttgaagaatgaggaaatggtgacaaaccatatgaaaggagagcacaagaaactggccgaggcaatctttaagctcacctatcagaataaagtggtcagagttcagaggccaacacctcgcggtactgtgatggacattatatccagacgggatcagaggggcagcgggcaagtaggaacctacggccttaacacgttcaccaatatggaagctcagctgatccgtcagatggagggtgaagggattttcaagtctatccaacatttaacagtgactgaggagatcgccgtccagaactggctggctcgagtgggacgcgaaagattgtcgcggatggccatttcaggcgacgattgcgttgtgaagcccctcgacgataggtttgcaagcgcgctgaccgccctaaatgacatgggcaaagtccgcaaggatatacagcagtgggagccatccagagggtggaacgactggacacaagtgcccttctgcagtcaccactttcatgaacttgtaatgaaagatggacgggttctggtggtcccttgtaggaatcaggacgagctcatcggtcgagctcgtatttctcagggcgccgggtggagcctgaaggaaactgcatgcttgggaaaatcctatgctcagatgtggaccttaatgtacttccacagacgcgatctgcggctcgccgcaaacgccatctgttcagcggtgccaagtcattgggtgccgacgtctaggacaacctggagcattcacgctaagcacgagtggatgactacagaggacatgcttgccgtctggaacagagtttggatccaagaaaatccctggatggaggacaagacccctgtggaatcctgggaggaagtaccatatctgggcaaacgcgaggatcagtggtgcggttcactaatagggctgactagccgggcaacctgggccaagaacatccagacagctattaatcaggtgaggtctctcatcggaaacgaggaatacacggactatatgccctccatgaaacgatttagacgggaggaagaggaagccggcgtcttgtggtga

SEQ ID NO: 14728 - RNA, 9876 nt, synthetic construct
  misc_feature 1..9876: note = derived and/or modified CDS sequence (opt3) from DENV-2__EU482739__SS-prME
  source 1..9876: mol_type = other RNA
accgccggagtgatcattatgctgatacccacagctatggcattccacctcactacgaggaacggggagcctcatatgatcgtcgggaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggattctgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggattattcggcaagggcgggattgtcacatgcgccatgtttacatgcaaaaagaatatggaaggaaaagtggtgctccctgagaacctggaatacaccatagtcatcactccacacagcggtgaggagcatgctgttggcaatgacacggggaagcacggaaaagaaattaagatcacaccgcagtcctcaataaccgaggccgaacttactggctatggtaccgtgacaatggagtgtagtcccaggaccgggctggatttcaacgaaatggtattgctccagatggaggacaaagcatggctggtgcaccggcaatggtttttagatctgcctctcccatggcttcccggcgctgacactcagggaagcaattggattcagaaggagacactggtcacgttcaagaaccctcatgccaaaaagcaggacgtggttgtgttgggctctcaagaaggggcgatgcacaccgccctgactggagcaacagagatccagatgtcctcaggtaatctgctctttaccggccatctgaaatgccgtcttcgcatggataagctgcagttgaaagggatgagctacagtatgtgtacaggaaagttcaagatcgtcaaagaaattgctgagactcaacacggcaccatcgtgattagagtacagtatgagggtgacgggtctccatgcaagatacccttcgaaatcatggatctcgagaaaaggcatgttctgggccggttaattacggtgaacccgatcgtcaccgaaaaggactcccctgtgaacatcgaggccgaacccccatttggagatagctacattataatcggcgtcgagcctgggcagctgaaactaaattggttcaagaagggatcgtctattggtcagatgtttgagacaactatgcgaggcgctaaacgcatggccatcctcggggacaccgcatgggatttcggatccctgggcggtgtgtttacatcaattgggaaggcccttcaccaagttttcggcgctatctacggagcggcatttagtggcgtgagctggactatgaaaatattgatcggggtaattatcacctggattggaatgaactccagatctacgagcctgtcagtcagtctcgtgctggttggcgtggtcacactttatctgggtgtgatggtacaggccgactccgggtgtgtggttagctggaagaataaagaattgaagtgcggatctggcatcttcataaccgataacgtccacacttggacagagcagtacaagtttcagcccgaatcaccaagtaaactcgctagcgccattcaaaaggcacatgaggaaggtatctgtggcattaggtccgtgacccggctggagaatttaatgtggaaacagatcactcccgagctgaaccacatactatctgaaaatgaggtgaagctcaccatcatgacaggggacattaaaggaatcatgcaggccggcaagcgctcgctgagacctcagccaacggaacttaaatatagctggaagacctgggggaaggctaaaatgttgtccactgagtcacataaccaaacattcctgattgatggaccggaaaccgccgagtgccccaatacaaacagggcatggaatagtctcgaggtcgaagactacggctttggtgttttctctactaacatctggctgaagttacgtgagaaacaggacgtgttttgtgatagcaagctgatgtccgcggctataaaagacaatcgggccgtgcacgcagatatggggtattggattgaatcagcccttaacgacacctggaagatggagaaggctagcttcatcgaggtaaaatcttgccactggcctaagtcccatacgttgtggagtaatggagtcctcgaaagcgagatgatcattcccaaaaacttcgccggccccgtgtctcagcacaactaccgacctggttatcatacacagaccgcaggcccatggcacctggggaagctagaaatggattttgacttctgtgagggaactaccgttgtggtcacagaagattgcggcaatagagggccctccctgaggactaccacagcttcaggaaaactcatcacggagtggtgctgtcgcagttgcaccctgccgcctcttcggtacagaggcgaggacggttgttggtacgggatggaaattaggccattgaaggagaaggaagagaacctggtgaatagcttagttactgccggacatggccaaatagataacttttcgctcggtgtgctgggcatggcgcttttcctggaagagatgttgcgcacacgagtagggaccaaacacgccatcctcctggtcgctgtgtcctttgtgactctaattacaggaaatatgtctttccgggacctgggccgtgtcatggttatggtgggggcaaccatgacggatgacatcggaatgggcgtaacttatctcgccctgcttgctgcctttaaggtgagacccaccttcgcagcgggtttgctgttaaggaaactcacaagcaaggagctgatgatggccaccattgggatcgcacttctgtcacagagtactatacctgaaacaatcctagagctcaccgatgccctggcattgggaatgatggtcctgaaaattgtgcgcaacttagaaaagtaccagctcgctgttacaatcatggccatttcctgcgtgcccaatgcagtcatcctgcaaaacgcctggaaggtgtcttgtactatacttgctgcggttagcgtgtccccactgttgctcacctcaagccagcagaaagccgactggattcctctggcactaacgatcaagggcctgaatcccacagctatctttcttaccactctcagtcggacctctaaaaagagatcctggccactgaacgaggccgtcatggccgtaggcatggtgagcattttggcttcgtcactgctcaaaaatgacataccgatgacagggcctctagttgcaggaggtctgcttactgtgtgctatgtcctgaccggcaggtctgccgatttggaactcgagcgagcggctgacgtgaagtgggaggatcaggccgaaatcagtgggtccagccccattctgtctatcacgattagcgaggacggatccatgtcaatcaaaaacgaagaggaggaacaaacactaaccatactgatccgcactggccttctcgtaattagtggtgtgttcccagtcagcatccccattacagcagccgcttggtacctgtgggaggttaagaagcagcgggcaggggtgttgtgggatgtgccttctccaccccctgtcggaaaagccgaattagaggacggcgcgtatagaatcaagcagaggggcatatttgggtactcccagattggagctggtgtgtataaagaaggcaccttccacactatgtggcatgttacacgtggggccgtactgatgcaccgcggaaagcggatcgagccgtcatgggcagatgtgaaaaaggacctcatcagttacggcggtgggtggaagctggagggagaatggaaagagggcgaagaggtccaagtgcttgccctggaaccaggcaagaatcccagagctgttcagaccaaacctgggttgtttaagacgaacactggaaccattggtgccgtgagcctagatttctccccaggcacatctgggtcgcccatcgtcgacaggaaaggaaaggtggtaggcctgtacggtaatggggtcgtgacccgaagcggagcatatgtttcagctatagcccagacagagaagtccattgaggataaccctgaaatcgaggacgatattttccggaaaaagcgcctcactatcatggacctgcatccgggcgcgggcaaaaccaagagataccttcccgccatagtgagggaagcaattaaacgggggttacgaacgctgatcctcgctccaacaagagtcgtggccgctgagatggaagaggcattgcgcggactgcctatcaggtatcagactcccgccattcgtgccgagcacaccggtcgggaaatcgttgacctcatgtgtcatgctacatttaccatgagactgcttagtccagtgagggtccctaactacaatctgattataatggatgaggcgcacttcactgaccccgcatctatcgccgctcgcggctatattagcacccgagtggaaatgggggaggccgcaggaatctttatgacagccacgccaccgggctccagagatcctttcccccaatcaaacgctccaatcatggacgaggaacgggagattcccgaaaggtcttggaatagcggtcacgagtgggtaactgattttaaggggaagaccgtgtggttcgttcctagtataaaagcgggaaacgacatcgccgcatgcttgcgcaagaatggcaaaaaggtcattcagctatcccgtaaaacatttgatagcgaatacgtgaagaccagagctaacgactgggatttcgtggtcactacagacatctctgagatgggcgccaattttcgggcagagagggtaattgatccacgccgatgtatgaagcccgtgatcctgaccgacggggaagagagagttatactcgccggacctatgccggtgacgcattcatccgctgcccagcggaggggtcgcatcggcagaaaccccaaaaatgaaaacgaccaatatatttacatgggggagcccttagaaaatgatgaggactgcgcgcactggaaggaggcaaaaatgctgcttgataacatcaatactcctgaaggaattatccccagtatgttcgagccagaaagggagaaggtcgacgccatagatggcgaataccggctgcgtggtgaggctcgcaaaacatttgtggacctcatgcgaagaggggatttgcctgtttggctggcctatagggtggctgcagagggcattaactacgccgaccggcgctggtgtttcgatggaatcaagaataaccagattctcgaagagaacgtcgaagtggagatctggaccaaagagggcgaaagaaagaagctgaaacccaggtggcttgacgctcggatatatagcgatccactagccctgaaggagttcaaagaatttgcagcggggcgaaagtcgttgaccttaaatctgatcactgagatgggaagactccctacattcatgacccagaaagcccgcgacgctctggataaccttgccgtactgcatacagcagaagtgggtggcagggcttacaatcacgccctctctgagttgccggagactctggaaacgctactgctccttaccctgttagcaacagttactgggggaatatttttgttcctgatgtccggcaagggtatcgggaagatgaccctcggcatgtgctgcattatcacagccagcatactgctttggtatgctcagattcaaccccactggatcgcggcctcaatcattctggagtttttcctcatcgtcttgctgataccagaacctgagaaacagcggaccccacaggacaaccagttaacttacgtggtgattgcaatcctaacggtcgttgctgccaccatggccaatgaaatgggatttctggagaagaccaaaaaggacctcggccttgggagtattactacccaagagtctgaatccaacatcctggatatagacttgcgtccagcaagcgcttggacactgtatgccgtggcgaccactttcgtaacacctatgctcagacattcaatcgagaatagtagcgtgaacgtctccctgacggctattgccaatcaggcaaccgtgcttatgggactcggtaggggctggcccctgtctaaaatggatatcggggttccgttgctggccattggatgttacagccaggtgaacccaatcactttaacagctgcactactgctccttgtcgcccactacgcgattatcggccctggtctgcaggctaaggccacccgcgaagcacaaaagcgggccgctgccgggataatgaaaaatcccaccgtagacggcattacagtgatcgatttggagccaatcccctatgaccctaagtttgaaaaacagctgggacaggttatgctcctggtgctttgcgtcactcaggtgttaatgatgcgaacgacctgggcactgtgtgaggctctcacattggccactggcccgatttccaccctgtgggaggggaaccccggaagattctggaatacaaccatagcggtctcaatggccaacatctttaggggctcttacctagctggtgctgggctactcttcagtattatgaagaatactacgaacacacgccggggaaccggcaatatcggtgaaactcttggcgagaaatggaagtcgagactgaacgccttgggaaagagcgaatttcaaacctataaaaagtccggcattcaggaggtggatcgtacactggcaaaagagggcatcaagagaggggaaactgaccatcacgctgtttctcggggatcagccaaactccgctggttcgtggagcgaaacatggtaaccccagaaggcaaggtggtcgatctgggttgcgggagaggaggctggagctactattgtggtggccttaaaaatgttagggaggtgaaggggctaacaaagggaggccctgggcatgaggaaccaatacctatgtccacgtacggatggaacctggtccggctccagagtggcgtggacgtattctttaccccacccgagaaatgcgatactctactgtgtgacatcggtgaatctagccctaatccaacaattgaggccgggcgcaccttgagagtgctgaacctcgttgaaaattggcttaacaataacactcaattctgcatcaaggtgctgaatccctatatgccgtcagtcattgagaaaatggaaacattgcagaggaagtacggaggcgcgctggtgcgaaaccctctctcccggaatagtacccacgagatgtactgggtcagcaacgctacgggcaatatcgtgtcttccgttaacatgatatcacgtatgttaattaatagatttaccatgaaacacaagaaggcaacatatgagccagatgtagacctggggagcggaactcgcaacatcggtatcgaaaacgagattcccaatcttgacataatcggcaaaaggattgaaaagatcaaacaggagcatgaaacctcgtggcactacgatcaggaccatccttataagacatgggcctaccacgggtcttatgagactaaacaaaccggaagtgcttccagcatggtgaacggcgtcgtgcggctgctaacaaagccatgggatgttgtgcccatggtcacccagatggccatgactgacacgacaccgttcggtcagcagagagtgtttaaggagaaagtagatacccgcactcaagaacctaaggaggggaccaaaaagctcatgaggattacagcagaatggctgtggaaagagttgggaaagaagaaaacgccccgaatgtgtacccgggaggagttcactagaaaggtgaggtcaaatgccgctctgggcgcgatctttacagacgagaacaaatggaagtccgcccgcgaagcagttgaggattctcgtttctgggaactcgtcgaccgggagagaaatcttcacctggagggcaaatgcgaaacctgtgtgtacaacatgatggggaagagggagaaaaagttaggagaatttggtaaggctaaaggcagccgcgccatatggtatatgtggctgggggcacgattcttggagtttgaagccctcggattcctgaatgaggatcattggtttagtcggggcaactccctaagcggtgtggagggggaaggacttcacaagctgggctacatcctcagagacgtctctaaaaaggagggcggggctatgtacgccgatgacactgcgggatgggacacaaggattaccctggaagatttgaaaaatgaggaaatggttacaaaccatatgaagggtgagcacaagaaactggcagaggccatcttcaagctcacttatcagaataaagtggtacgcgtgcagagaccaacccctcggggcacggtcatggacattatctcaaggaaggatcagcgtgggagtggacaagtgggcacctacggtcttaacacattcactaatatggaagctcagctgattcgacagatggagggggaaggaatatttaaatccatccaacatttaaccgttacagaggagattgccgtgcagaactggctggcacgcgtcggcagagaacggttgagcaggatggctatctctggcgacgattgcgtggtaaagcccctcgacgatcgcttcgcctcggctctgactgccctaaatgacatggggaaggttagaaaagatatccagcagtgggagccatcacggggatggaacgactggacccaagtgcccttttgcagccaccacttccatgaacttgtcatgaaggatggtagggtgctggtggtcccttgtcgaaaccaggacgagctcattggccgtgcaagaatatcccagggggcgggatggagtctgaaagaaacggcctgcttgggcaagtcttatgctcagatgtggacattaatgtactttcaccgccgggatctgaggctcgccgcaaatgctatctgtagcgccgttccatcccattgggtgccgacctcaagaactacatggagtattcacgcaaaacacgagtggatgaccactgaggacatgcttgccgtatggaaccgcgtgtggatccaagaaaatccctggatggaggacaagacccctgtcgaatcttgggaggaagtgccatatctgggtaagcgggaggatcagtggtgcgggagcctaattggactgacatccagggcgacgtgggctaaaaacatccagaccgccataaatcaggttcgatcactcatcggcaacgaggaatacactgactatatgcccagcatgaagagattccggaaagaggaagaggaagcaggcgtgttgtggtga

SEQ ID NO: 14729 - RNA, 9876 nt, synthetic construct
  misc_feature 1..9876: note = derived and/or modified CDS sequence (opt3) from DENV-2__EU482740__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtgaccgaaaaggactcccctgtcaacatcgaggccgaacccccatttggagatagctacatcattataggcgtggagcctgggcagctgaaactaaattggttcaagaagggatcgtctatcggtcagatgtttgagacaactatgcgaggcgctaaacgcatggccattctcggggacaccgcatgggatttcggatccctgggcggtgtttttacatcaatcgggaaggcccttcaccaagtgttcggcgctatttacggagcggcatttagtggcgtaagctggactatgaaaatcttgataggggtcatcattacctggatcggaatgaactccagatctacgagcctgtcagtgagtctcgttctggtgggcgtcgtgacactttatctgggtgccatggtacaggctgactccgggtgtgtggttagctggaagtctaaagaattgaagtgcggatcaggcattttcatcaccgataatgtccacacttggacagagcagtacaagtttcagcccgaaagtccaagcaaactcgcctccgcaatacaaaaggcccatgaggaaggtatttgtggcatcaggtctgtgacccggctggagaacttaatgtggaaacagattactcccgagctgaatcacatcctatcggaaaacgaggtgaagctcaccataatgacaggggacatcaaaggaattatgcagcctggcaagcgcagcctgagaccacagccgacggaacttaaatattcctggaagacctgggggaaggctaaaatgttgtcaactgagagtcataatcaaacattcctgatcgatggacccgaaaccgccgagtgccctaacacaaatagggcatggaactctctcgaggtcgaagactacggctttggtgttttcactaccaatatttggctgaagttacgtgagaaacaggacgtgttttgtgatagcaagctgatgtccgcggctatcaaagacaaccgggccgtgcacgcagatatggggtattggatagaatcagcccttaatgacacgtggaagatggagaaggctagcttcattgaggtaaaatcttgccactggccaaagtcccatacattgtggagtaacggagtcctcgaaagcgagatgatcatccccaaaaatttcgccggccctgtgtctcagcacaactaccgaccaggttatcatacccagactgcaggcccctggcacctggggaagctagaaatggattttgacttctgtgagggaaccacagttgtggtcactgaagattgcggcaacagagggccgtccctgaggaccacaacggcttcaggaaaactcattaccgagtggtgctgtcgcagttgcactctgcctccacttcggtacagaggcgaggacggttgttggtacgggatggaaatcaggcccttgaaggagaaggaagagaatctggtgaacagcttagttacagccggacatggccaaattgataatttttcgctcggtgtgctgggcatggcgcttttcctggaagagatgttgcgcacccgagtagggactaaacacgccatactcctggtcgctgtgtcctttgtgacactaatcaccggaaacatgtctttccgggacctgggccgtgtcatggttatggtgggggcaacgatgactgatgacattggaatgggcgtaacctatctcgccctgcttgctgcctttaaggtgagacctacattcgcagcgggtttgctgttaaggaaactcaccagcaaggagctgatgatggccactatcgggattgctcttctgtcacagagtacaatccccgaaaccatactagagctcacagatgccctggcattgggaatgatggtcctgaaaatcgtgcgcaatatggaaaagtaccagttagctgttactattatggccatctcctgcgtgccaaacgcagtcattctccaaaatgcctggaaggtgtcttgtaccatcctggctgttgtgagcgtctcccctcttctgttgacgtcaagccagcagaaagcggactggatacccctcgccctgacaattaagggcctaaacccaaccgcaatctttctgactacccttagtcggacatctaaaaagagatcctggccgctcaatgaggctatcatggccgtaggcatggtgagcattctggcctcgtcattgctgaaaaacgacatacctatgactgggcccttagttgctggaggtctcctgaccgtgtgctatgtccttacgggcaggtctgcagatctggaattggagcgagccgcggacgtgaagtgggaggatcaggctgaaatcagtgggtccagcccaattctctctatcacaattagcgaggacggatccatgtcaatcaaaaatgaagaggaggaacaaaccctgactatactaatccgcacaggcctgcttgtaattagtggtgtgttccccgtcagcatccctattaccgccgcagcctggtacctctgggaggttaagaagcagcgggctggggtgctgtgggatgtgccatctccccctccggtcggaaaagcagaattggaggacggcgcctatagaatcaagcagaggggcatattagggtactcccagattggagcgggtgtgtataaagaaggcacttttcacacaatgtggcatgttacccgtggggctgtactgatgcaccgcggaaagcggatcgagccatcatgggccgatgtgaaaaaggacctcatcagttacggcggtgggtggaagctggagggagaatggaaagagggcgaagaggtccaagtgcttgcactggaacccggcaagaaccctagagccgttcagacgaaaccagggttgttcaagactaataccggaacaattggtgctgtgagcctagatttttcccccggcacctctgggtcgcctatcgtcgacaggaaaggaaaggtggtaggcctgtacggtaacggggtcgtgacacgaagcggagcctatgtttcagcaatagctcagactgagaagtccattgaggataatccggaaatcgaggacgatattttccggaaaaagcgcctcaccatcatggacctgcatcccggcgccggcaaaacgaagagataccttccagcgatagtgagggaagccattaaacgggggttacgaacactgatcctcgcacctactagagtcgtggctgccgagatggaagaggctttgcgcggactgcccatcaggtatcagaccccagcaattcgtgccgagcacacaggtcgggaaatcgttgacctcatgtgtcatgccaccttcactatgagactgcttagtcctgtgagggtccccaactacaacctgattataatggatgaggctcactttaccgacccagcgtctatcgcagcccgcggctatattagcacacgagtggaaatgggggaggctgccggaatcttcatgacggcaactccgcctggctccagagatccctttccacaatcaaatgcccccatcatggacgaggaacgggagattcctgaaaggtcttggaacagcggtcacgagtgggtaaccgatttcaaggggaagacagtgtggtttgttccaagtataaaagctggaaatgacatcgcggcctgcttgcgcaagaacggcaaacgtgtcattcagctatccagaaagaccttcgatagcgaatacgtgaaaactcgggcaaatgactgggattttgtggtcacaaccgacatctctgagatgggcgctaacttcaaggccgagagggtaattgatccccgccgatgtatgaagcctgtgatcctgacggacggggaagagagagttatactcgcaggaccgatgccagtgactcattcatccgccgctcagcggaggggtcgcatcggcagaaatcccaaaaacgaaaatgaccaatatatttacatgggggagcctttagaaaacgatgaggactgcgcccactggaaggaggcgaaaatgctgcttgataatatcaacacacccgaaggaattatcccaagtatgtttgagcctgaaagggagaaggtcgacgcaatagatggcgaataccggctgcgtggtgaggcccgcaaaaccttcgtggacctcatgcgaagaggggatttgcccgtttggctggcttatagggtggccgctgagggcattaattacgcagaccggcgctggtgttttgatggaatcaagaacaatcagattctcgaagagaacgtcgaagtggagatctggaccaaagagggcgaaagaaagaagctgaaaccaaggtggcttgacgcccggatatatagcgatcctctagctctgaaggagttcaaagaattcgccgcagggcgaaagtcgttgactttaaacctgatcacagagatgggaagactcccgacctttatgacacagaaagcgcgcgacgccctggataatcttgctgtactgcatactgccgaagcaggtggcagggcttacaaccacgccctctctgagttgcccgagacgctggaaaccctactgctccttacactgttagcaactgtgaccgggggaattttcttgtttctgatgtccggcaagggtatcgggaagatgacactcggcatgtgctgcattatcaccgccagcatactgctttggtatgctcagattcaaccacactggatcgcggcctcaatcattctggagttctttctcatcgttttgctgatacctgaacccgagaaacagcggactccacaggacaatcagttaacgtacgtcgtgattgcaatcctaaccgtggtcgctgccacaatggccaacgaaatgggattcctggagaagactaaaaaggacctcggccttgggagtattaccacacaagagtctgaatccaatatcctggatatagacttgcgtcctgcaagcgcttggaccctgtatgccgttgcgactacatttgtgacgcccatgctcagacattcaatcgagaacagtagcgtaaatgtgtccctgaccgctattgccaaccaggcaactgtccttatgggactcggtaaaggctggccgctgtctaagatggatatcggggtgccattgctggccattggatgttacagccaggttaatcctatcacattaaccgctgcactactgctccttgtggcccactacgcgattatcggccccggtctgcaggctaaggccaccagggaagcacaaaaacgcgccgctgccgggataatgaagaacccaacagtcgacggcattactgtaatcgatttggagcccatcccttatgacccgaaattcgaaaagcagctgggacaggtgatgctcctgattctttgcgttacgcaggtgttaatgatgcggaccacatgggcactgtgtgaggctctcactttggccaccggccccatatccacactgtgggaggggaatccaggacgattttggaacaccactatcgcggtctcaatggccaatattttcagaggctcttacctagcaggtgctgggctgctctttagtatcatgaaaaacacgacaaataccaggcgcggaactggcaacattggtgaaacccttggcgagaagtggaagtcgcggctgaatgccttggggaaaagcgaattccaaatctataagaaatccggaatacaggaggtggatagaacactggcaaaggagggcatcaaacgtggggaaactgaccatcacgctgtctctaggggatcagccaagctccggtggtttgtggagcgcaacatggttacccctgaaggcaaagtggtagatctgggttgcgggcgaggaggctggagctactattgtggtggcttaaagaacgtgagagaggtcaaggggcttacaaaaggaggccccgggcatgaagagcctattccaatgtccacgtacggatggaatctggttaggctccagagtggcgtggacgtcttcttcaccccccctgagaagtgcgatactctactgtgtgacatcggtgaatctagcccaaaccccacaattgaggccgggcggaccttgcgcgtgctgaatctcgtagaaaactggcttaataacaatactcaattttgcgtgaaagttctgaacccgtatatgccttcagtgatcgagaagatggaaacattgcagagaaaatacggaggcgcgctggtcaggaatccactctcccgaaacagtacccacgagatgtactgggtgagcaatgctacgggcaacatagtctcttccgtgaatatgatttcacggatgttaatcaaccgtttcaccatgaagcacaagaaagcaacatatgagcccgatgttgacctggggagcggaactagaaatatcggtattgaatcggagatacctaaccttgacatcattggcaagcgcatcgaaaaaattaagcaggagcatgaaacctcttggcactacgatcaggaccatccatataaaacatgggcctaccacgggagttatgagactaagcaaaccggatccgctagctcaatggtaaacggcgtggtcaggctgctaacaaagccctgggatgtggttccgatggtgacccagatggccatgactgacacgacaccttttggtcagcagcgggtcttcaaagagaaggtggataccagaactcaagaacccaaagaggggaccaagaaactcatgaagatcacagcagaatggctgtggaaggagttgggaaaaaagaaaacgccacgcatgtgtaccagggaggaatttactcgaaaggtacggtccaatgccgctctgggcgcgatattcacagacgagaacaaatggaagtctgccagagaagcagtggaggatagcaggttttgggaactcatcgaccgcgagcgtaatcttcacctggagggcaaatgcgaaacctgtgtttacaacatgatggggaagcgggagaagaaattaggagaattcggtaaggctaaaggcagtagagccatttggtatatgtggctgggggcaaggtttttggagttcgaagccctcggatttctgaatgaggatcattggttctcccgcggcaacagcctatctggtgtcgagggggaaggacttcaccgactgggctacatcctccgggacgtgtcaaagaaagagggcggggctatgtacgccgatgacactgcgggatgggacacaagaattaccctggaagatttgaagaatgaggaaatggtgacaaaccatatgaagggtgagcacaaaaagctggcagaggccatctttaaactcacttatcagaataaggtcgttagggtgcagcgccctacccccagaggcacggtaatggacattataagtcggagggatcagcgtgggtccggacaagtgggcacctacggtcttaacacattcactaatatggaagctcagctgatccgacagatggagggggaaggaattttcaaaagcatccaacatttaaccgtcacagaggagatcgccgtgcagaactggctggcacgcgttggcagagaacggttgtctaggatggctatttcgggcgacgattgcgtggtcaagccactcgacgatcgctttgcctcagctctgactgccctaaatgacatggggaaggtgagaaaagatatacagcagtgggagcccagccggggatggaacgactggacccaagtacctttctgctcccaccactttcatgaacttgttatgaaggatggtagggtgctggtcgtgccatgtcgaaatcaggacgagctcatcggccgtgcaagaattagtcagggggcgggatggtctctgaaagaaacggcctgcttgggcaagagctatgctcagatgtggacattaatgtacttccaccgccgggatctgaggctcgccgcaaacgctatctgttccgccgtgccgtcacattgggtccccaccagtagaactacatggtctattcacgcaaaacacgagtggatgaccactgaggacatgcttgccgtttggaaccgcgtgtggatccaagaaaatccttggatggaggacaagaccccagtagaaagctgggaggaagtgccctatctgggtaagcgggaggatcagtggtgcgggtccctaataggactgacatcaagggcgacgtgggctaaaaacatccagaccgccattaatcaggtccgaagcctcatcggcaacgaggaatacactgactatatgccttctatgaagagatttcggagggaggaagaggaagcaggcgtgttgtggtga

SEQ ID NO: 14730 - RNA, 9876 nt, synthetic construct
  misc_feature 1..9876: note = derived and/or modified CDS sequence (opt3) from DENV-2__EU482741__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtggccgaaaaggactcccctgtcaacatcgaggctgaacccccatttggagatagctacatcattataggcgtggagcctgggcagctgaaactaaattggttcaagaagggatcgtctatcggtcagatgtttgagaccacaatgcgaggcgccaaacgcatggcaattctcggggacactgcctgggatttcggatccctgggcggtgtttttacctcaatcgggaaggctcttcaccaagtgttcggcgcgatttacggagcagcctttagtggcgtaagctggacaatgaaaatcttgataggggtcatcattacttggatcggaatgaactccagatctaccagcctgtcagtgagtctcgttctggtgggcgtcgtgacgctttatctgggtgctatggtacaggccgactccgggtgtgtggttagctggaagtctaaagaattgaagtgcggatcaggcattttcatcacagataatgtccacacctggactgagcagtacaagtttcagcccgaaagtccaagcaaactcgcatccgccatacaaaaggctcatgaggaaggtatttgtggcatcaggtctgtgacacggctggagaacttaatgtggaaacagattacccccgagctgaatcacatcctatcggaaaacgaggtgaagctcactataatgaccggggacatcaaaggaattatgcaggccggcaagcgcagcctgagacctcagccaacagaacttaaatattcctggaagacgtgggggaaggcaaaaatgttgtcaaccgagagtcataatcaaactttcctgatcgatggaccggaaacagcggagtgccccaacaccaatagggcttggaactctctcgaggtcgaagactacggctttggtgttttcacaactaatatttggctgaagttacgtgagaaacaggacgtgttttgtgatagcaagctgatgtccgccgcaatcaaagacaaccgggccgtgcacgctgatatggggtattggatagaatcagcccttaatgacacctggaagatggagaaggcaagcttcattgaggtaaaatcttgccactggcctaagtcccatacgttgtggagtaacggagtcctcgaaagcgagatgatcatcccaaaaaatttcgctggccccgtgtctcagcacaactaccgacctggttatcatacacagaccgccggcccatggcacctggggaagctagaaatggattttgacttctgtgagggaactaccgttgtggtcacagaagattgcggcaacagagggccctccctgaggactaccacagcgtcaggaaaactcattacggagtggtgctgtcgcagttgcaccctgccgcctcttcggtacagaggcgaggacggttgttggtacgggatggaaatcaggccattgaaggagaaggaagagaatctggtgaacagcttagttactgccggacatggccaaattgataatttttcgctcggtgtgctgggcatggctcttttcctggaagagatgttgcgcacacgagtagggaccaaacacgcaatgctcctggtcgtggtgtcctttgtcactctaataacaggaaacatgtctttccgggacctgggccgtgttatggtgatggtaggggccaccatgacggatgacatcggaatgggcattacttatctcgctctgcttgccgcatttaaggtgagacccaccttcgcggccggtttgctgttaaggaaactcacaagcaaggagctgatgatggctaccatcgggattgcccttctgtcacagagtactatccctgaaacaatactagagctcaccgatgcactggctttgggaatgatggtcctgaaaatcgtgcgcaatatggaaaagtaccagttagccgttacaattatggcaatctcctgcgtgcccaacgccgtcattctccaaaatgcttggaaggtgtcttgtactatcctggcggccgttagcgtgtccccacttctgttgacctcaagccagcagaaagcagactggatacctctcgctctgacgattaagggcctaaaccccacagccatctttctgaccactcttagtcggacctctaaaaagagatcctggccactcaatgaggccatcatggctgtcggcatggtaagcattctggcatcgtcattgctgaaaaacgacataccgatgacagggcctttagtggccggaggtctcctgactgtttgctatgtgcttaccggcaggtctgcggatctggaattggagcgagctgccgacgtcaagtgggaggatcaggcagaaatcagtgggtccagccccattctctctatcacgattagcgaggacggatccatgtcaatcaaaaatgaagaggaggaacaaacactgaccatactaatccgcactggcctgcttgtgattagtggtgtattcccagtgagcatccccattacagccgctgcatggtacctctgggaggtcaagaagcagcgggccggggttctgtgggatgtgccttctccaccccctgtggaaaaagcggagttggaagacggagcttatagaatcaagcagaggggcatattaggctactcccagattggggccggagtctataaagagggtacctttcacactatgtggcatgtgacacgtggcgcagttctgatgcaccgcgggaagcggatcgagccgtcatgggccgatgtaaaaaaggacctcatcagttacggaggcggttggaagctggaaggggagtggaaagaaggagaggaagtgcaagtccttgctctggagccaggcaagaaccccagagccgtgcagaccaaacctggcttgttcaagacgaatactgggaccattggagcagttagcctagatttttccccaggtacatctggctcgcccatcgtggacaggaaagggaaggtcgtgggactgtacggcaacggtgtagtcacccgaagcggggcttatgtgtcagccatagcgcagacagagaagtccattgaagataatcctgagatcgaagacgatattttccggaaaaagcgcctcactatcatggacctgcatccgggagccggcaaaaccaagagataccttcccgcaatagttagggaggctattaaacggggcttacgaacgctgatcctcgccccaacaagagtggtcgctgcagaaatggaggaggccttgcgcgggctgcctatcaggtatcagactcccgccattcgtgctgaacacaccggacgggagatcgtggacctcatgtgtcatgcgacattcaccatgagactgcttagtccagttagggtgcctaactacaacctgattataatggatgaagcacactttactgaccccgcctctatcgctgcccgcggttatattagcacccgagtcgagatgggcgaggcagccgggatcttcatgacagctacgccaccgggatccagagatccttttccccaatcaaatgcgccaatcatggacgaagagcgggaaattcccgagaggtcttggaacagcggccacgaatgggtgactgatttcaagggtaagaccgtatggtttgtgcctagtataaaagccgggaatgacatcgcagcttgcttgcgcaagaacggaaaaaaggttattcagctatcccgtaaaacattcgatagcgagtacgtcaagaccagagccaatgactgggattttgtggtgactacagacatctctgagatgggcgcaaacttcaaggccgaacgggtcattgatccaaggcgctgtatgaaacccgtaatcctgaccgacggcgaggaacgagtgatactcgctgggcctatgccggttacgcattcatccgccgcgcagagacggggaaggatcggtcgcaatccaaagaacgagaatgaccaatatatttacatgggcgaacccttagagaacgatgaggactgcgcacactggaaagaagccaagatgctgcttgataatatcaacactcctgaggggattatccccagtatgtttgaaccagagagagaaaaagtggacgctatagatggagagtacaggctgcggggcgaggcccgtaagacattcgtcgacctcatgcgccgaggtgatttgcctgtgtggctggcttatagagttgcagccgaagggattaattacgctgacaggcggtggtgttttgatggcatcaaaaacaatcagattctcgaggaaaacgtggaggtcgagatctggaccaaggaaggagagcgcaagaaactgaagcccagatggcttgacgccaggatatatagcgatccactagcactgaaagaattcaaggagttcgcggccggccggaaatcgttgaccttaaacctgatcactgaaatggggcgactccctacatttatgacccagaaggctagagacgccctggataatcttgcagtgctgcatacagctgaggccggaggtcgcgcatacaaccacgccctctctgagttgccggaaactctggagacgctactgctccttaccctgttagctacagtaactggcgggattttcttgtttctgatgtccggaaagggcatcggtaaaatgaccctcgggatgtgctgcattatcacagcgagcatactgctttggtatgcccagattcaaccccactggatcgcagcttcaatcattctggaattctttctcatcgtgttgctgataccagagcctgaaaagcagaggaccccccaggacaatcagttaacttacgttgtcattgccatcctaacggtggtggccgcaaccatggctaacgagatgggcttcctggagaaaacaaagaaagacctcggacttggcagtattgccactcaagaatctgagtccaatatcctggatatagacttgcggccagcgagcgcttggaccctgtatgccgtcgcaacaacctttgttactcctatgctccgtcattcaatcgaaaacagtagcgtgaatgtatccctgacagccattgctaaccaggcaacggtgcttatggggctcggaaagggttggcccctgtctaagatggatatcggcgtcccgttgctggccattgggtgttacagccaggtgaatccaatcaccttaactgcggctctactgctccttgttgcccactacgcaattatcggacctggcctgcaggccaaagctacaagagaggcccaaaagagggcagctgccggtataatgaaaaaccccaccgtggacgggattaccgtcatcgatttggaaccaatcccctatgaccctaagttcgagaaacagctgggccaggtaatgctcctgattctttgcgtgacacaggttttaatgatgcgcactacgtgggcgctgtgtgaggccctcaccttggcaacaggaccgatatccactctgtgggaaggcaatcccgggcggttttggaacaccacaatcgctgtgtcaatggccaatattttccgaggatcttacctagcaggcgctggtctgctctttagtatcatgaagaacaccactaatacgagaagggggacaggaaacattggcgagacccttggtgaaaagtggaaatcgcgcctgaatgccttgggcaagagcgagttccaaatctataaaaagtccgggatacaggaggtcgatcggactctggccaaagaaggaatcaagagaggcgagaccgaccatcacgcggtgtctcgtgggtcagctaaactcaggtggtttgtcgaacggaacatggtgacaccagagggaaaggttgtggatctgggctgcggtcgcgggggatggagctactattgtggcggtttaaagaacgtacgagaagtgaaaggccttactaaggggggacctggccatgaggagcccattcctatgtccacctacgggtggaatctggtcagactccagagtggagttgacgtgttcttcacaccacccgaaaaatgcgatacgctactgtgtgacatcggcgagtctagccctaacccaaccattgaagcaggtaggactttgcgggtcctgaatctcgtggagaactggcttaataacaatacacaattttgcatcaaggtactgaacccctatatgccgtcagtgatagaaaaaatggagaccttgcagcgcaagtacgggggagccctggttagaaatcctctctccaggaacagtactcacgagatgtactgggtgagcaatgctacaggcaacattgtctcttccgtgaatatgatctcacgaatgttaatcaaccggttcaccatgaagcacaaaaaggccacgtatgaaccagatgtcgacctgggcagcgggacccgtaatattggaatagagtcggaaatccccaaccttgacattatcggtaaaagaattgagaagatcaaacaggaacatgagacatcttggcactacgatcaggaccatccttataagacttgggcataccacggcagttatgagaccaagcaaacagggtccgccagctcaatggtgaacggagttgtacgcctgctaactaaaccatgggatgtggtccccatggtgacccagatggctatgacagacaccactccgtttggccagcagagggttttcaaggaaaaagtggatacgcggacacaagagcctaaggaaggtaccaaaaagctcatgaagataactgcggagtggctgtggaaagagttggggaagaaaaagacccccagaatgtgtacacgcgaagagtttacgaggaaagtccgatccaatgccgcactgggagctatcttcaccgacgaaaacaagtggaaatctgcccgggaggcagtggaagatagcagattttgggagctcattgacagggagcgcaatcttcacctggaaggcaagtgcgagacttgtgtatacaacatgatgggcaagcgtgaaaaaaagttaggggagttcggaaaagccaagggtagtcgggctatctggtatatgtggctgggcgccagatttttggaattcgaggcgctcgggtttctgaatgaggatcattggttctccaggggaaacagcctatctggcgtggaaggtgaggggcttcaccgcctgggatacattctccgagacgtttcaaaaaaggaaggcggcgcaatgtacgccgatgacacagctgggtgggacacccggatcactctggaggatttgaagaatgaagagatggtcacaaaccatatgaaaggagagcacaagaaactggccgaagcaatttttaagctcacctatcagaataaagtggtgagagtccagaggccaacacctcgcggtactgttatggacataatcagtagacgggatcagaggggctccgggcaagtgggaacctacggccttaacacgttcaccaatatggaggctcagctgattcgtcagatggaaggtgaggggatcttcaagagcatccaacatttaacagtaactgaggaaattgccgtgcagaactggctggctcgagtcggacgcgagagattgtctcggatggccatatcgggcgacgattgcgtggttaagcccctcgacgataggtttgcatcagcgctgaccgccctaaatgacatgggcaaagtgcgcaaggatatccagcagtgggaaccaagcagagggtggaacgactggacacaagtccccttctgctcccaccactttcatgagcttgtgatgaaagatggacgggtactggttgtgccttgtaggaatcaggacgaactcattggtcgagctcgtatcagtcagggcgccgggtggtctctgaaggagactgcatgcttgggaaaaagctatgctcagatgtggaccttaatgtacttccacagacgcgatctgcggctcgccgcaaacgccatttgttccgcggtcccatcacattgggtgccgacgagtaggacaacctggtctatccacgctaagcacgagtggatgactacagaagacatgcttgccgtgtggaacagagtctggatacaagagaatccctggatggaagacaagacccctgttgagagctgggaagaggtgccatatctgggcaaacgcgaggatcagtggtgcggttccctaatcgggctgacttcacgggcaacctgggccaagaacattcagacagctatcaatcaggtaaggagcctcattggaaacgaagagtacacggactatatgccctctatgaaacgatttagacgggaagaggaagaggccggcgtgttgtggtga

SEQ ID NO: 14731 - RNA, 9876 nt, synthetic construct
  misc_feature 1..9876: note = derived and/or modified CDS sequence (opt3) from DENV-2__EU482742__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaccagagattcagatgtcctcaggtaatctgctctttacaggccatctgaaatgccgtcttcgcatggataagctgcagttgaaagggatgagctacagtatgtgtaccggaaagttcaagatcgtgaaagaaatcgctgagacacaacacggcactattgtaatcagagttcagtatgagggtgacgggtctccctgcaagattccgttcgaaataatggatctcgagaaaaggcatgtgctgggccggttaatcaccgtcaaccctattgtgacggaaaaggactcccccgtcaacatcgaggccgaaccaccttttggagatagctacatcattataggcgtggagcccgggcagctgaaactaaattggttcaagaagggatcgtctatcggtcagatgtttgagaccacaatgcgaggcgctaaacgcatggccattctcggggacactgcatgggatttcggatccctgggcggtgtttttacctcaatcgggaaggcccttcaccaagtgttcggcgctatttacggagcggcatttagtggcgtaagctggacaatgaaaatcttgataggggtcatcattacttggatcggaatgaactccagatctaccagcctgtcagtgagtctcgttctggtgggcgtcgtgacgctttatctgggtgccatggtacaggctgactccgggtgtgtggttagctggaagtctaaagaattgaagtgcggatcaggcattttcatcacagataatgtccacacctggactgagcagtacaagtttcagccagaaagtcccagcaaactcgcctccgcaatacaaaaggcccatgaggaaggtatttgtggcatcaggtctgtgacacggctggagaacttaatgtggaaacagattacccctgagctgaatcacatcctatcggaaaacgaggtgaagctcactataatgaccggggacatcaaaggaattatgcaggctggcaagcgcagcctgagaccacagccgacagaacttaaatattcctggaagacgtgggggaaggccaaaatgttgtcaaccgagagtcataatcaaactttcctgatcgatggacccgaaacagcagagtgccctaacaccaatagggcgtggaactctctcgaggtcgaagactacggctttggtgttttcacaactaatatttggctgaagttacgtgagaaacaggacgtgttttgtgatagcaagctgatgtccgctgccatcaaagacaaccgggcagtgcacgccgatatggggtattggatagaatcagctcttaatgacacctggaagatggagaaggccagcttcattgaggtaaaatcttgccactggccaaagtcccatacgttgtggagtaacggagtcctcgaaagcgagatgatcatccccaaaaatttcgcaggccctgtgtctcagcacaactaccgaccaggttatcatacacagaccgctggcccctggcacctggggaagctagaaatggattttgacttctgtgagggaactaccgttgtggtcacagaagattgcggcaacagagggccgtccctgaggactaccacagcctcaggaaaactcattacggagtggtgctgtcgcagttgcaccctgcctccacttcggtacagaggcgaggacggttgttggtacgggatggaaatcaggcccttgaaggagaaggaagagaatctggtgaacagcttagttactgcgggacatggccaaattgataatttttcgctcggtgtgctgggcatggcccttttcctggaagagatgttgcgcacacgagtagggaccaaacacgctatactcctggtcgcagtgtcctttgtgactctaatcacaggaaacatgtctttccgggacctgggccgtgtcatggttatggtgggggccaccatgacggatgacattggaatgggcgtaacttatctcgctctgcttgccgcatttaaggtgagacctaccttcgcggccggtttgctgttaaggaaactcacaagcaaggagctgatgatggctaccatcgggattgcccttctgtcacagagtactatccccgaaacaatactagagctcaccgatgcactggctttgggaatgatggtcctgaaaatcgtgcgcaatatggaaaagtaccagttagccgttacaattatggcaatctcctgcgtgccaaacgccgtcattctccaaaatgcttggaaggtgtcttgtactatcctggcggccgttagcgtgtcccctcttctgttgacctcaagccagcagaaagcagactggatacccctcgctctgacgattaagggcctaaacccaacagccatctttctgaccactcttagtcggacctctaaaaagagatcctggccgctcaatgaggccatcatggctgtcggcatggtaagcattctggcatcgtcattgctgaaaaacgacatacctatgacagggcccttagtggccggaggtctcctgactgtttgctatgtgcttaccggcaggtctgcggatctggaattggagcgagctgccgacgtcaagtgggaggatcaggcagaaatcagtgggtccagcccaattctctctatcacgattagcgaggacggatccatgtcaatcaaaaatgaagaggaggaacaaacactgaccatactaatccgcactggcctgcttgtgattagtggtgtattccccgtgagcatccctattacagccgctgcatggtacctctgggaggtcaagaagcagcgggccggggttctgtgggatgtgccatctccccctccggtgggaaaagcggaattggaggacggcgcttatagaatcaagcagaggggcatattagggtactcccagattggagccggtgtctataaagaaggcacctttcacactatgtggcatgtgacacgtggggcagttctgatgcaccgcggaaagcggatcgagccatcatgggccgatgtaaaaaaggacctcatcagttacggcggtgggtggaagctggagggagaatggaaagagggcgaagaggtgcaagtccttgctctggaacccggcaagaaccctagagccgtgcagaccaaaccagggttgttcaagacgaatactggaaccattggtgcagttagcctagatttttcccccggcacatctgggtcgcctatcgtggacaggaaaggaaaggtcgtgggcctgtacggtaacggggtagtcacccgaagcggagcttatgtgtcagccatagcgcagacagagaagtccattgaggataatccggaaatcgaggacgatattttccggaaaaagcgcctcactatcatggacctgcatcccggcgccggcaaaaccaagagataccttccagcaatagttagggaagctattaaacgggggttacgaacgctgatcctcgcccctacaagagtggtcgctgcagagatggaagaggccttgcgcggactgcccatcaggtatcagactccagccattcgtgctgagcacaccggtcgggaaatcgtggacctcatgtgtcatgcgacattcaccatgagactgcttagtcctgttagggtgcccaactacaacctgattataatggatgaggcacactttactgacccagcctctatcgctgcccgcggctatattagcacccgagtcgaaatgggggaggcagccggaatcttcatgacagctacgccgcctggctccagagatccctttccacaatcaaatgcgcccatcatggacgaggaacgggagattcctgaaaggtcttggaacagcggtcacgagtgggtgactgatttcaaggggaagaccgtatggtttgtgccaagtataaaagccggaaatgacatcgcagcttgcttgcgcaagaacggcaaaaaggttattcagctatcccgtaaaacattcgatagcgaatacgtcaagaccagagccaatgactgggattttgtggtgactacagacatctctgagatgggcgcaaacttcaaggccgagcgggtcattgatcccaggcgctgtatgaaacctgtaatcctgaccgacggggaagagcgagtgatactcgctggaccgatgccagttacgcattcatccgccgcgcagagacggggtaggatcggccgcaatcccaagaacgaaaatgaccaatatatttacatgggggagcctttagaaaacgatgaggactgcgcacactggaaagaggccaagatgctgcttgataatatcaacactcccgaaggaattatcccaagtatgtttgagcctgaaagagagaaagtggacgctatagatggcgaatacaggctgcggggtgaggcccgtaagacattcgtcgacctcatgcgccgaggggatttgcccgtgtggctggcttatagagttgcagccgagggcattaattacgctgacaggcggtggtgttttgatggaatcaaaaacaatcagattctcgaagagaacgtggaagtcgagatctggaccaaggagggcgaacgcaagaaactgaagccaagatggcttgacgccaggatatatagcgatcctctagcactgaaagagttcaaggaattcgcggccgggcggaaatcgttgaccttaaacctgatcactgagatgggacgactcccgacatttatgacccagaaggctagagacgccctggataatcttgcagtgctgcatacagctgaagccggtggccgcgcatacaaccacgccctctctgagttgcccgagactctggaaacgctactgctccttaccctgttagctgcggtaacagggggaattttcttgtttctgatgtccggcaagggtatcgggaaaatgactctcggcatgtgctgcattatcaccgccagcatactgctttggtatgcacagattcaaccacactggatcgctgcctcaatcattctggagttctttctcatcgtgttgctgatacctgaacccgagaagcagaggacaccacaggacaatcagttaacctacgttgtcattgccatcctaactgtggtggcagctacgatggccaacgaaatgggattcctggagaaaaccaagaaagacctcggccttgggagtattacaactcaagagtctgaatccaatatcctggatatagacttgcggcctgcgagcgcttggaccctgtatgccgtcgcaacaacctttgttactcccatgctccgtcattcaatcgagaacagtagcgtgaatgtatccctgacagccattgctaaccaggcaacggtgcttatgggactcggtaagggctggccgctgtctaagatggatatcggggtcccattgctggccattggatgttacagccaggtgaatcctatcaccttaactgcggctctactgctccttgttgcccactacgcaattatcggccccggtctgcaggccaaagctacaagagaagcccaaaagagggcagctgccgggataatgaaaaacccaaccgtggacggcattaccgtcatcgatttggagcccatcccttatgacccgaagttcgaaaaacagctgggacaggtaatgctcctgattctttgcgtgacacaggttttaatgatgcgcactacgtgggcgctgtgtgaggccctcaccttggcaacaggccccatatccactctgtgggaggggaatccaggacggttttggaacaccacaatcgctgtgtcaatggccaatattttccgaggctcttacctagcaggtgctgggctgctctttagtatcatgaagaacaccactaatacgagaaggggaacaggcaacattggtgaaacccttggcgagaagtggaaatcgcgcctgaatgccttggggaagagcgaattccaaatctataaaaagtccggaatacaggaggtcgatcggactctggccaaagagggcatcaagagaggggaaaccgaccatcacgcggtgtctcgtggatcagctaaactcaggtggtttgtcgagcggaacatggtgacacctgaaggcaaggttgtggatctgggttgcgggcgcggaggctggagctactattgtggtggcttaaagaacgtacgagaggtgaaagggcttactaagggaggccccgggcatgaagagcctattccaatgtccacctacggatggaatctggtcagactccagagtggcgttgacgtgttcttcacaccccctgagaaatgcgatacgctactgtgtgacatcggtgaatctagcccaaaccccaccattgaggcagggaggactttgcgggtcctgaatctcgtggaaaactggcttaataacaatacacaattttgcatcaaggtactgaacccgtatatgccttcagtgatagagaaaatggaaaccttgcagcgcaagtacggaggcgccctggttagaaatccactctccaggaacagtactcacgagatgtactgggtgagcaatgctacaggcaacattgtctcttccgtgaatatgatctcacgaatgttaatcaaccggttcaccatgaagcacaaaaaggccacgtatgagcccgatgtcgacctggggagcggaacccgtaatattggtatagaatcggagatccctaaccttgacattatcggcaaaagaattgaaaagatcaaacaggagcatgaaacatcttggcactacgatcaggaccatccatataagacttgggcataccacgggagttatgagaccaagcaaacaggatccgccagctcaatggtgaacggcgttgtacgcctgctaactaaaccctgggatgtggtcccgatggtgacccagatggctatgacagacaccactccttttggtcagcagagggttttcaaggagaaagtggatacgcggacacaagaacccaaggaggggaccaaaaagctcatgaagataactgcggaatggctgtggaaagagttgggaaagaaaaagaccccaagaatgtgtacacgcgaggaatttacgaggaaagtccgatccaatgccgcactgggcgctatcttcaccgacgagaacaagtggaaatctgcccgggaagcagtggaggatagcagattttgggaactcattgacagggagcgcaatcttcacctggagggcaagtgcgaaacttgtgtatacaacatgatggggaagcgtgagaaaaagttaggagaattcggtaaagccaagggcagtcgggctatctggtatatgtggctgggggccagatttttggagttcgaagcgctcggatttctgaatgaggatcattggttctccaggggcaacagcctatctggtgtggagggggaaggacttcaccgcctgggctacattctccgagacgtttcaaaaaaggagggcggggcaatgtacgccgatgacacagctggatgggacacccggatcactctggaagatttgaagaatgaggaaatggtcacaaaccatatgaaaggtgagcacaagaaactggccgaggcaatttttaagctcacctatcagaataaagtggtgagagtccagaggcctacaccccgcggcactgttatggacataatcagtagacgggatcagagggggtccggacaagtgggcacctacggtcttaacacgttcaccaatatggaagctcagctgattcgtcagatggagggggaaggaatcttcaagagcatccaacatttaacagtaactgaggagattgccgtgcagaactggctggctcgagtcggccgcgaaagattgtctcggatggccatatcgggcgacgattgcgtggttaagccactcgacgataggtttgcatcagcgctgaccgccctaaatgacatggggaaagtgcgcaaggatatccagcagtgggagcccagcagaggatggaacgactggacacaagtccctttctgctcccaccactttcatgaacttgtgatgaaagatggtcgggtactggttgtgccatgtaggaatcaggacgagctcattggccgagctcgtatcagtcagggggccggatggtctctgaaggaaactgcatgcttgggcaaaagctatgctcagatgtggaccttaatgtacttccacagacgcgatctgcggctcgccgcaaacgccatttgttccgcggtcccgtcacattgggtgcccacgagtaggacaacctggtctatccacgctaagcacgagtggatgactacagaggacatgcttgccgtgtggaacagagtctggatacaagaaaatccttggatggaggacaagaccccagttgaaagctgggaggaagtgccctatctgggtaaacgcgaggatcagtggtgcgggtccctaatcggactgacttcacgggcaacctgggccaagaacattcagacagctatcaatcaggtaaggagcctcattggcaacgaggaatacacggactatatgccttctatgaaacgatttagacgggaggaagaggaagccggcgtgttgtggtga

SEQ ID NO: 14732 - RNA, 9876 nt, synthetic construct
  misc_feature 1..9876: note = derived and/or modified CDS sequence (opt3) from DENV-2__EU482744__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtgaccgaaaaggactcccctgtcaacatcgaggccgaacccccatttggagatagctacatcattataggcgtggagcctgggcagctgaaactaaattggttcaagaagggatcgtctatcggtcagatgtttgagacaactatgcgaggcgctaaacgcatggccattctcggggacaccgcatgggatttcggatccctgggcggtgtttttacatcaatcgggaaggcccttcaccaagtgttcggcgctatttacggagcggcatttagtggcgtaagctggactatgaaaatcttgataggggtcatcattacctggatcggaatgaactccagatctacgagcctgtcagtgagtctcgttctggtgggcgtcgtgacactttatctgggtgccatggtacaggctgactccgggtgtgtggttagctggaagaataaagaattgaagtgcggatctggcattttcatcaccgataacgtccacacttggacagagcagtacaagtttcagcccgaatcaccaagtaaactcgccagcgcaatacaaaaggcccatgaggaaggtatttgtggcatcaggtccgtgacccggctggagaatttaatgtggaaacagattactcccgagctgaaccacatcctatctgaaaatgaggtgaagctcaccataatgacaggggacatcaaaggaattatgcaggctggcaagcgctcgctgagacctcagccaacggaacttaaatatagctggaagacctgggggaaggccaaaatgttgtccactgagtcacataaccaaacattcctgatcgatggaccggaaaccgcagagtgccccaatacaaacagggcgtggaatagtctcgaggtcgaagactacggctttggtgttttcactaccaacatttggctgaagttacgtgagaaacaggacgtgttttgtgattctaagctgatgagcgctgccatcaaagacaatcgggcagtgcacgccgatatggggtattggatagaatccgctcttaacgacacgtggaagatggagaaggcctcattcattgaggtaaaaagctgccactggcctaagtctcatacattgtggtccaatggagtcctcgaaagtgagatgatcatcccaaaaaacttcgcaggccccgtgagccagcacaactaccgacctggttatcatacccagactgctggcccatggcacctggggaagctagaaatggattttgacttctgtgagggaaccacagttgtggtcactgaagattgcggcaatagagggccctctctgaggaccacaacggcctccggaaaactcattaccgagtggtgctgtcgctcatgcactctgccgcctcttcggtacagaggcgaggacggttgttggtacgggatggaaatcaggccattgaaggagaaggaagagaacctggtgaatagtttagttacagcgggacatggccaaattgataactttagcctcggtgtgctgggcatggcccttttcctggaagagatgttgcgcacccgagtagggactaaacacgctatactcctggtcgcagtgtcgtttgtgacactaatcaccggaaatatgtccttccgggacctgggccgtgtcatggttatggtgggggccacgatgactgatgacattggaatgggcgtaacctatctcgctctgcttgccgcatttaaggtgagacccacattcgcggccggtttgctgttaaggaaactcacctctaaggagctgatgatggctactatcgggattgcccttctgagccagtcaacaatccctgaaaccatactagagctcacagatgcactggctttgggaatgatggtcctgaaaatcgtgcgcaacatggaaaagtaccagttagccgttagtattatggcaatctcctgcgtgcccaatgccgtcattctccaaaacgcttggaaggtgtcttgtactatcctggcggccgttagcgtgtccccacttctgttgacctcaagccagcagaaagcagactggatacctctcgctctgacgattaagggcctaaatcccacagccatctttctgaccactcttagtcggacctctaaaaagagatcctggccactcaacgaggccatcatggctgtcggcatggtaagcattctggcatcgtcattgctgaaaaatgacataccgatgacagggcctttagtggccggaggtctcctgactgtttgctatgtgcttaccggcaggtctgcggatctggaattggagcgagctgccgacgtcaagtgggaggatcaggcagaaatcagtgggtccagccccattctctctatcacgattagcgaggacggatccatgtcaatcaaaaacgaagaggaggaacaaacactgaccatactaatccgcactggcctgcttgtgattagtggtgtattcccagtgagcatccccattacagccgctgcatggtacctctgggaggtcaagaagcagcgggccggggttctgtgggatgtgccttctccaccccctgtgggaaaagcggaattggaggacggcgcttatagaatcaagcagaggggcatattagggtactcccagattggagccggtgtctataaagaaggcacctttcacactatgtggcatgtgacacgtggggcagttctgatgcaccgcggaaagcggatcgagccgtcatgggccgatgtaaaaaaggacctcatcagttacggcggtgggtggaagctggagggagaatggaaagagggcgaagaggtgcaagtccttgctctggaaccaggcaagaatcccagagccgtgcagaccaaacctgggttgttcaagacgaacactggaaccattggtgcagttagcctagatttttccccaggcacatctgggtcgcccatcgtggacaggaaaggaaaggtcgtgggcctgtacggtaatggggtagtcacccgaagcggagcttatgtgtcagccatagcgcagacagagaagtccattgaggataaccctgaaatcgaggacgatattttccggaaaaagcgcctcactatcatggacctgcatccgggcgccggcaaaaccaagagataccttcccgcaatagttagggaagctattaaacgggggttacgaacgctgatcctcgccccaacaagagtggtcgctgcagagatggaagaggccttgcgcggactgcctatcaggtatcagactcccgccattcgtgctgagcacaccggtcgggaaatcgtggacctcatgtgtcatgcgacattcaccatgagactgcttagtccagttagggtgcctaactacaatctgattataatggatgaggcacactttactgaccccgcctctatcgctgcccgcggctatattagcacccgagtcgaaatgggggaggcagccggaatcttcatgacagctacgccaccgggctccagagatccttttccccaatcaaacgcgccaatcatggacgaggaacgggagattcccgaaaggtcttggaatagcggtcacgagtgggtgactgatttcaaggggaagaccgtatggtttgtgcctagtataaaagccggaaacgacatcgcagcttgcttgcgcaagaatggcaaaaaggttattcagctatcccgtaaaacattcgatagcgaatacgtcaagaccagagccaacgactgggattttgtggtgactacagacatctctgagatgggcgcaaatttcaaggccgagcgggtcattgatccaaggcgctgtatgaaacccgtaatcctgaccgacggggaagagcgagtgatactcgctggacctatgccggttacgcattcatccgccgcgcagagacggggtaggatcggccgcaacccaaagaatgaaaacgaccaatatatttacatgggggagcccttagaaaatgatgaggactgcgcacactggaaagaggccaagatgctgcttgataacatcaatactcctgaaggaattatccccagtatgtttgagccagaaagagagaaagtggacgctatagatggcgaatacaggctgcggggtgaggcccgtaagacattcgtcgacctcatgcgccgaggggatttgcctgtgtggctggcttatagagttgcagccgagggcattaactacgctgacaggcggtggtgttttgatggaatcaaaaataaccagattctcgaagagaacgtggaagtcgagatctggaccaaggagggcgaacgcaagaaactgaagcccagatggcttgacgccaggatatatagcgatccactagcactgaaagagttcaaggaattcgcggccgggcggaaatcgttgaccttaaatctgatcactgagatgggacgactccctacatttatgacccagaaggctagagacgccctggataaccttgcagtgctgcatacagctgaagccggtggccgcgcatacaatcacgccctctctgagttgccggagactctggaaacgctactgctccttaccctgttagctacagtaactgggggaattttcttgtttctgatgtccggcaagggtatcgggaaaatgaccctcggcatgtgctgcattatcacagcgagcatactgctttggtatgcccagattcaaccccactggatcgcagcttcaatcattctggagttctttctcatcgtgttgctgataccagaacctgagaagcagaggaccccccaggacaaccagttaacttacgttgtcattgccatcctaacggtggtggccgcaaccatggctaatgaaatgggattcctggagaaaacaaagaaagacctcggccttgggagtattactacccaagagtctgaatccaacatcctggatatagacttgcggccagccagcgcgtggacactgtatgctgtcgccaccacttttgttacacctatgctccgtcattcaatcgagaatagtagcgtgaacgtatccctgacggcaattgccaatcaggctaccgtgcttatgggactcggtaagggctggcccctgtctaagatggatatcggggtcccgttgctggcaattggatgttacagccaggtgaacccaatcactttaacagccgcgctactgctccttgttgctcactacgccattatcggccctggtctgcaggcaaaagccaccagagaagctcaaaagagggccgcagctgggataatgaaaaatcccaccgtggacggcattacagtcatcgatttggagccaatcccctatgaccctaagttcgaaaaacagctgggacaggtaatgctcctgattctttgcgtgactcaggttttaatgatgcgcacgacctgggccctgtgtgaggcgctcacattggccactggcccgatatccaccctgtgggaggggaaccccggacggttttggaatacaaccatcgcagtgtcaatggctaacattttccgaggctcttacctagccggtgcagggctgctctttagtatcatgaagaatactacgaacacaagaaggggaaccggcaatattggtgaaactcttggcgagaagtggaaatcgcgcctgaacgctttggggaagagcgaattccaaatctataaaaagtccggaatacaggaggtcgatcggaccctggccaaagagggcatcaagagaggggaaacagaccatcacgccgtgtctcgtggatcagcgaaactcaggtggtttgtcgagcggaacatggtgactccagaaggcaaggttgtggatctgggttgcgggcgcggaggctggagctactattgtggtggcttaaagaatgtacgagaggtgaaagggcttaccaagggaggccctgggcatgaagagcccattcctatgtccacatacggatggaacctggtcagactccagagtggcgttgacgtgttcttcacgccacccgagaaatgcgataccctactgtgtgacatcggtgaatctagccctaatccaactattgaggctgggaggacattgcgggtcctgaacctcgtggaaaattggcttaacaataacacccaattttgcatcaaggtactgaatccctatatgccgtcagtgatagagaaaatggaaactttgcagcgcaagtacggaggcgcactggttagaaaccctctctccaggaatagtacacacgagatgtactgggtgagcaacgccaccggcaatattgtctcttccgtgaacatgatctcacgaatgttaatcaatcggttcacgatgaagcacaaaaaggctacctatgagccagatgtcgacctggggagcggaacacgtaacattggtatagaatcggagatccccaaccttgacattatcggcaaaagaattgaaaagatcaaacaggagcatgaaacttcttggcactacgatcaggaccatccttataagacctgggcctaccacgggagttatgagacaaagcaaactggatccgcaagctcaatggtgaatggcgttgtacgcctgctaaccaaaccatgggatgtggtccccatggtgacacagatggccatgaccgacactacgccgtttggtcagcagagggttttcaaggagaaagtggatacacggacccaagaacctaaggaggggactaaaaagctcatgaagataaccgctgaatggctgtggaaagagttgggaaagaaaaagacacccagaatgtgtacgcgcgaggaatttaccaggaaagtccgatccaacgcggccctgggcgcaatcttcactgacgagaataagtggaaatctgctcgggaagccgtggaggatagcagattttgggaactcattgacagggagcgcaaccttcacctggagggcaagtgcgaaacatgtgtatacaatatgatggggaagcgtgagaaaaagttaggagaattcggtaaagcaaagggcagtcgggccatctggtatatgtggctgggggctagatttttggagttcgaagccctcggatttctgaacgaggatcattggttctccaggggcaatagcctatctggtgtggagggggaaggacttcaccgcctgggctacattctccgagacgtttcaaaaaaggagggcggggcgatgtacgcagatgacaccgccggatgggacactcggatcacactggaagatttgaagaacgaggaaatggtcaccaatcatatgaaaggtgagcacaagaaactggctgaggccatttttaagctcacatatcagaacaaagtggtgagagtccagaggccaactcctcgcggcaccgttatggacataatcagtagacgggatcagagggggtccggacaagtgggcacgtacggtcttaataccttcacaaacatggaagcacagctgattcgtcagatggagggggaaggaatcttcaagagcatccaacatttaactgtaaccgaggagattgctgtgcagaattggctggcccgagtcggccgcgaaagattgtctcggatggctatatcgggcgacgattgcgtggttaagcccctcgacgataggtttgcctcagcactgacagcgctaaacgacatggggaaagtgcgcaaggatatccagcagtgggagccaagcagaggatggaatgactggactcaagtccccttctgctcccaccactttcatgaacttgtgatgaaagatggtcgggtactggttgtgccttgtaggaaccaggacgagctcattggccgagcccgtatcagtcagggggctggatggtctctgaaggaaaccgcctgcttgggcaaaagctatgcacagatgtggacgttaatgtacttccacagacgcgatctgcggctcgctgccaacgcaatttgttccgccgtcccatcacattgggtgccgacaagtaggaccacttggtctatccacgcgaagcacgagtggatgacaaccgaggacatgcttgctgtgtggaatagagtctggatacaagaaaacccctggatggaggacaagactcctgttgaaagctgggaggaagtgccatatctgggtaaacgcgaggatcagtggtgcgggtccctaatcggactgacctcacgggccacatgggcaaagaatattcagacggccatcaaccaggtaaggagcctcattggcaatgaggaatacaccgactatatgccctctatgaaacgatttagaaaggaggaagaggaagctggcgtgttgtggtga

SEQ ID NO: 14733 - RNA, 9876 nt, synthetic construct
  misc_feature 1..9876: note = derived and/or modified CDS sequence (opt3) from DENV-2__EU482745__SS-prME
  source 1..9876: mol_type = other RNA
accgcaggagtgatcattatgctgatacccacagctatggcattccacctcactacgagaaacggggaacctcatatgatcgtaggaaggcaggaaaagggtaaaagccttctgtttaagaccgaagacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtgaccgaaaaggactcccctgtcaacatcgaggccgaacccccatttggagatagctacatcattataggcgtggagcctgggcagctgaaactaaattggttcaagaagggatcgtctatcggtcagatgtttgagacaactatgcgaggcgctaaacgcatggccattctcggggacaccgcatgggatttcggatccctgggcggtgtttttacatcaatcgggaaggcccttcaccaagtgttcggcgctatttacggagcggcatttagtggcgtaagctggactatgaaaatcttgataggggtcatcattacctggatcggaatgaactccagatctacgagcctgtcagtgagtctcgttctggtgggcgtcgtgacactttatctgggtgccatggtacaggctgactccgggtgtgtggttagctggaagtctaaagaattgaagtgcggatcaggcattttcatcaccgataatgtccacacttggacagagcagtacaagtttcagcccgaaagtccaagcaaactcgcctccgcaatacaaaaggcccatgaggaaggtatttgtggcatcaggtctgtgacccggctggagaacttaatgtggaaacagattactcccgagctgaatcacatcctatcggaaaacgaggtgaagctcaccataatgacaggggacatcaaaggaattatgcaggctggcaagcgcagcctgagacctcagccaacggaacttaaatattcctggaagacctgggggaaggccaaaatgttgtcaactgagagtcataataggacattcctgatcgatggaccggaaaccgcagagtgccccaacacaaatcgtgcgtggaactctctcgaggtcgaagactacggctttggtgttttcactaccaatatttggctgaagttacgggagaaacaagacgtgttttgtgatagcaagctgatgtccgctgccatcaaagacaaccgagcagtgcacgccgatatggggtattggatagaatcagctcttaatgacacgtggaagatggagaaggccagcttcattgaggtaaaatcttgccactggcctaagtcccatacattgtggagtaacggagtcctcgaaagcgagatgatcatccccaaaaatttcgcaggccccgtgtctcagcacaactacagacctggttatcatacccagactgctggcccatggcacctggggaagctagaaatggattttgacttctgtgagggaaccacagttgtggtcactgaagattgcggcaacagggggccctccctgcgcaccacaacggcctcaggaaaactcattaccgagtggtgctgtcggagttgcactctgccgcctcttagatacaggggcgaggacggttgttggtacgggatggaaatccgcccattgaaggagaaggaagagaatctggtgaacagcttagttacagcgggacatggccagattgataatttttcgctcggtgtgctgggcatggcccttttcctggaagagatgttgcgaacccgggtagggactaaacacgctatactcctggtcgcagtgtcctttgtgacactaatcaccggaaacatgtctttccgtgacctgggcagagtcatggttatggtgggggccacgatgactgatgacattggaatgggcgtaacctatctcgctctgcttgccgcatttaaggtgaggcccacattcgcggccggtttgctgttacgcaaactcaccagcaaggagctgatgatggctactatcgggattgcccttctgtcacaaagtacaatccctgaaaccatactagagctcacagatgcactggctttgggaatgatggtcctgaaaatcgtgcggaatatggaaaagtaccagttagccgttactattatggcaatctcctgcgtgcccaacgccgtcattctccagaatgcttggaaggtgtcttgtaccatcctggcggccgttagcgtgtccccacttctgttgacgtcaagccaacagaaagcagactggatacctctcgctctgacaattaagggcctaaaccccaccgccatctttctgactacccttagtagaacatctaaaaagaggtcctggccactcaatgaggccatcatggctgtcggcatggtaagcattctggcatcgtcattgctgaaaaacgacataccgatgactgggcctttagtggccggaggtctcctgaccgtttgctatgtgcttacgggccgatctgcggatctggaattggagcgcgctgccgacgtcaagtgggaggatcaggcagaaatcagtgggtccagccccattctctctatcacaattagcgaggacggatccatgtcaatcaaaaatgaagaggaggaacagaccctgactatactaatccggacaggcctgcttgtgattagtggtgtattcccagtgagcatccccattaccgccgctgcatggtacctctgggaggtcaagaagcaaagagccggggttctgtgggatgtgccttctccaccccctgtgggaaaagcggaattggaggacggcgcttataggatcaagcagcgtggcatattagggtactcccagattggagccggtgtctataaagaaggcacttttcacacaatgtggcatgtgacccgcggggcagttctgatgcaccggggaaagagaatcgagccgtcatgggccgatgtcaaaaaggacctcatcagttacggcggtgggtggaagctggagggagaatggaaagagggcgaagaggtgcaggtccttgctctggaaccaggcaagaaccccagggccgtgcaaacgaaacctgggttgttcaagactaataccggaacaattggtgcagttagcctagatttttccccaggcacctctgggtcgcccatcgtggaccgaaaaggaaaggtcgtgggcctgtacggtaacggggtagtcacacggagcggagcttatgtgtcagccatagcgcagactgagaagtccattgaggataatcctgaaatcgaggacgatattttccgcaaaaagagactcaccatcatggacctgcatccgggcgccggcaaaacgaagaggtaccttcccgcaatagttcgggaagctattaaacgagggttaagaacactgatcctcgccccaactcgcgtggtcgctgcagagatggaagaggccttgaggggactgcctatccgttatcagacccccgccattcgggctgagcacacaggtagagaaatcgtggacctcatgtgtcatgcgaccttcactatgaggctgcttagtccagttcgcgtgcctaactacaacctgattataatggatgaggcacactttaccgaccccgcctctatcgctgcccgaggctatattagcacaagagtcgaaatgggggaggcagccggaatcttcatgacggctactccaccgggctcccgggatccttttccccagtcaaatgcgccaatcatggacgaggaaagggagattcccgaacgctcttggaacagcggtcacgagtgggtgaccgatttcaaggggaagacagtatggtttgtgcctagtataaaagccggaaatgacatcgcagcttgcttgcgtaagaacggcaaaaaggttattcaactatccagaaaaaccttcgatagcgaatacgtcaagactcgggccaatgactgggattttgtggtgacaaccgacatctctgagatgggcgcaaacttcaaggccgagagggtcattgatccacgccgatgtatgaaacccgtaatcctgacggacggggaagagagagtgatactcgctggacctatgccggttactcattcatccgccgcgcagcggaggggtcgcatcggcagaaatccaaagaacgaaaatgaccagtatatttacatgggggagcccttagaaaacgatgaggactgcgcacactggaaagaggccaagatgctgcttgataatatcaacacacctgaaggaattatccccagtatgtttgagccagaaagggagaaagtggacgctatagatggcgaataccggctgcgtggtgaggcccgcaagaccttcgtcgacctcatgcgaagaggggatttgcctgtgtggctggcttatagggttgcagccgagggcattaattacgctgaccggcgctggtgttttgatggaatcaaaaacaatcaaattctcgaagagaacgtggaagtcgagatctggaccaaggagggcgaaagaaagaaactgaagcccaggtggcttgacgcccggatatatagcgatccactagcactgaaagagttcaaggagttcgcggccgggcgaaaatcgttgactttaaacctgatcacagagatgggaagactccctacctttatgacacagaaggctcgcgacgccctggataatcttgcagtgctgcatactgctgaagccggtggcagggcatacaaccacgccctctctgagttgccggagacgctggaaaccctactgctccttacactgttagctactgtaaccgggggaattttcttgtttctgatgtccggcaagggtatcgggaaaatgacactcggcatgtgctgcattatcaccgcgagcatactgctttggtatgcccagattcagccccactggatcgcagcttcaatcattctggagttctttctcatcgtgttgctgataccagaacctgagaagcaacggactccccaggacaatcagttaacgtacgttgtcattgccatcctaaccgtggtggccgcaacaatggctaacgaaatgggattcctggagaaaactaagaaagacctcggccttgggagtattaccacaaaggagtctgaatccaatatcctggatatagacttgcgtccagccagcgcgtggaccctgtatgctgtcgccactacatttgttacgcctatgctcagacattcaatcgagaacagtagcgtgaatgtatccctgaccgcaattgccaaccaggctactgtgcttatgggactcggtaagggctggcccctgtctaaaatggatatcggggtcccgttgctggcaattggatgttacagccaagtgaatccaatcacattaaccgccgcgctactgctccttgttgctcactacgccattatcggccctggtctgcaggcaaaggccaccagggaagctcagaaacgcgccgcagctgggataatgaagaaccccacagtggacggcattactgtcatcgatttggagccaatcccctatgaccctaaattcgaaaagcagctgggacaagtaatgctcctgattctttgcgtgacgcaggttttaatgatgcggaccacatgggccctgtgtgaggcgctcactttggccaccggcccgatatccacactgtgggaggggaatcccggacgattttggaacaccactatcgcagtgtcaatggctaatattttcagaggctcttacctagccggtgcagggctgctctttagtatcatgaagaacacgacaaataccaggcgcggaactggcaacattggtgaaacccttggcgagaaatggaagtcgcggctgaatgctttggggaaaagcgagttccagatctataagaaatccggaatacaggaggtcgatagaacactggccaaggagggcatcaaacgtggggaaactgaccatcacgccgtgtctaggggatcagcgaagctccggtggtttgtcgagcgcaacatggtgaccccagaaggcaaggttgtggatctgggttgcgggcgaggaggctggagctactattgtggtggccttaaaaacgtaagagaggtgaaggggctaacaaaaggaggccctgggcatgaagaaccaattcctatgtccacgtacggatggaatctggtcaggctccaaagtggcgttgacgtgttcttcaccccacccgagaagtgcgatactctactgtgtgacatcggtgaatctagccctaacccaacaattgaggctgggcggaccttgcgcgtcctgaatctcgtggaaaactggcttaataacaatactcagttttgcatcaaagtactgaacccctatatgccgtcagtgatagagaagatggaaacattgcagagaaagtacggaggcgcactggttaggaatcctctctcccgaaacagtacccacgagatgtactgggtgagcaatgccacgggcaacattgtctcttccgtgaatatgatctcacggatgttaatcaaccgtttcaccatgaaacacaagaaagctacatatgagccagatgtcgacctggggagcggaactagaaatattggtatagaatcggagatccccaaccttgacattatcggcaagcgcattgagaaaatcaagcaagagcatgaaacctcttggcactacgatcaggaccatccttataagacatgggcctaccacgggagttatgagactaaacagaccggatccgcaagctcaatggtgaacggcgttgtaaggctgctaacaaagccatgggatgtggtccccatggtgacccagatggccatgactgacacgacaccgtttggtcaacagcgggttttcaaagagaaggtggataccagaactcaggaacctaaagaggggaccaagaagctcatgaaaataacagctgaatggctgtggaaggagttgggcaaaaagaaaacgccccgcatgtgtaccagggaggaatttactcgaaaggtccggtccaatgcggccctgggcgcaatcttcacagacgagaacaaatggaagtctgctagagaagccgtggaggatagcaggttttgggaactcattgaccgcgagcgtaatcttcacctggagggcaagtgcgaaacctgtgtatacaacatgatggggaaacgggagaagaaattaggagagttcggtaaggcaaaaggcagtagagccatctggtatatgtggctgggggctaggtttttggagttcgaagccctcggatttctgaatgaggatcattggttctcccgcggcaacagcctatctggtgtggagggggaaggacttcaccgactgggctacattctccgggacgtttcaaagaaggagggcggggcgatgtacgcagatgacactgccggatgggacacaagaatcaccctggaagatttgaaaaatgaggaaatggtcacaaaccatatgaagggtgagcacaaaaagctggctgaggccatttttaaactcacttatcagaataaggtggtgagggtccaacgcccaacccctagaggcacggttatggacataatcagtcggagggatcagcgtgggtccggacaggtgggcacctacggtcttaacacattcactaatatggaagcacagctgattcgacaaatggagggggaaggaatcttcaagagcatccagcatttaaccgtaacagaggagattgctgtgcagaactggctggcccgcgtcggcagagaacggttgtctaggatggctatatcgggcgacgattgcgtggttaaacccctcgacgatcgctttgcctcagcactgactgcgctaaatgacatggggaaggtgagaaaagatatccaacagtgggagccaagccggggatggaacgactggacccaggtccccttctgctcccaccactttcatgaacttgtgatgaaggatggtagggtactggttgtgccttgtcgaaatcaggacgagctcattggccgtgccagaatcagtcaaggggctggatggtctctgaaagaaacggcctgcttgggcaagagctatgcacagatgtggacattaatgtacttccaccgccgggatctgaggctcgctgccaacgcaatttgttccgccgtcccatcacattgggtgccgaccagtagaactacatggtctatccacgcgaagcacgagtggatgaccactgaggacatgcttgctgtgtggaaccgcgtctggatacaggaaaatccctggatggaggacaaaacccctgttgaaagctgggaggaagtgccatatctgggtaagcgggaggatcagtggtgcgggtccctaatcggactgacatcaagggccacgtgggccaaaaacattcaaaccgccatcaatcaggtaaagagcctcattggcaacgaggaatacactgactatatgccctctatgaaacgatttagacgggaggaagaggaagctggcgtgttgtggtga

SEQ ID NO: 14734 - RNA, 9876 nt, synthetic construct
  misc_feature 1..9876: note = derived and/or modified CDS sequence (opt3) from DENV-2__EU482746__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtgaccgaaaaggactcccctgtcaacatcgaggccgaacccccatttggagatagctacatcattataggcgtggagcctgggcagctgaaactaaattggttcaagaagggatcgtctatcggtcagatgtttgagacaactatgcgaggcgctaaacgcatggccattctcggggacaccgcatgggatttcggatccctgggcggtgtttttacatcaatcgggaaggcccttcaccaagtgttcggcgctatttacggagcggcatttagtggcgtaagctggactatgaaaatcttgataggggtcatcattacctggatcggaatgaactccagatctacgagcctgtcagtgagtctcgttctggtgggcgtcgtgacactttatctgggtgccatggtacaggctgactccgggtgtgtggttagctggaagtctaaagaattgaagtgcggatcaggcattttcatcaccgataatgtccacacttggacagagcagtacaagtttcagcccgaaagtccaagcaaactcgcctccgcaatacaaaaggcccatgaggaaggtatttgtggcatcaggtctgtgacccggctggagaacttaatgtggaaacagattactcccgagctgaatcacatcctatcggaaaacgaggtgaagctcaccataatgacaggggacatcaaaggaattatgcaggctggcaagcgcagcctgagacctcagccaacggaacttaaatattcctggaagacctgggggaaggccaaaatgttgtcaactgagagtcataataggacattcctgatcgatggaccggaaaccgcagagtgccccaacacaaatcgtgcgtggaactctctcgaggtcgaagactacggctttggtgttttcactaccaatatttggctgaagttacgggagaaacaagacgtgttttgtgatagcaagctgatgtccgctgccatcaaagacaaccgagcagtgcacgccgatatggggtattggatagaatcagctcttaatgacacgtggaagatggagaaggccagcttcattgaggtaaaatcttgccactggcctaagtcccatacattgtggagtaacggagtcctcgaaagcgagatgatcatcccaaaaaatttcgcaggccccgtgtctcagcacaactacagacctggttatcatacccagactgctggcccatggcacctggggaagctagaaatggattttgacttctgtgagggaaccacagttgtggtcactgaagattgcggcaacagggggccctccctgcgcaccacaacggcctcaggaaaactcattaccgagtggtgctgtcggagttgcactctgccgcctcttagatacaggggcgaggacggttgttggtacgggatggaaatccgcccattgaaggagaaggaagagaatctggtgaacagcttagttacagcgggacatggccagattgataatttttcgctcggtgtgctgggcatggcccttttcctggaagagatgttgcgaacccgggtagggactaaacacgctatactcctggtcgcagtgtcctttgtgacactaatcaccggaaacatgtctttccgtgacctgggcagagtcatggttatggtgggggccacgatgactgatgacattggaatgggcgtaacctatctcgctctgcttgccgcatttaaggtgaggcccacattcgcggccggtttgctgttacgcaaactcaccagcaaggagctgatgatggctactatcgggattgcccttctgtcacaaagtacaatccctgaaaccatactagagctcacagatgcactggctttgggaatgatggtcctgaaaatcgtgcggaatatggaaaagtaccagttagccgttactattatggcaatctcctgcgtgcccaacgccgtcattctccagaatgcttggaaggtgtcttgtaccatcctggcggccgttagcgtgtccccacttctgttgacgtcaagccaacagaaagcagactggatacctctcgctctgacaattaagggcctaaaccccaccgccatctttctgactacccttagtagaacatctaaaaagaggtcctggccactcaatgaggccatcatggctgtcggcatggtaagcattctggcatcgtcattgctgaaaaacgacataccgatgactgggcctttagtggccggaggtctcctgaccgtttgctatgtgcttacgggccgatctgcggatctggaattggagcgcgctgccgacgtcaagtgggaggatcaggcagaaatcagtgggtccagccccattctctctatcacaattagcgaggacggatccatgtcaatcaaaaatgaagaggaggaacagaccctgactatactaatccggacaggcctgcttgtgattagtggtgtattcccagtgagcatccccattaccgccgctgcatggtacctctgggaggtcaagaagcaaagagccggggttctgtgggatgtgccttctccaccccctgtgggaaaagcggaattggaggacggcgcttataggatcaagcagcgtggcatattagggtactcccagattggagccggtgtctataaagaaggcacttttcacacaatgtggcatgtgacccgcggggcagttctgatgcaccggggaaagagaatcgagccgtcatgggccgatgtaaaaaaggacctcatcagttacggcggtgggtggaagctggagggagaatggaaagagggcgaagaggtgcaggtccttgctctggaaccaggcaagaaccccagggccgtgcaaacgaaacctgggttgttcaagactaataccggaacaattggtgcagttagcctagatttttccccaggcacctctgggtcgcccatcgtggaccgaaaaggaaaggtcgtgggcctgtacggtaacggggtagtcacacggagcggagcttatgtgtcagccatagcgcagactgagaagtccattgaggataatcctgaaatcgaggacgatattttccgcaaaaagagactcaccatcatggacctgcatccgggcgccggcaaaacgaagaggtaccttcccgcaatagttcgggaagctattaaacgagggttaagaacactgatcctcgccccaactcgcgtggtcgctgcagagatggaagaggccttgaggggactgcctatccgttatcagacccccgccattcgggctgagcacacaggtagagaaatcgtggacctcatgtgtcatgcgaccttcactatgaggctgcttagtccagttcgcgtgcctaactacaacctgattataatggatgaggcacactttaccgaccccgcctctatcgctgcccgaggctatattagcacaagagtcgaaatgggggaggcagccggaatcttcatgacggctactccaccgggctcccgggatccttttccccagtcaaatgcgccaatcatggacgaggaaagggagattcccgaacgctcttggaacagcggtcacgagtgggtgaccgatttcaaggggaagacagtatggtttgtgcctagtataaaagccggaaatgacatcgcagcttgcttgcgtaagaacggcaaaaaggttattcaactatccagaaaaaccttcgatagcgaatacgtcaagactcgggccaatgactgggattttgtggtgacaaccgacatctctgagatgggcgcaaacttcaaggccgagagggtcattgatccacgccgatgtatgaaacccgtaatcctgacggacggggaagagagagtgatactcgctggacctatgccggttactcattcatccgccgcgcagcggaggggtcgcatcggcagaaatccaaagaacgaaaatgaccagtatatttacatgggggagcccttagaaaacgatgaggactgcgcacactggaaagaggccaagatgctgcttgataatatcaacacacctgaaggaattatccccagtatgtttgagccagaaagggagaaagtggacgctatagatggcgaataccggctgcgtggtgaggcccgcaagaccttcgtcgacctcatgcgaagaggggatttgcctgtgtggctggcttatagggttgcagccgagggcattaattacgctgaccggcgctggtgttttgatggaatcaaaaacaatcaaattctcgaagagaacgtggaagtcgagatctggaccaaggagggcgaaagaaagaaactgaagcccaggtggcttgacgcccggatatatagcgatccactagcactgaaagagttcaaggaattcgcggccgggcgaaaatcgttgactttaaacctgatcacagagatgggaagactccctacctttatgacacagaaggctcgcgacgccctggataatcttgcagtgctgcatactgctgaagccggtggcagggcatacaaccacgccctctctgagttgccggagacgctggaaaccctactgctccttacactgttagctactgtaaccgggggaattttcttgtttctgatgtccggcaagggtatcgggaaaatgacactcggcatgtgctgcattatcaccgcgagcatactgctttggtatgcccagattcagccccactggatcgcagcttcaatcattctggagttctttctcatcgtgttgctgataccagaacctgagaagcaacggactccccaggacaatcagttaacgtacgttgtcattgccatcctaaccgtggtggccgcaacaatggctaacgaaatgggattcctggagaaaactaagaaagacctcggccttgggagtattaccacacaggagtctgaatccaatatcctggatatagacttgcgtccagccagcgcgtggaccctgtatgctgtcgccactacatttgttacgcctatgctcagacattcaatcgagaacagtagcgtgaatgtatccctgaccgcaattgccaaccaagctactgtgcttatgggactcggtaagggctggcccctgtctaagatggatatcggggtcccgttgctggcaattggatgttacagccaggtgaatccaatcacattaaccgccgcgctactgctccttgttgctcactacgccattatcggccctggtctgcaggcaaaagccaccagggaagctcagaagcgcgccgcagctgggataatgaaaaaccccacagtggacggcattactgtcatcgatttggagccaatcccctatgaccctaagttcgaaaaacaactgggacaggtaatgctcctgattctttgcgtgacgcaggttttaatgatgcggaccacatgggccctgtgtgaggcgctcactttggccaccggcccgatatccacactgtgggaggggaatcccggacgattttggaacaccactatcgcagtgtcaatggctaatattttcagaggctcttacctagccggtgcagggctgctctttagtatcatgaagaacacgacaaataccaggcgcggaactggcaacattggtgaaacccttggcgagaagtggaaatcgcggctgaatgctttggggaagagcgaattccagatctataaaaagtccggaatacaagaggtcgatagaacactggccaaagagggcatcaagcgtggggaaactgaccatcacgccgtgtctaggggatcagcgaaactccggtggtttgtcgagcgcaacatggtgaccccagaaggcaaggttgtggatctgggttgcgggcgaggaggctggagctactattgtggtggcttaaagaacgtaagagaggtgaaagggcttacaaagggaggccctgggcatgaagagcccattcctatgtccacgtacggatggaatctggtcaggctccagagtggcgttgacgtgttcttcaccccacccgagaaatgcgatactctactgtgtgacatcggtgaatctagccctaacccaacaattgaggctgggcggaccttgcgcgtcctgaatctcgtggaaaactggcttaataacaatactcagttttgcatcaaggtactgaacccctatatgccgtcagtgatagagaaaatggaaacattgcaaagaaagtacggaggcgcactggttaggaatcctctctcccgaaacagtacccacgagatgtactgggtgagcaatgccacgggcaacattgtctcttccgtgaatatgatctcacggatgttaatcaaccgtttcaccatgaagcacaaaaaggctacatatgagccagatgtcgacctggggagcggaactagaaatattggtatagaatcggagatccccaaccttgacattatcggcaaacgcattgaaaagatcaaacaggagcatgaaacctcttggcactacgatcaggaccatccttataagacatgggcctaccacgggagttatgagactaagcagaccggatccgcaagctcaatggtgaacggcgttgtaaggctgctaacaaaaccatgggatgtggtccccatggtgacccaaatggccatgactgacacgacaccgtttggtcagcagcgggttttcaaggagaaagtggataccagaactcaggaacctaaggaggggaccaaaaagctcatgaagataacagctgaatggctgtggaaagagttgggaaagaaaaagacgccccgcatgtgtaccagggaggaatttactcgaaaagtccggtccaatgcggccctgggcgcaatcttcacagacgagaacaagtggaaatctgctagagaagccgtggaggatagcaggttttgggaactcattgaccgcgagcgtaatcttcacctggagggcaagtgcgaaacctgtgtatacaacatgatggggaagcgggagaaaaagttaggagaattcggtaaagcaaagggcagtagagccatctggtatatgtggctgggggctaggtttttggagttcgaagccctcggatttctgaatgaggatcattggttctcccgcggcaacagcctatctggtgtggagggggaaggacttcaccgactgggctacattctccgggacgtttcaaaaaaggagggcggggcgatgtacgcagatgacactgccggatgggacacaagaatcaccctggaagatttgaagaatgaggaaatggtcacaaaccatatgaaaggtgagcacaagaaactggctgaggccatttttaagctcacttatcaaaataaagtggtgagggtccagcgcccaacccctagaggcacggttatggacataatcagtcggagggatcagcgtgggtccggacaggtgggcacctacggtcttaacacattcactaatatggaagcacaactgattcgacagatggagggggaaggaatcttcaagagcatccagcatttaaccgtaacagaggagattgctgtgcaaaactggctggcccgcgtcggcagagaacggttgtctaggatggctatatcgggcgacgattgcgtggttaagcccctcgacgatcgctttgcctcagcactgactgcgctaaatgacatggggaaagtgagaaaggatatccagcagtgggagccaagccggggatggaacgactggacccaggtccccttctgctcccaccactttcatgaacttgtgatgaaagatggtagggtactggttgtgccttgtcgaaatcaagacgagctcattggccgtgccagaatcagtcagggggctggatggtctctgaaggaaacggcctgcttgggcaaaagctatgcacagatgtggacattaatgtacttccaccgccgggatctgaggctcgctgccaacgcaatttgttccgccgtcccatcacattgggtgccgaccagtagaactacatggtctatccacgcgaagcacgagtggatgaccactgaggacatgcttgctgtgtggaaccgcgtctggatacaggaaaatccctggatggaggacaagacccctgttgaaagctgggaggaagtgccatatctgggtaaacgggaggatcaatggtgcgggtccctaatcggactgacatcaagggccacgtgggcaaagaacattcagaccgccatcaatcaggtacgaagcctcattggcaacgaggaatacactgactatatgccctctatgaaaagatttcggagggaggaagaggaagctggcgtgttgtggtga

SEQ ID NO: 14735 - RNA, 9876 nt, synthetic construct
  misc_feature 1..9876: note = derived and/or modified CDS sequence (opt3) from DENV-2__EU482590__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttgtgtgcaagcattctatggtcgatagaggctggggtaacgggtgtggactattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtgaccgaaaaggactcccctgtcaacatcgaggccgaacccccatttggagatagctacatcattataggcgtggagcctgggcagctgaaactaaattggttcaagaagggatcgtctatcggtcagatgtttgagacaactatgcgaggcgctaaacgcatggccgttctcggggacaccgcatgggatttcggatccctgggcggtgtgtttacatcaattgggaaggcccttcaccaagtattcggcgctatctacggagcggcatttagtggcgtcagctggactatgaaaattttgatcggggtgataatcacctggattggaatgaactccagatctacgagcctgtcagttagtctcgtgctggtcggcgtggtaacactttatctgggtgccatggtgcaggctgactccgggtgtgttgtcagctggaagaataaagaattgaagtgcggatctggcatcttcattaccgataacgtgcacacttggacagagcagtacaagtttcagcccgaatcaccaagtaaactcgccagcgcaatccaaaaggcccatgaggaaggtatatgtggcattaggtccgtgacccggctggagaatttaatgtggaaacagatcactcccgagctgaaccacattctatctgaaaatgaggtcaagctcaccatcatgacaggggacataaaaggaatcatgcaggctggcaagcgctcgctgagacctcagccaacggaacttaaatatagctggaagacctgggggaaggccaaaatgttgtccactgagccgcataaccaaacattcctgattgatggacccgaaaccgcagagtgccctaatacaaacagggcgtggaattcactcgaggttgaagactacggctttggtgtgttcactaccaacatctggctgaagttacgtgagaaacaggacgtgttttgtgatagtaagctgatgtctgctgccattaaagacaatcgggcagtacacgccgatatggggtattggatcgaaagcgctcttaacgacacgtggaagatggagaaggcctccttcatagaggtcaaatcatgccactggccaaagagccatacattgtggtctaatggagtgctcgaatccgagatgattatccccaaaaacttcgcaggccctgttagtcagcacaactaccgaccaggttatcatacccagactgctggcccctggcacctggggaagctagaaatggattttgacttctgtgagggaaccacagtggtcgtgactgaagattgcggcaatagagggccgagcctgaggaccacaacggcctctggaaaactcatcaccgagtggtgctgtcgctcctgcactctgcctccacttcggtacagaggcgaggacggttgttggtacgggatggaaattaggcccttgaaggagaaggaagagaacctggttaattcattagtgacagcgggacatggccaaatcgataactttagtctcggtgtactgggcatggcccttttcctggaagagatgttgcgcacccgagtcgggactaaacacgctattctcctggtggcagtgagctttgtcacactaataaccggaaatatgtcgttccgggacctgggccgtgttatggtgatggtaggggccacgatgactgatgacatcggaatgggcgtgacctatctcgctctgcttgccgcatttaaggtcagacctacattcgcggccggtttgctgttaaggaaactcacctccaaggagctgatgatggctactattgggatcgcccttctgtctcagagcacaattcccgaaaccatcctagagctcacagatgcactggctttgggaatgatggtgctgaaaatagttcgcaacatggaaaagtaccagttagccgtgactatcatggcaatttcatgcgtcccaaatgccgtgatcctccaaaacgcttggaaggttagttgtaccattctggcggccgtgtccgtctctcctcttctgttgacgagctcccagcagaaagcagactggatccccctcgctctgacaataaagggcctaaatccaaccgccatttttctgactaccctttcacggacaagcaaaaagagaagttggccgctcaacgaggccatcatggctgtaggcatggtgtctatcctggcatccagcttgctgaaaaatgacattcctatgactgggcccttagttgccggaggtctcctgaccgtgtgctatgtccttacgggcaggtcggcggatctggaattggagcgagctgccgacgtgaagtgggaggatcaggcagaaatatcagggtctagtccaatcctctccattacaatcagcgaggacggatctatgagcattaaaaacgaagaggaggaacaaaccctgactatcctaatacgcacaggcctgcttgtaatctccggtgtgttccccgtctcaattcctatcaccgccgctgcatggtacctctgggaggttaagaagcagcgggccggggtgctgtgggatgtgccaagtccccctccggtcggaaaagcggaattggaggacggcgcttatagaattaagcagaggggcatcttagggtacagccagataggagccggtgtgtataaagaaggcacttttcacacaatgtggcatgttacccgtggggcagtactgatgcaccgcggaaagcggattgagccatcttgggccgatgtgaaaaaggacctcatctcctacggcggtgggtggaagctggagggagaatggaaagagggcgaagaggtccaagtgcttgctctggaacccggcaagaatcctagagccgttcagacgaaaccagggttgttcaagactaacaccggaacaatcggtgcagtgtcactagattttagtcccggcaccagcgggtcccctattgtcgacaggaaaggaaaggtggtaggcctgtacggtaatggggtcgtgacacgatctggagcttatgtttcggccatcgcgcagactgagaagagcatagaggataacccggaaattgaggacgatatcttccggaaaaagcgcctcaccattatggacctgcatcccggcgccggcaaaacgaagagataccttccagcaatcgtgagggaagctataaaacgggggttacgaacactgattctcgcccctactagagtcgtggctgcagagatggaagaggccttgcgcggactgcccatcaggtatcagaccccagccatccgtgctgagcacacaggtcgggaaattgttgacctcatgtgtcatgcgaccttcactatgagactgctttcacctgtgagggtccccaactacaatctgatcattatggatgaggcacactttaccgacccagcctccatagctgcccgcggctatatcagtacacgagtggaaatgggggaggcagccggaattttcatgacggctactccgcctggctctagagatccctttccacaaagcaacgcgcccatcttggacgaggaacgggagatccctgaaaggtcctggaattcaggtcacgagtgggtaaccgatttcaaggggaagacagtgtggtttgttccatctattaaagccggaaacgacatagcagcttgcctacgcaagaatggcaaaaaggtcatccagctgagccgtaaaaccttcgatagtgaatacgtgaagactagagccaacgactgggattttgtggtcacaaccgacatttccgagatgggcgcaaatttcaaggccgagcgggtaatcgatcccaggcgctgtatgaaacctgtgattctcacggacggggaagagcgagttatcttagctggaccgatgccagtgactcatagctctgccgcgcagagacggggtaggataggccgcaaccccaagaatgaaaacgaccaatatatctacatgggggagcctctggaaaatgatgaggactgcgcacactggaaagaggccaagatgcttctggataacattaatacacccgaaggaatcattccatcaatgtttgagcctgaaagagagaaagtcgacgctatcgatggcgaatacaggctccggggtgaggcccgtaagaccttcgtggacttgatgcgccgaggggatctgcccgtttggctcgcttatagagtggcagccgagggcataaactacgctgacaggcggtggtgttttgatggaattaaaaataaccagatcctggaagagaacgtcgaagtggagatttggaccaaggagggcgaacgcaagaaacttaagccaagatggctagacgccaggatctattccgatcctctggcattgaaagagttcaaggaattcgcggccgggcggaaaagtttaactctgaatctcataacagagatgggacgactgccgacctttatgacacagaaggctagagacgcccttgataacctggcagtactccatactgctgaagtgggtggccgcgcctacaatcacgcattgagcgagctgcccgagacgctagaaaccctgctccttctgacattattggccactgttaccgggggaatcttcctgtttctcatgtcgggcaagggtattgggaaaatgacactgggcatgtgctgcatcattaccgcttctatccttctgtggtatgcgcagatacaaccacactggattgccgcatccatcatcctcgagttctttttgattgtcctgttaatccctgaacccgagaagcagaggactccacaggacaaccagctaacgtacgtggtgatagctattctgaccgtcgttgccgccacaatggcaaatgaaatgggattcctcgagaaaactaagaaagaccttggcctggggagcatcaccacacaagagtcagaaagtaacattttggatatcgacctgcggcctgcttctgcctggaccctctatgcggtggctactacatttgtaacgcccatgctgcgtcattccatagagaatagctcagtgaacatcagtcttaccgccattgcaaatcaggccactgtcctcatgggactgggtaagggctggccgttgagcaagatggatatcggggtgccactgttagctattggatgttactcccaggttaaccctatcacactaaccgcagccctgctccttctggtggcgcactacgctattatcggccccggtttgcaggccaaagcaaccagagaagcccaaaagagggctgccgcagggataatgaaaaatccaacagtcgacggcattactgtaatcgatctggagcccatcccttatgacccgaagttcgaaaaacagctcggacaggtgatgctgcttattttatgcgttacgcaggtgctgatgatgcgcaccacatgggctctctgtgaggccttgactctggcgaccggccccatatctacactatgggaggggaacccaggacggttttggaataccactatcgccgtcagcatggcaaacattttccgaggctcctacctggctggtgccgggctccttttttcaatcatgaagaatacgacaaacaccagaaggggaactggcaatattggtgaaaccctgggcgagaagtggaaatctcgcttgaacgcactggggaagagtgaattccaaatctataaaaagtcgggaatacaggaggtggatcggacactcgctaaagagggcatcaagagaggggaaactgaccatcacgccgtcagccgtggatccgccaaactgaggtggtttgtggagcggaacatggttacccctgaaggcaaggtggtagatttaggttgcgggcgcggaggctggtcttactattgtggtggccttaagaatgtgcgagaggtcaaagggctgacaaagggaggccccgggcatgaagagcctattccaatgtcaacgtacggatggaacctcgttagactacagagcggcgtggacgtcttcttcaccccccctgagaaatgcgatactctgttgtgtgacatcggtgaatccagtccaaatcccacaattgaggcggggaggaccctgcgggtgctcaaccttgtagaaaattggctgaacaataacactcaattttgcatcaaggtgttgaatccgtatatgccttctgttatagagaaaatggaaacactgcagcgcaagtacggaggcgctctcgtgagaaacccattaagcaggaattcaacccacgagatgtactgggtctccaacgcaacgggcaatattgtgagtagcgtcaacatgatctctcgaatgctgatcaatcggttcaccatgaagcacaaaaaggccacatatgagcccgatgtggaccttgggtccggaactcgtaacattggtatagaatcagagatccctaacctggacattatcggcaaaagaattgaaaagatcaaacaggagcatgaaaccagctggcactacgatcaggaccatccatataagacatgggcttaccacgggtcgtatgagactaagcaaaccggatctgccagttccatggttaatggcgtagtgcgcctactcacaaaaccctgggatgtcgtgccgatggttacccagatggcaatgactgacacgacaccttttggtcagcagagggtgttcaaggagaaagtcgatacccggactcaagaacccaaggaggggaccaaaaagctgatgaagataacagccgaatggttgtggaaagagctgggaaagaaaaagacgccaagaatgtgtacccgcgaggaatttactaggaaagtgcgaagcaacgctgcgctcggcgccatcttcacagacgagaataagtggaaatcagcacgggaagctgtagaggattccagattttgggaacttattgacagggagcgcaacctgcacttagagggcaagtgcgaaacctgtgtgtacaatatgatggggaagcgtgagaaaaagctgggagaattcggtaaagccaagggctctcgggcaatctggtatatgtggttgggggccagatttctcgagttcgaagctctgggatttctaaacgaggatcattggttcagcaggggcaatagtctttccggtgttgagggggaaggactgcaccgcctcggctacattctgcgagacgtcagcaaaaaggagggcggggccatgtacgcggatgacactgcaggatgggacacacggatcaccttggaagatctgaagaacgaggaaatggtgacaaatcatatgaaaggtgagcacaagaaactcgccgaggctatttttaagcttacttatcagaacaaagtggtcagagttcagaggcctaccccccgcggcacggtgatggacataatctctagacgggatcagagggggtcaggacaagtaggcacctacggtctgaatacattcactaacatggaagcccagttaattcgtcagatggagggggaaggaatcttcaagagtatccaacatctgaccgtgacagaggagattgcagtccagaattggttggctcgagtgggccgcgaaagactctcccggatggccataagcggcgacgattgcgttgtgaagccactggacgataggtttgcttctgccctaactgcacttaacgacatggggaaagtccgcaaggatatccagcagtgggagccctcgagaggatggaatgactggacccaagtgcctttctgctcacaccactttcatgaactggtaatgaaagatggtcgggttctcgtggtcccatgtaggaaccaggacgagctgattggccgagcgcgtatcagccagggggccggatggtccttgaaggaaacggcttgcttaggcaaaagttatgcccagatgtggacactgatgtacttccacagacgcgatctccggcttgcagctaacgccatttgttctgcagtgccgagccattgggtgcccacctccaggactacatggtcaatccacgccaagcacgagtggatgaccactgaggacatgctggcggtctggaatagagtttggatacaagaaaacccttggatggaggacaagaccccagtggaaagttgggaggaagtaccctatctaggtaaacgcgaggatcagtggtgcgggtctctgatcggactcacaagccgggctacgtgggccaagaatattcagaccgcaatcaaccaggtgaggtccttgattggcaatgaggaatacactgactatatgccttcaatgaaacgatttagacgggaggaagaggaagccggcgtcctgtggtga

SEQ ID NO: 14736 - RNA, 9876 nt, synthetic construct
  misc_feature 1..9876: note = derived and/or modified CDS sequence (opt3) from DENV-2__EU482594__SS-prME
  source 1..9876: mol_type = other RNA
accgccggcgtgatcattatgctgatacccaccgctatggcattccacctcactacgcggaacggggaacctcatatgatcgtcggaaggcaggaaaagggtaaaagccttctgtttaagaccgaggacggcgttaatatgtgcacattgatggccattgatttaggggaactgtgtgaggacactatcacctacaaatgcccattactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaagacaaacgatttgtgtgcaagcattctatggtcgatagaggctggggtaacgggtgtggattattcggcaagggcgggatcgtgacctgcgccatgtttacatgcaaaaagaatatggaaggaaaagtggtcctccctgagaacctggaatacaccattgttataactccacacagcggtgaggagcatgctgtgggcaatgacacggggaagcacggaaaagaaatcaagattacaccgcagtcctcaatcaccgaggccgaacttactggctatggtaccgtaacaatggagtgtagtcccaggaccgggctggatttcaacgaaatggtgttgctccagatggaggacaaagcatggctggtccaccggcaatggtttttagatctgcctctcccatggcttcccggcgctgacactcagggaagcaattggatacagaaggagacactggtgacgttcaagaaccctcatgccaaaaagcaggacgttgtggtcttgggctctcaagaaggggcgatgcacaccgccctaactggagcaacagagattcagatgtcctcaggtaatctgctctttaccggccatctgaaatgccgtcttcgcatggataagctgcagttgaaagggatgagctacagtatgtgtacaggaaagttcaagatcgtgaaagaaatcgctgagactcaacacggcaccattgtaatcagagttcagtatgagggtgacgggtctccatgcaagattcccttcgaaataatggatctcgagaaaaggcatgtgctgggccggttaatcacggtcaacccgattgtggccgaaaaggactcccctgtcaacatcgaggctgaacccccatttggagatagctacatcattataggcgtggagcctgggcagctgaaactaaattggttcaagaagggatcgtctatcggtcagatgtttgagaccacaatgcgaggcgccaaacgcatggcaattctcggggacactgcctgggatttcggatccctgggcggtgtttttacctcaatcgggaaggcacttcaccaagtgttcggcgcgatttacggagcagcctttagtggcgtaagctggacaatgaaaatcttgataggggtcatcattacttggatcggaatgaactccagatctaccagcctgtcagtgagtctcgttctggtgggcgtcgtgacgctttatctgggtgctatggtacaggccgactccgggtgtgtggttagctggaagtctaaagaattgaagtgcggatcaggcattttcatcacagataatgtccacacctggactgagcagtacaagtttcagcccgaaagtccaagcaaactcgcatccgccatacaaaaggctcatgaggaaggtatttgtggcatcaggtctgtgacacggctggagaacttaatgtggaaacagattacccccgagctgaatcacatcctatcggaaaacgaggtgaagctcactataatgaccggggacatcaaaggaattatgcaggccggcaagcgcagcctgagacctcagccaacagaacttaaatattcctggaagacgtgggggaaggcaaaaatgttgtcaaccgagagtcataatcaaactttcctgatcgatggaccggaaacagcggagtgccccaacaccaatagggcttggaactctctcgaggtcgaagactacggctttggtgttttcacaactaatatttggctgaagttacgtgagaaacaggacgtgttttgtgatagcaagctgatgtccgccgcaatcaaagacaaccgggccgtgcacgctgatatggggtattggatagaatcagcccttaatgacacctggaagatggagaaggccagcttcattgaggtaaaatcttgccactggcctaagtcccatacgttgtggagtaacggagtcctcgaaagcgagatgatcatccccaaaaatttcgctggccccgtgtctcagcacaactaccgacctggttatcatacacagaccgccggcccatggcacctggggaagctagaaatggattttgacttctgtgagggaactaccgttgtggtcacagaagattgcggcaacagagggccctccctgaggactaccacagcgtcaggaaaactcattacggagtggtgctgtcgcagttgcaccctgccgcctcttcggtacagaggcgaggacggttgttggtacgggatggaaatcaggccattgaaggagaaggaagagaatctggtgaacagcttagttactgccggacatggccaaattgataatttttcgctcggtgtgctgggcatggctcttttcctggaagagatgttgcgcacacgagtagggaccaaacacgcaatactcctggtcgccgtgtcctttgtgactctaatcacaggaaacatgtctttccgggacctgggccgtgtcatggttatggtgggggctaccatgacggatgacattggaatgggcatcacttatctcgccctgcttgcagcgtttaaggtaagacccaccttcgccgctggtttgctgctcaaaaagctaacaagcaaagagctgatgatggccaccattgggatcgcacttctgtcacagagtactatacctgaaacaatcctagagctcaccgatgctctggccttgggaatgatggtgctgaagattgtcaggaatatggaaaagtaccagttagcagtgacaatcatggccatttcctgcgttcccaacgctgtgatcctccaaaatgcgtggaaagtctcttgtactatactggccgcagtgagcgtttccccacttctgttgacctcaagccagcagaaggctgactggattcctctcgccctgacgatcaaaggcctaaaccccacagccatctttctgaccactcttagtcgcacctctaagaaacggtcctggccactcaatgaggctattatggcagtgggcatggtcagcatactggcctcgtcattgctgaagaacgacatcccgatgacagggcctttagtagcgggaggtctcctgactgtgtgctatgttcttaccggcagatctgctgatctggaattggagagggccgcagacgtgaaatgggaggatcaggccgaaattagtgggtccagccccatcctctctattacgatcagcgaggacggatccatgtcaataaagaatgaagaggaggaacaaacactgaccatcctaattcgaactggcctgcttgtcatcagtggtgtgttcccagtaagcattcccatcacagctgcagcctggtacctctgggaggtgaagaaacagcgcgcgggggtcctgtgggatgttccttctccaccccctgtgggaaaggctgaattggaggacggcgcctatcggataaaacagagaggcattttagggtactcccagatcggagctggtgtgtataaggaaggcacctttcacactatgtggcatgtcacaagaggggcagtgctgatgcaccgtggaaaacgcatcgagccgtcatgggctgatgttaagaaggacctcattagttacggcggtgggtggaaactggagggagaatggaaggagggcgaagaggtacaagtgcttgccctggaaccaggcaaaaacccccgggcagtccagaccaagcctgggttgttcaaaacgaatactggaaccatcggtgctgtgagcctagatttttccccaggcacatctgggtcgcccatagttgacagaaagggaaaggtggtcggcctgtacggtaacggggtggtaaccaggagcggagcctatgtctcagcgattgcccagacagagaaatccatcgaggataatcctgaaattgaggacgatatcttccgaaagaaacggctcactataatggacctgcatccgggcgcaggcaagaccaaacgctaccttcccgctattgtgagagaagccatcaagagggggttacggacgctgatcctcgctccaacacgagttgtggcagccgagatggaagaggccttgagaggactgcctattcgctatcagactcccgctatcagggcggagcacaccggtcgtgaaattgtcgacctcatgtgtcatgcaacattcaccatgcggctgcttagtccagtgagagttcctaactacaacctgataatcatggatgaggcccactttactgaccccgcttctattgccgcaaggggctatatcagcacccgcgtggaaatgggggaggccgctggaatcttcatgacagcgacgccaccgggctcccgagatccttttccccaatcaaatgccccaattatggacgaggaaagagagatacccgaacggtcttggaacagcggtcacgagtgggtcactgatttcaaggggaaaaccgtgtggtttgtacctagtatcaaggcaggaaatgacattgctgcctgcttgaggaaaaacggcaagaaagtgatccagctatcccgcaagacattcgatagcgaatacgttaagacccgtgcaaatgactgggattttgtcgtgactacagacatttctgagatgggcgccaacttcaaagctgagagagtgatcgatccacggaggtgtatgaagcccgtcatactgaccgaaggggaggaacgcgtaatcctcgccggacctatgccggtgacgcattcatccgcggcacagcgaagaggtcggattggcaggaatcccaaaaacgagaatgaccaatatatctacatgggggaaccattagagaacgacgaggattgcgcccactggaaggaagctaaaatgctgcttgacaatattaacactcctgagggaatcatacccagtatgtttgaaccagagcgcgaaaaggttgatgccattgacggcgagtacagactgaggggtgaggctcggaaaacattcgtggatctcatgcgtcgcggggacttgcctgtctggctggcatatcgagtggccgctgaaggcatcaattacgccgatagaaggtggtgttttgacggaattaagaacaatcagatcctcgaggaaaacgttgaggtggagatatggaccaaggaaggcgagcggaaaaagctgaaaccccgctggcttgatgcaagaatctatagcgacccactagcgctgaaggagttcaaagagttcgccgctgggaggaagtcgttgaccttaaacctgattactgaaatgggacggctccctacatttatgacccagaaggcccgagatgcactggacaatcttgctgtcctgcatacagccgaggcaggaggtagagcctacaaccacgctctctctgagttgccggaaactctggagacgctactgctccttaccctgttagcgacagtgactgggggaatcttcttgtttctgatgtccggcaaaggtattgggaagatgaccctcggcatgtgctgcatcataacagccagcattctgctttggtatgcacagatccaaccccactggatcgctgcctcaattatcctggagttctttctcatagtattgctgattccagagcctgaaaaacagcgcacaccacaggataatcagttaacttacgtggttatcgccattctaacggtcgtggcagctaccatggccaacgagatgggattcctggagaagaccaaaaaggacctcggccttgggagtatcgcgactcaagaatctgagtccaatatactggacatcgatttgaggccagctagcgcctggaccctgtatgcagtggccacaacctttgtcactcctatgctccggcattcaattgaaaacagtagcgttaatgtgtccctgacagctatcgcaaaccaggccacggtacttatgggactcggtaagggctggcccctgtctaaaatggacattggggtgccgttgctggcgatcggatgttacagccaggtcaatccaattaccttaactgctgccctactgctccttgtggcacactacgccatcataggccctggtctgcaggctaaggccacacgtgaggcacagaaaagggctgccgcggggattatgaagaaccccaccgttgatggcatcaccgtgatcgacttggaaccaattccctatgatcctaaattcgagaagcagctgggacaggtcatgctcctgatactttgcgtaacacaggtgttaatgatgaggactacgtgggccctgtgtgaggcactcaccttggctacaggcccgatctccactctgtgggaagggaatcccggacgcttttggaacaccacaattgccgtttcaatggcaaatatcttccggggctcttacctagctggtgccgggctgctctttagtattatgaagaacaccactaatacgcgaagaggaacaggcaacatcggtgagacccttggcgaaaaatggaagtcgaggctgaatgccttggggaaaagcgagttccaaatatataagaaatccggaatccaggaggtggaccgcactctggcgaaggaaggcattaaaagaggggaaaccgatcatcacgctgtctctagaggatcagcaaagctccgttggtttgtggaaaggaacatggtcacaccagagggcaaggtggttgacctgggttgcgggcggggaggctggagctactattgtggtggccttaaaaacgtgcgcgaagtaaaggggctaactaaaggaggccctgggcatgaggagcccatccctatgtccacctacggatggaatctggtgcgactccagagtggcgtcgatgttttcttcacaccacccgaaaagtgcgacacgctactgtgtgatattggtgagtctagccctaacccaaccatcgaagccgggagaactttgagggtgctgaatctcgtcgagaactggcttaataacaatacacaattttgcataaaagtgctgaacccctatatgccgtcagtaattgaaaagatggagaccttgcagcggaagtacggaggcgctctggtgcgcaatcctctctccagaaacagtactcacgagatgtactgggttagcaatgccacaggcaacatcgtgtcttccgtcaatatgatctcaaggatgttaattaaccgattcaccatgaaacacaagaaagcaacgtatgaaccagacgtggatctggggagcggaacccggaatataggtatcgagtcggaaattcccaaccttgacatcattggcaagcgtatcgagaaaataaagcaggaacatgagacatcttggcactacgaccaggatcatccttataagacttgggcctaccacgggagttatgagaccaaacaaacaggatccgctagctcaatggtcaacggcgtggttagactgctaactaagccatgggacgtagtgcccatggtcacccagatggcgatgacagataccactccgtttggtcagcagcgcgtgttcaaagaaaaggttgacacgaggacacaagagcctaaagaagggaccaagaagctcatgaaaatcactgccgagtggctgtggaaggagttgggcaaaaagaaaacaccccggatgtgtacaagagaagagtttacgcgcaaggtgaggtccaatgcagctctgggcgccattttcaccgatgaaaacaaatggaagtctgcacgagaggccgtcgaagacagccggttttgggagctcatcgatagagagaggaatcttcacctggaaggcaagtgcgagacttgtgtgtacaacatgatggggaaacgcgaaaagaaattaggagagttcggtaaggctaaaggcagtcgtgccatttggtatatgtggctgggggcgcggtttttggagttcgaggcactcggatttctgaatgaggaccattggttctccagaggcaacagcctatctggtgtagaaggggagggacttcacaggctgggctacatcctccgcgatgtgtcaaagaaggaaggcggggccatgtacgctgacgatacagccggatgggacacccgaattactctggaggacttgaaaaatgaagagatggttacaaaccatatgaagggtgagcacaaaaagctggcagaagctatatttaaactcacctatcagaataaggtcgtgcgggtgcagagaccaacacctaggggcactgtcatggatatcattagtcgcagagaccagcgggggtccggacaagttggcacctacggtcttaacacgttcaccaatatggaggcccagctgatcaggcagatggaaggggagggaatcttcaagagcattcaacatttaacagtgactgaggaaatagctgtacagaactggctggcccgtgtgggccgagagcgcttgtctagaatggcaatctcgggcgatgactgcgtcgtgaaacccctcgatgaccggtttgcgtcagccctgaccgctctaaatgatatggggaaggttaggaaagacattcagcagtgggaaccaagccgcggatggaacgattggacacaagtgcccttctgctcccaccactttcatgagcttgtcatgaaggacggtagagtgctggtagttccttgtcggaatcaggatgaactcatcggcagggcccgaattagtcagggggcaggatggtctctgaaagagactgcttgcttgggcaagagctatgcccagatgtggaccttaatgtacttccaccgtagagacctgcgcctcgcagccaacgcgatctgttccgctgtgccatcacattgggtcccgacgagtcggacaacctggtctatacacgccaagcacgagtggatgactacagaagatatgcttgcagtgtggaacagggtgtggatccaagagaatccctggatggaagacaaaacccctgtcgagagctgggaagaggttccatatctgggtaagagagaggaccagtggtgcgggtccctaattggactgacttcacgcgccacctgggctaaaaacatccagacagccattaatcaggtgcggagcctcatcggcaacgaagagtacacggattatatgccctctatgaagaggtttcgaagagaagaggaagaggcaggcgtattgtggtga

SEQ ID NO: 14737 - RNA, 9876 nt, synthetic construct
  misc_feature 1..9876: note = derived and/or modified CDS sequence (opt3) from DENV-2__EU482604__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataagcttcaactgaaagggatgagctacagtatgtgtacaggaaagttcaagatcgtcaaagaaattgctgagactcagcacggcaccatcgtgattagaatacagtatgagggtgacgggtctccatgcaagatccccttcgaaattacggatttggagaaaaggcatgtactcggccggctgatcaccgttaacccgatcgtgattgaaaaggactcccctgtcaacatagaggccgaacccccatttggagatagctacatcattatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtctttacatcaatagggaaggccctgcaccaggtgttcggcgctatctacggagcggcatttagtggcgttagctggactatgaaaattcttatcggggtggtaattacctggatcggaatgaactccagatctacgagcttgtcagtcagtctggtgctcgttggcgtggtcacactgtatcttggtgccatggtgcaggctgactccgggtgtgtagtgagctggaagaataaagaactgaagtgcggatctggcatattcattaccgataacgttcacacttggacagagcagtacaagtttcaacccgaatcaccaagtaaattggccagcgcaatccagaaggcccatgaggaaggtatttgtggcatcaggtccgtcacccggctcgagaatctgatgtggaaacagataactcccgagttaaaccacatcctgtctgaaaatgaggtgaagctaaccattatgacaggggacacgaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggtggaagactacggctttggtgtcttcaccacgaacatctggctcaagctgcgtgagaaacaggacgttttttgtgattctaagttaatgagcgctgccataaaagacaatcgggcagtgcacgccgatatggggtattggattgaatccgctctgaacgacacatggaagatggagaaggcctcattcatcgaggtgaaaagctgccactggcctaagtctcataccctttggtccaatggagtattggaaagtgagatgatcattccaaaaaacttcgcaggccccgtcagccagcacaactaccgacctggttatcatactcaaaccgctggcccatggcacctcgggaagctggaaatggattttgacttctgtgagggaacaactgtggttgtgaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaattaggccacttaaggagaaggaagagaacttggtcaatagtctggtgaccgcgggacatggccagatagataactttagcttaggtgttctcggcatggccctgttccttgaagagatgctgcgcactcgagtggggacaaaacacgctatcttgctcgtagcagtctcgtttgtgaccctgattacgggaaatatgtccttccgggacctaggccgtgtgatggtcatggttggggccactatgaccgatgacatcggaatgggcgtgacatatctggctctcctggccgcatttaaggtaagacccaccttcgcggccggtcttttgctgaggaaattaacttctaaggagctcatgatggctacaattgggatcaccctgcttagccagtcaacaatacctgaaactatcctggagctaaccgatgccctcgcactgggaatgatggtgttgaaaattgtccgcaacatggaaaagtaccaactggctgtgacgatcatggccattagttgcgttcccaatgcagtgatcttacggaacgcctggaaggtctcctgtacaatactcgctgcggtgtctgttagcccactgcttctgacctcctcacagcagaaagccgactggattcctttggcactcactatcaagggcctgaatcccaccgctatctttctaacaactctgagcagaaccagtaaaaagaggtcttggccacttaacgaggccattatggccgtgggcatggtctccatactcgctagctcgctgttgaaaaatgacatcccgatgacggggcctctggtagcaggaggtttactcacagtgtgctatgttctgaccggccgatcagccgatcttgaactggagcgcgcggctgacgtgaagtgggaggatcaggccgaaatttctgggagttcccccatcttgagcattactatctctgaggacggaagcatgtccataaaaaacgaagaggaggaacaaacactcaccatcctgattcggactggcctactggtcatctcaggtgtgttcccagtaagtattcccatcacagcagccgcttggtacctttgggaggtgaagaagcagagagcaggggtcctctgggatgttcctagcccaccccctgtgggaaaagccgaactggaggacggcgcgtataggataaagcagcgtggcattttggggtactctcagatcggagctggtgtgtataaagaaggcacctttcacacgatgtggcatgtcactcgcggggccgtgttaatgcaccggggaaagagaatcgagccgtcctgggcagatgttaaaaaggacctgatttcatacggcggtgggtggaagctcgagggagaatggaaagagggcgaagaggtacaagtgctggcccttgaaccaggcaagaatcccagggctgtccagaccaaacctgggatcttcaagacaaacaccggaacaataggtgccgtgagtctggattttagcccaggcacttccgggtctcccattgttgaccgaaaaggaaaggtggtcggcttgtacggtaatggggtggtaacccggtcgggagcatatgtcagcgctatcgcccagacggagaagtcaattgaggataaccctgaaatcgaggacgatatattccgcaaaaagagactaacaattatggacctgcatccgggcgcgggcaaaactaagaggtacctccccgccatcgtgcgggaagcaatcaaacgagggctgagaacccttattttagctccaacacgcgttgtggccgctgagatggaagaggcactgaggggactccctatccgttatcagacccccgccattaaggccgagcacactggtcgggaaatagtcgacttgatgtgtcatgctaccttcacaatgagactgctctccccagtgagggttcctaactacaatctgatcattatggatgaggcgcactttacggaccccgcaagtatcgccgctcgcggctatatctctactcgagtggaaatgggggaggccgcaggaattttcatgaccgccacaccaccgggcagcagagatccttttccccaatccaacgctccaataatggacgaggaacgggagatccccgaaaggtcatggaattctggtcacgagtgggtcaccgatttcaaggggaaaactgtgtggtttgtacctagcattaaggcgggaaacgacatcgccgcatgccttcgcaaaaatggcaagaaagtgattcagctgagtcgtaagacattcgattccgaatacgttaagaccagagctaacgactgggattttgtcgtgacgactgacatcagcgagatgggcgccaatttcaaagcagagcgggtgatagatccaaggcgctgtatgaagcccgtcatcttgacagacggggaagagcgagtaattctagccggacctatgccggtgacccattcttcagctgcccagagacggggtaggatcggccgcaacccaaaaaatgaaaacgaccaatatatttacatgggggagcccctggaaaatgatgaggactgcgcgcactggaaggaggcaaaaatgctcttagataacatcaatacccctgaaggaataattccctccatgtttgagccagaaagagagaaggttgacgccatcgatggcgaatacaggctgcggggtgaggctcgtaaaactttcgtggaccttatgcgccgaggggatctgcctgtctggctcgcctataaggtggctgcagagggcattaactacgccgacagaaagtggtgttttgatggaatcaaaaataaccagatattggaagagaacgttgaagtggagatctggacaaaggagggcgaaaggaaaaagctgaaaccccggtggctcgacgctcgcatttatagtgatccactggcccttaaggagttcaaggaattcgcagcggggagaaaaagcctaaccctgaatttgatcacagagatgggaaggttacctacttttatgacgcagaaggcccggaacgctctggacaatctcgccgtcctgcataccgcagaagctggtggccgagcctacaaccacgcactttcggagctgccggagacactcgaaactttgctgctactgaccctccttgccacagtgaccgggggaattttcctgtttttaatgtctggcaaaggtatcgggaagatgactttgggcatgtgctgcataattacggcttccgtactgctctggtatgcgcagatccaaccccactggatcgccgcaagcattatcctggagttctttcttatagtgctgctcattccagaacctgagaaacagagaaccccccaggataatcagttgacatacgttgtcatcgctattctgactgtggtggccgccaccatggcaaacgaaatgggattcttagagaagacaaagaaagacctaggcctggggtcaatcaccactcaagagagtgaatctaatatactcgacatcgatcttcgcccagcttccgcctggacactgtatgcggtcgctacgacctttgttactcctatgttgaggcatagcattgagaactcaagtgtgaatgtaagcctgacagccatcgcaaaccaggccaccgtgctcatgggactgggtaagggctggcccctttccaaaatggacattggggtcccgctcctggctatcggatgttactctcaggtgaatccaattaccttgacagcagccctgttactactggttgcgcactacgctatcataggccctggtctccaggccaaggcaactcgggaagcccaaaaacgtgctgccgcagggattatgaagaaccccacggtggatggcatcaccgtcatcgaccttgagccaattccctatgatcctaagttcgaaaaacagctgggacaggtaatgttgctgatactctgcgtgacacaggttctgatgatgagaactacctgggctctttgtgaggccttaacactggcgaccggcccgatcagcactctctgggaggggaatcccggaaggttttggaacacgacaattgccgtgtccatggcaaatatcttccgcggctcatacttggctggtgccgggctgctattttctattatgaagaacaccactaatacccggcgaggaacaggcaacatcggtgaaactctgggcgagaaatggaagagtagactcaacgcacttgggaaatcggaattccaaatatataagaaaagcggaatccaggaggtcgacaggaccctggctaaggagggcattaagcgcggggaaacagatcatcacgccgtgtcccggggatctgccaaattgagatggtttgtcgagcgtaatatggtgacgccagaaggcaaggttgtggacctgggttgcgggaggggaggctggtcatactattgtggtggcctcaaaaacgtacgggaggtgaaggggctgaccaaaggaggccctgggcatgaagagcccatccctatgagcacttacggatggaatttagtccgccttcagtccggcgttgatgtgttcttcacaccacccgagaagtgcgacaccctgctctgtgatattggtgaaagttctcctaacccaactatcgaggcggggcgaacactaagagtcctgaatttggtggaaaactggctgaataacaatacccaattttgcataaaggtactcaacccctatatgccgagcgtgattgagaaaatggaaacgcttcagaggaagtacggaggcgctctggttcggaatcctttgtcacgcaactccacccacgagatgtactgggtgagtaatgcaacaggcaacatcgtcagctctgtgaatatgatctccagaatgctgattaacaggttcactatgaaacacaagaaagccacctatgagccagacgtcgatctcgggtcaggaacacgaaacataggtatcgaaagcgagattcccaatttagacatcattggcaagcggatcgaaaagataaaacaggagcatgaaacttcgtggcactacgaccaggatcatccttataagacctgggcttaccacgggtcttatgagacaaaacaaaccggaagtgcctccagcatggtgaacggcgttgtacgtctgcttactaagccatgggacgtggtccccatggtgacgcagatggcaatgacagataccactccgtttggtcagcagagagttttcaaagagaaggtggacacccgcacacaagaacctaaggaggggacgaaaaagctgatgaggatcaccgccgaatggctatggaaagagctcggaaagaaaaagactccccggatgtgtacaagagaggaatttacccgcaaagtcaggtcaaatgctgcgctgggcgccattttcactgatgagaacaagtggaagtccgcacgagaagctgtggaggacggccggttttgggaattggtagataaagagagaaatctgcacctcgaggggaagtgcgaaacatgtgtgtacaacatgatgggaaaaagggagaagaaacttggtgaattcggcaaggccaaggggtctcgcgcaatctggtatatgtggctgggagcccgttttttagagttcgaagctctgggctttttgaatgaggaccattggttcagccggggtaacagtctctccggggttgagggagaaggcctgcacagactaggctacattcttagggatgtcgggaaaaaggagggaggtgccatgtacgcggacgataccgcaggctgggacacacgcatcactctggaagacctcaaaaatgaggaaatggtgaccaaccatatgaagggggagcacaaaaagctggccgaggctatttttaagttgacgtatcagaataaagtggtccgagttcagcggccaacccctagaggaacagtgatggatataatcagcaggcgcgaccagagaggctctggtcaagtagggacttacggactgaacaccttcacaaatatggaagcccagctcattcggcagatggagggcgaaggcatcttcaagtcaatccaacatcttactgcaaccgaggagattgctgtgcagaactggctggccagggtcgggcgtgaacgattaagtcgcatggctatatccggagatgactgcgtggttaaacccatcgatgacagatttgccagcgcactgacggcgttgaatgatatgggtaaggtgcggaaagacattcagcagtgggagccatctaggggctggaacgattggacacaagtccccttctgctcgcaccactttcatgaactcgtgatgaaggacgggcgcgtactggttgtgccttgtagaaaccaggatgagctaatcggacgggccaggatttcacagggcgctggttggagccttaaggaaaccgcctgcctggggaaatcctatgcacagatgtggactctcatgtacttccaccgacgtgacctgagattggctgccaatgcaatctgtagtgccgtcccatctcattgggtgccgacaagccgcaccacttggtccatacacgcgaagcacgagtggatgaccacagaggatatgttagctgtgtggaaccgggtctggatccaagaaaatccctggatggaggacaaaacgcctgttgaatcatgggaggaagtgccatatctgggaaagagggaggaccagtggtgcggcagtctcattggccttacctctagagccacttgggcaaaaaacatccagacagccattaatcaggtacgcagcctgatcgggaacgaggaatacaccgattatatgccctccatgaagcggtttaggcgagaggaagaggaagctggagtgctatggtga

SEQ ID NO: 14738 - RNA, 9876 nt, synthetic construct
  misc_feature 1..9876: note = derived and/or modified CDS sequence (opt3) from DENV-2__EU482605__SS-prME
  source 1..9876: mol_type = other RNA
accgccggagtgataattatgctgataccaacagctatggcattccacctcactacgagaaacggggaacctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggactattcggcaagggcgggattgtaacctgcgccatgtttacatgcaaaaagaatatggaaggaaaagtggtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactggtcaccggccatctcaaatgccgtctgcgcatggataaacttcaactgaaagggatgagctacagtatgtgtacaggaaagtttaagatcgtgaaagaaattgctgagactcagcacggcaccatcgtaattagaatacagtatgagggtgacgggtctccatgcaagatccccttcgaaattacggatttggagaaaaggcatgttctcggccggctgatcaccgtgaacccgatcgtcattgaaaaggactcccctgtgaacatagaggccgaacccccattcggagatagctacatcattatcggcgtcgagcctgggcagttaaaactgaattggtttaagaagggatcgtctattggtcaaatgttcgagacaactatgcgaggcgctaaacgcatggccatcctaggggacaccgcatgggattttggatccctcggcggtgtgttcacatcaatagggaaggccctgcaccaggtttttggcgctatctacggagcggcattcagtggcgtgagctggactatgaaaattcttatcggggtagtcattacctggatcggaatgaactccagatctacgagcttgtcagtgagtctggttctcgtgggcgtcgtgacactgtatcttggtgccatggtacaggctgactccgggtgtgtggttagctggaagaataaagaactgaagtgcggatctggcatatttattaccgataacgtccacacttggacagagcagtacaagttccaacccgaatcaccaagtaaattggccagcgcaatccagaaggcccatgaggaaggtatttgtggcatcaggtccgtgacccggctcgagaatctgatgtggaaacagataactcccgagttaaaccacatcctgtctgaaaatgaggtgaagctaaccattatgacaggggacacgaaaggaatcatgcaggctggcaagcgctcgctcagacctcaaccaaccgaactgaaatatagctggaagacttgggggaaggccaaaatgctttccacagagtcacataaccagacctttttgattgatggaccggaaacagcagagtgccccaatactaacagggcgtggaatagtctggaggtcgaagactacggcttcggtgtttttaccacgaacatctggctcaagctgcgtgagaaacaggacgtgttctgtgattctaagttaatgagcgctgccataaaagacaatcgggcagtgcacgccgatatggggtattggattgaatccgctctgaacgacacatggaagatggagaaggcctcatttatcgaggtaaaaagctgccactggcctaagtctcataccctttggtccaatggagtcttggaaagtgagatgatcattcccaagaacttcgcaggccccgtgagccagcacaactaccgacctggttatcatactcaaaccgctggcccatggcacctcgggaagctggaaatggatttcgacttttgtgagggaacaactgttgtggtcaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaattaggccacttaaggagaaggaagagaacttggtgaatagtctggttaccgcgggacatggccagatagataacttcagcttaggtgtgctcggcatggccctgtttcttgaagagatgctgcgcactcgagtagggacaaaacacgctatcttgctcgtcgcagtgtcgttcgtgaccctgattacgggaaatatgtcctttcgggacctaggccgtgtcatggttatggtgggggccactatgaccgatgacatcggaatgggcgtaacatatctggctctcctggccgcattcaaggtgagacccacctttgcggccggtcttttgctgaggaaattaacttctaaggagctcatgatggctacaattgggatcaccctgcttagccagtcaacaatacctgaaactatcctggagctaaccgatgccctcgcactgggaatgatggtcttgaaaattgtgcgcaacatggaaaagtaccaactggctgttacgatcatggccattagttgcgtgcccaatgcagtcatcttacggaacgcctggaaggtgtcctgtacaatactcgctgcggtttctgtgagcccactgcttctgacctcctcacagcagaaagccgactggattcctttggcactcactatcaagggcctgaatcccaccgctatcttcctaacaactctgagcagaaccagtaaaaagaggtcttggccacttaacgaggccattatggccgtcggcatggtatccatactcgctagctcgctgttgaaaaatgacatcccgatgacggggcctctggtggcaggaggtttactcacagtttgctatgtgctgaccggccgatcagccgatcttgaactggagcgcgcggctgacgtcaagtgggaggatcaggccgaaatttctgggagttcccccatcttgagcattactatctctgaggacggaagcatgtccatcaagaacgaagaggaggaacaaacactcaccatcctgattcggactggcctactggtgatctcaggtgtatttccagtgagtattcccatcacagcagccgcttggtacctttgggaggtcaagaagcagagagcaggggttctctgggatgtgcctagcccaccccctgtgggaaaagccgaactggaggacggcgcgtataggataaagcagcgtggcattttggggtactctcagatcggagctggtgtctataaagaaggcaccttccacacgatgtggcatgtgactcgcggggccgttttaatgcaccggggaaagagaatcgagccgtcctgggcagatgtcaaaaaggacctgatttcatacggcggtgggtggaagctcgagggagaatggaaagagggcgaagaggtgcaagtcctggcccttgaaccaggcaagaatcccagggctgtgcagaccaaacctgggatctttaagacaaacaccggaacaataggtgccgttagtctggatttcagcccaggcacttccgggtctcccattgtggaccgaaaaggaaaggtcgtgggcttgtacggtaatggggtagtcacccggtcgggagcatatgtgagcgctatcgcccagacggagaagtcaattgaggcgaaccctgaaatcgaggatgccatatttcgcaaaaagagactaacaattatggacctgcatccgggcgcaggcaaacccaagaggtccctcccagctatcgttcgggaagccatcaaacgagggctgagacctcttattttagctcccccacgcgtggtccctgcagagatggaggaaccactgaggggactcccaatccgttaccagactccggccattaagcctgatcacaccggtcgggagatagtggccttgatgtgtcatgctcccttcacaatgagactgctcagtccagttagggtgcccaactataatctgatcattatggacgaagcgcacttcaccgaccctgcatctatcgccgctcgcggctacatcagcactcgagtcgagatgggggaagccgcaggaatttttatgaccgccacaccacccggctccagagatcctttcccgcaatcaaacgctccaataatggacgaggagcgggaaatccccgagaggtcttggaatagcggtcacgaatgggtgacggattttaaggggaaaactgtatggttcgtgcctagtattaaggcgggaaacgacatcgccgcatgccttcgcaaaaatggcaagaaagttattcagctgtcccgtaagacctttgatagcgagtatgtcaagacaagagctaacgactgggatttcgtggtgaccactgacatctctgaaatgggcgccaattttaaagcagagcgggtcatagatcccaggcgctgtatgaagccagtaatcttgacagacggggaggaacgagtgattctagccggacctatgcccgttacccattcatccgctgcccagagacggggtaggatcggccgcaaccccaaaaatgagaacgatcaatacatttatatgggggaacctctggagaatgacgaagactgcgcgcactggaaggaggcaaaaatgctcttagataacatcaatacgccggagggaataattcccagtatgttcgaaccagagagagaaaaggtggacgccatcgatggcgagtacaggctgcggggtgaagctcgtaaaacttttgtcgaccttatgcgccgaggggatctgcctgtgtggctcgcctacaaggttgctgcagagggcattaactatgccgacagaaagtggtgtttcgatggaatcaaaaataaccagatattggaggaaaacgtggaggtcgaaatctggacaaaggagggcgagaggaaaaagctgaaaccccggtggctcgacgctcgcatttacagcgatccactggcccttaaggaatttaaggagttcgcagcggggagaaaatcgctaaccctgaatttgatcaccgaaatgggaaggttacctactttcatgacacagaaggcccggaacgctctggacaatctcgccgtgctgcataccgcagaggctggtggccgagcctataaccacgcactttctgaactgcccgagacactcgagactttgctgctactgacgctccttgccaccgtaacagggggaatttttctgttcttaatgtccggcaaaggtatcgggaagatgactttgggcatgtgctgcataattaccgctagcgtgctgctctggtacgcgcagatccaaccgcactggatcgccgcatcaattatcctggaatttttccttatagttctgctcattccagagcctgaaaaacagagaacaccccaggataatcagttgacctatgtcgtgatcgctattctgactgtggtcgccgccacgatggcaaacgagatgggatttttagaaaagaccaagaaagacctaggcctggggagtatcacaactcaagagtctgagtccaatatactcgatatcgaccttcgcccagctagcgcctggaccctgtacgcggttgctacaaccttcgtgactcccatgttgaggcattcaattgaaaacagtagcgtaaatgtgtccctgacagccatcgcaaaccaggccacggtcctcatgggactgggtaagggctggcctctttctaaaatggacattggggtgccgctcctggctatcggatgttatagccaggttaatcccattaccttgactgcagccctgttactactggtggcgcactacgctatcataggcccaggtctccaggccaaggcaacacgggaggcccaaaaacgtgctgccgcagggattatgaagaaccctaccgtcgatggcatcaccgtaatcgaccttgaacccattccttacgatccaaagtttgagaaacagctgggacaggtgatgttgctgatactctgcgttacacaggtgctgatgatgagaactacgtgggctctttgtgaagccttaaccctggcgacaggccccatctccactctctgggaggggaatcctggaaggttctggaacaccacaattgccgtctcaatggcaaatatctttcgcggctcttatttggctggtgccgggctgctattcagtattatgaagaacaccactaatacgcggcgaggaacaggcaacatcggtgagaccctgggcgaaaaatggaagtcgagactcaacgcacttgggaaaagcgagtttcaaatatacaagaaatccggaatccaggaagtggacaggactctggctaaggagggcattaagcgcggggagaccgatcatcacgccgtctctcggggatcagccaaattgagatggttcgtggaacgtaatatggttacaccagagggcaaggtggtagacctgggttgcgggaggggaggctggagctattactgtggtggcctcaaaaacgtgcgggaagtcaaggggctgactaaaggaggccccgggcatgaggaaccgatccctatgtccacctatggatggaatttagttcgccttcagagtggcgtggatgtctttttcacaccacccgagaagtgcgacacgctgctctgtgatattggtgagtctagccctaacccaaccatcgaagcggggcgaactctaagagtgctgaatttggtagagaactggctgaataacaatacacaattctgcataaaggtgctcaacccctacatgccgtcagttattgagaaaatggagacccttcagaggaagtatggaggcgctctggtgcggaatcctttgtcccgcaacagtactcacgaaatgtactgggtcagcaatgcaacaggcaacatcgtgtcttccgtcaatatgatctcaagaatgctgattaacaggtttaccatgaaacacaagaaagccacgtacgagcccgacgtggatctcgggagcggaacccgaaacataggtatcgagtcggaaattccaaatttagacatcattggcaagcggatcgagaagataaaacaggaacatgagacatcttggcactatgatcaggaccatccttacaagacttgggcttatcacgggagttacgaaaccaaacaaacaggatccgccagctcaatggttaacggcgtagtgcgtctgcttactaagccctgggacgtcgtgccaatggttacccagatggcaatgacagataccactcccttcggtcagcagagagtgtttaaagagaaggtcgacacgcgcacacaagagcctaaggaagggaccaaaaggctgatgcggatcactgccgagtggctatggaaggaactcggcaaaaagaaaaccccaagaatgtgtacacgcgaggagttcacgaggaaggtgcgatccaatgctgcgctgggcgccatttttaccgatgaaaacaaatggaagtctgcacgggaggctgtagaagacggcagattctgggagttggtggataaggaaaggaatctgcacctcgaggggaaatgcgagacttgtgtttataacatgatgggaaagcgcgagaagaaacttggtgagtttggcaaagccaaagggagccgtgcaatctggtacatgtggctgggagcccggttcttagaatttgaggctctgggcttcttgaatgaagaccattggtttagtagaggtaactccctcagcggggtcgagggagagggcctgcacaggctaggctatattcttcgcgatgtggggaagaaagaaggaggtgccatgtacgcggacgatacagcaggctgggacacccgaatcactctggaggatctcaagaatgaagagatggtgacaaaccatatgaaaggggaacacaagaaactggccgaggctattttcaagttgacctaccagaataaggtcgttcgggtgcagagaccgacacccaggggaactgtaatggacataatctctcgcagagaccagcggggctcaggtcaagtggggacctatggactgaacacgtttaccaatatggaggcccagctcattaggcagatggaaggcgagggcatcttcaaaagtatccaacatcttacagcaactgaagagattgctgtccagaactggctggcccgtgtggggcgagagcgcttatccagaatggctataagcggagatgactgcgttgtgaagcctatcgatgaccggttcgcctctgcactgaccgcgttgaatgatatgggtaaagtcaggaaggacattcagcagtgggaaccatcgcgcggctggaacgattggacacaagtgcccttttgctcacaccacttccatgagctcgtaatgaaagacgggagagttctggtggtcccttgtcggaaccaggatgaactaatcggaagggcccgaattagccagggcgctggttggtcccttaaggagactgcctgcctggggaagagttacgcacagatgtggaccctcatgtattttcaccgtagagacctgcgcttggctgccaatgcaatctgttctgccgtgccaagccattgggtgcccacgtcccggacaacctggtcaatacacgcgaaacacgaatggatgactacagaggatatgttagctgtctggaacagggtttggatccaagagaatccttggatggaagacaagaccccggtggagagttgggaagaggtaccatacctgggaaaaagagaagatcagtggtgcggctctctcattggccttactagccgcgccacctgggcaaagaacatccagacagccattaatcaggtgcggtccctgatcgggaacgaggagtatacggactacatgccctcaatgaaaaggttccgaagagaagaggaagaggctggagtcctatggtga

SEQ ID NO: 14739 - RNA, 9876 nt, synthetic construct
  misc_feature 1..9876: note = derived and/or modified CDS sequence (opt3) from DENV-2__EU482606__SS-prME
  source 1..9876: mol_type = other RNA
accgccggcgtgatcattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtggatagaggctggggtaacgggtgtggactattcggcaagggcgggattgtcacctgcgccatgtttacatgcaaaaagaatatggaaggaaaagtggtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataagcttcaactgaaagggatgagctacagtatgtgtacaggaaagttcaagatcgtcaaagaaattgctgagactcagcacggcaccatcgtgattagaatacagtatgagggtgacgggtctccatgcaagatccccttcgaaattacggatttggagaaaaggcatgtactcggccggctgatcaccgttaacccgatcgtgattgaaaaggactcccctgtcaacatagaggccgaacccccatttggagatagctacatcattatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtctttacatcaatagggaaggccctgcaccaggtgttcggcgctatctacggagcggcatttagtggcgttagctggactatgaaaattcttatcggggtggtaattacctggatcggaatgaactccagatctacgagcttgtcagtcagtctggtgctcgttggcgtggtcacactgtatcttggtgccatggtgcaggctgactccgggtgtgtagtgagctggaagaataaagaactgaagtgcggatctggcatattcattaccgataacgttcacacttggacagagcagtacaagtttcaacccgaatcaccaagtaaattggccagcgcaatccagaaggcccatgaggaaggtatttgtggcatcaggtccgtcacccggctcgagaatctgatgtggaaacagataactcccgagttaaaccacatcctgtctgaaaatgaggtgaagctaaccattatgacaggggacacgaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggtggaagactacggctttggtgtcttcaccacgaacatctggctcaagctgcgtgagaaacaggacgttttttgtgattctaagttaatgagcgctgccataaaagacaatcgggcagtgcacgccgatatggggtattggattgaatccgctctgaacgacacatggaagatggagaaggcctcattcatcgaggtgaaaagctgccactggcctaagtctcataccctttggtccaatggagtattggaaagtgagatgatcattccaaaaaacttcgcaggccccgtcagccagcacaactaccgacctggttatcatactcaaaccgctggcccatggcacctcgggaagctggaaatggattttgacttctgtgagggaacaactgtggttgtgaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaattaggccacttaaggagaaggaagagaacttggtcaatagtctggtgaccgcgggacatggccagatagataactttagcttaggtgttctcggcatggccctgttccttgaagagatgctgcgcactcgagtggggacaaaacacgctatcttgctcgtagcagtctcgtttgtgaccctgattacgggaaatatgtccttccgggacctaggccgtgtgatggtcatggttggggccactatgaccgatgacatcggaatgggcgtgacatatctggctctcctggccgcatttaaggtaagacccaccttcgcggccggtcttttgctgaggaaattaacttctaaggagctcatgatggctacaattgggatcaccctgcttagccagtcaacaatacctgaaactatcctggagctaaccgatgccctcgcactgggaatgatggtgttgaaaattgtccgcaacatggaaaagtaccaactggctgtgacgatcatggccattagttgcgttcccaatgcagtgatcttacggaacgcctggaaggtctcctgtacaatactcgctgcggtgtctgttagcccactgcttctgacctcctcacagcagaaagccgactggattcctttggcactcactatcaagggcctgaatcccaccgctatctttctaacaactctgagcagaaccagtaaaaagaggtcttggccacttaacgaggccattatggccgtgggcatggtctccatactcgctagctcgctgttgaaaaatgacatcccgatgacggggcctctggtagcaggaggtttactcacagtgtgctatgttctgaccggccgatcagccgatcttgaactggagcgcgcggctgacgtgaagtgggaggatcaggccgaaatttctgggagttcccccatcttgagcattactatctctgaggacggaagcatgtccataaaaaacgaagaggaggaacaaacactcaccatcctgattcggactggcctactggtcatctcaggtgtgttcccagtaagtattcccatcacagcagccgcttggtacctttgggaggtgaagaagcagagagcaggggtcctctgggatgttcctagcccaccccctgtgggaaaagccgaactggaggacggcgcgtataggataaagcagcgtggcattttggggtactctcagatcggagctggtgtgtataaagaaggcacctttcacacgatgtggcatgtcactcgcggggccgtgttaatgcaccggggaaagagaatcgagccgtcctgggcagatgttaaaaaggacctgatttcatacggcggtgggtggaagctcgagggagaatggaaagagggcgaagaggtacaagtgctggcccttgaaccaggcaagaatcccagggctgtccagaccaaacctgggatcttcaagacaaacaccggaacaataggtgccgtgagtctggattttagcccaggcacttccgggtctcccattgttgaccgaaaaggaaaggtggtcggcttgtacggtaatggggtggtaacccggtcgggagcatatgtcagcgctatcgcccagacggagaagtcaattgaggataaccctgaaatcgaggacgatatattccgcaaaaagagactaacaattatggacctgcatccgggcgcgggcaaaactaagaggtacctccccgccatcgtgcgggaagcaatcaaacgagggctgagaacccttattttagctccaacacgcgttgtggccgctgagatggaagaggcactgaggggactccctatccgttatcagacccccgccattaaggccgagcacactggtcgggaaatagtcgacttgatgtgtcatccaaccttcacaatgagactgctctcccctgtgagggttcccaactacaatctgatcattatggatgaggctcactttacggacccagcgagtatcgcagcccgcggctatatctctactcgagtggaaatgggggaggctgccggaattttcatgaccgcaacaccgcctggcagcagagatccctttccacaatccaacgcccccataatggacgaggaacgggagatccctgaaaggtcatggaattctggtcacgagtgggtcaccgatttcaaggggaaaactgtgtggtttgtaccaagcattaaggctggaaacgacatcgcggcctgccttcgcaaaaatggcaagaaagtgattcagctgagtcgtaagacattcgattccgaatacgttaagaccagagcaaacgactgggattttgtcgtgacgactgacatcagcgagatgggcgctaatttcaaagccgagcgggtgatagatcccaggcgctgtatgaagcctgtcatcttgacagacggggaagagcgagtaattctagcaggaccgatgccagtgacccattcttcagccgctcagagacggggtaggatcggccgcaaccccaaaaatgaaaacgaccaatatatttacatgggggagcctctggaaaatgatgaggactgcgcccactggaaggaggcgaaaatgctcttagataacatcaatacccccgaaggaataattccatccatgtttgagcctgaaagagagaaggttgacgcaatcgatggcgaatacaggctgcggggtgaggcccgtaaaactttcgtggaccttatgcgccgaggggatctgcccgtctggctcgcttataaggtggccgctgagggcattaactacgcagacagaaagtggtgttttgatggaatcaaaaataaccagatattggaagagaacgttgaagtggagatctggacaaaggagggcgaaaggaaaaagctgaaaccacggtggctcgacgcccgcatttatagtgatcctctggctcttaaggagttcaaggaattcgccgcagggagaaaaagcctaaccctgaatttgatcacagagatgggaaggttaccgacttttatgacgcagaaggcgcggaacgccctggacaatctcgctgtcctgcataccgccgaagcaggtggccgagcttacaaccacgccctttcggagctgcccgagacactcgaaactttgctgctactgaccctccttgcaacagtgaccgggggaattttcctgtttttaatgtctggcaaaggtatcgggaagatgactttgggcatgtgctgcataattacggcctccgtactgctctggtatgctcagatccaaccacactggatcgcggccagcattatcctggagttctttcttatagtgctgctcattcctgaacccgagaaacagagaaccccacaggataatcagttgacatacgttgtcatcgcaattctgactgtggtggctgccaccatggccaacgaaatgggattcttagagaagacaaagaaagacctaggcctggggtcaatcaccactcaagagagtgaatctaatatactcgacatcgatcttcgccctgcatccgcttggacactgtatgccgtcgcgacgacctttgttactcccatgttgaggcatagcattgagaactcaagtgtgaatgtaagcctgacagctatcgccaaccaggcaaccgtgctcatgggactgggtaagggctggccgctttccaaaatggacattggggtcccactcctggccatcggatgttactctcaggtgaatcctattaccttgacagctgcactgttactactggttgcccactacgcgatcataggccccggtctccaggctaaggccactcgggaagcacaaaaacgtgccgctgccgggattatgaagaacccaacggtggatggcatcaccgtcatcgaccttgagcccattccttatgatccgaagttcgaaaaacagctgggacaggtaatgttgctgatactctgcgtgacacaggttctgatgatgagaactacctgggcactttgtgaggctttaacactggccaccggccccatcagcactctctgggaggggaatccaggaaggttttggaacacgacaattgcggtgtccatggccaatatcttccgcggctcatacttggcaggtgctgggctgctattttctattatgaagaacaccactaatacccggcgaggaacaggcaacatcggtgaaactctgggcgagaaatggaagagtagactcaacgcccttgggaaatcggaattccaaatatataagaaaagcggaatccaggaggtcgacaggaccctggcaaaggagggcattaagcgcggggaaacagatcatcacgctgtgtcccggggatctgccaaattgagatggtttgtcgagcgtaatatggtgacgcctgaaggcaaggttgtggacctgggttgcgggaggggaggctggtcatactattgtggtggcctcaaaaacgtacgggaggtgaaggggctgaccaaaggaggccccgggcatgaagagcctatcccaatgagcacttacggatggaatttagtccgccttcagtccggcgttgatgtgttcttcacaccccctgagaagtgcgacaccctgctctgtgatattggtgaaagttctccaaaccccactatcgaggccgggcgaacactaagagtcctgaatttggtggaaaactggctgaataacaatacccaattttgcataaaggtactcaacccgtatatgcctagcgtgattgagaaaatggaaacgcttcagaggaagtacggaggcgcgctggttcggaatccattgtcacgcaactccacccacgagatgtactgggtgagtaatgctacaggcaacatcgtcagctctgtgaatatgatctccagaatgctgattaacaggttcactatgaaacacaagaaagcaacctatgagcccgacgtcgatctcgggtcaggaacacgaaacataggtatcgaaagcgagattcctaatttagacatcattggcaagcggatcgaaaagataaaacaggagcatgaaacttcgtggcactacgaccaggatcatccatataagacctgggcctaccacgggtcttatgagacaaaacaaaccggaagtgcttccagcatggtgaacggcgttgtacgtctgcttactaagccctgggacgtggtcccgatggtgacgcagatggccatgacagataccactccttttggtcagcagagagttttcaaagagaaggtggacacccgcacacaagaacccaaggaggggacgaaaaagctgatgaggatcaccgcagaatggctatggaaagagctcggaaagaaaaagactccacggatgtgtacaagagaggaatttacccgcaaagtcaggtcaaatgccgctctgggcgcgattttcactgatgagaacaagtggaagtccgcccgagaagcagtggaggacggccggttttgggaattggtagataaagagagaaatctgcacctcgaggggaagtgcgaaacatgtgtgtacaacatgatgggaaaaagggagaagaaacttggtgaattcggcaaggctaaggggtctcgcgccatctggtatatgtggctgggagcacgttttttagagttcgaagccctgggctttttgaatgaggaccattggttcagccggggtaacagtctctccggggttgagggagaaggcctgcacagactaggctacattcttagggatgtcgggaaaaaggagggaggtgctatgtacgccgacgataccgcgggctgggacacacgcatcactctggaagacctcaaaaatgaggaaatggtgaccaaccatatgaagggggagcacaaaaagctggcagaggccatttttaagttgacgtatcagaataaagtggtccgagttcagcggcctacccccagaggaacagtgatggatataatcagcaggcgcgaccagagaggctctggtcaagtagggacttacggactgaacaccttcacaaatatggaagctcagctcattcggcagatggagggcgaaggcatcttcaagtcaatccaacatcttactgccaccgaggagattgcagtgcagaactggctggctagggtcgggcgtgaacgattaagtcgcatggccatatccggagatgactgcgtggttaaaccaatcgatgacagatttgctagcgccctgacggcattgaatgatatgggtaaggtgcggaaagacattcagcagtgggagccctctaggggctggaacgattggacacaagtccctttctgctcgcaccactttcatgaactcgtgatgaaggacgggcgcgtactggttgtgccatgtagaaaccaggatgagctaatcggacgggcgaggatttcacagggcgccggttggagccttaaggaaaccgcttgcctggggaaatcctatgcccagatgtggactctcatgtacttccaccgacgtgacctgagattggcagctaatgccatctgtagtgcagtcccgtctcattgggtgcccacaagccgcaccacttggtccatacacgccaagcacgagtggatgaccacagaggatatgttagcggtgtggaaccgggtctggatccaagaaaatccttggatggaggacaaaacgccagttgaatcatgggaggaagtgccctatctgggaaagagggaggaccagtggtgcggcagtctcattggccttacctctagagctacttgggccaaaaacatccagacagcaattaatcaggtacgcagcctgatcgggaacgaggaatacaccgattatatgccttccatgaagcggtttaggcgagaggaagaggaagccggagtgctatggtga

SEQ ID NO: 14740 - RNA, 9876 nt, synthetic construct
  misc_feature 1..9876: note = derived and/or modified CDS sequence (opt3) from DENV-2__EU482607__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcggggtctctaacagggattttgtggaaggagtatcgggtggctcatgggttgacatagtgctcgagcacgggagctgtgtcactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatttgcaagcattctatggtggatagaggctggggtaacgggtgtggactattcggcaagggcgggatcgtgacctgcgccatgtttacatgcaaaaagaatatggaaggaaaagtcgttcagcctgagaacctcgaatacaccatcgtgattactccacacagcggtgaggagcatgctgtaggcaatgacacggggaagcacggaaaagaaataaagatcacaccgcagtcctcaattatcgaggccgaactgaccggctatggtactgtgaccatggagtgtagtcccaggacagggcttgatttcaacgaaatggtcctgttgcaaatggaggacaaagcatggctcgtgcaccggcagtggtttctggatttacctctgccatggctccccggcgctgacacccagggaagcaattggatacagaaggagactcttgttacattcaagaaccctcatgccaaaaagcaagacgtggtcgtgctgggctctcaggaaggggcgatgcacacggccttgaccggagcaactgagattcagatgtcctcaggtaatctactgtttacaggccatctcaaatgccgtctgcgcatggataagcttcaactgaaagggatgagctacagtatgtgtaccggaaagttcaagatcgtaaaagaaatcgctgagacacagcacggcactattgttatcagagtgcagtatgagggtgacgggtctccatgcaagattcccttcgaaataaccgatttggagaaaaggcatgtcctcggccggctgatcacggtgaacccgattgtcaccggaaaggactcccctgtgaacatcgaagccgagcccccatttggcgatagctacatcattataggggttgaacctggacagttaaaactgaattggttcaagaagggttcgtctatcggccaaatgtttgagacaactatgcgaggggctaaacgcatggccattctaggagacaccgcatgggatttcggctccctcggtggggtgtttacatcaatcggcaaggccctgcaccaggtattcggagctatttacggcgcggcatttagtggggtcagctggactatgaaaatccttataggagtgatcattacctggatcggcatgaactccagatctacgagcttgtcagttagtctggtgctcgtcggtgtggtaacactgtatcttggggccatggtgcaggctgactccggatgtgttgtcagctggaagaataaagagctgaagtgcggctctggtattttcatcaccgataacgtgcacacttggacagaacagtacaagtttcaacccgagtcaccaagtaaattggccagcgcaatacagaaggcccatgaagagggcatttgtgggatcaggtccgtgacccggctcgaaaatctgatgtggaaacagattactcccgagttaaaccacatcctgtctgagaatgaagtcaagctaaccataatgacaggagacatcaaaggcattatgcaggctgggaagcgctcgctcagacctcaaccaacggagctgaaatatagctggaagacctggggaaaggccaaaatgctttccactgaatcacataaccagacattcttgatcgatggcccggagaccgcagaatgccccaatacaaacagggcgtggaatagtctggaggttgaggactacggttttggggtgttcactaccaacatttggctcaagctgcgtgaaaaacaggacgtgttttgtgattctaagttaatgagcgctgccatcaaagacaatcgggcagtacacgccgatatgggatattggatagagtccgctctgaacgacacgtggaagatggaaaaggcctcattcattgaggtcaaaagctgccactggcctaagtctcatacactttggtccaatggcgtgttggagagtgaaatgatcatcccaaaaaacttcgcaggtcccgttagccagcacaactaccgacctggctatcatacccaaactgctgggccatggcacctcggaaagctggagatggattttgacttctgtgaaggcaccacagtggtcgtgactgaggattgcgggaatagaggaccctctctaaggaccacaacggcctccggcaaactgattaccgaatggtgctgtcgctcatgcactctcccgcctctgcggtacagaggtgaggacgggtgttggtacggaatggagatcaggccacttaaggaaaaggaggaaaacttggttaatagtctggtgacagcgggccatggtcagattgataactttagcttaggcgtactcgggatggccctgttccttgaggaaatgctgcgcacccgagtcggaactaaacacgctatattgctcgtggcagtgtcgtttgtcacactgatcaccggcaatatgtccttccgggacctagggcgtgttatggtgatggtaggagccacgatgactgatgacattggcatgggtgtgacctatctggctctcctggccgcatttaaggtcagacccacattcgcggccgggcttttgctgaggaaattaacctctaaggagctcatgatggctactatcggaattgccctgcttagccagtcaacaatccctgagaccatactggaactaacagatgcactcgctctgggcatgatggtgttgaaaatcgttcgcaacatggagaagtaccaactggccgtgactgtcatggcaattagttgcgtgcccaatgccgttatcttacagaacgcttggaaggtgtcctgtaccattctcgcggccgtctctgtaagcccactgcttctgacgtcctcacagcagaaagcagactggatccctttggctctcacaataaagggcctgaatcccaccgccatttttctaactaccctgagccggacaagtaaaaagagatcttggccacttaacgaagccatcatggctgtggggatggtttccatcctcgcaagctcgctgttgaaaaatgacattccgatgactggacctctggtggccggtggcttactcaccgtctgctatgtgctgacggggaggtcagcggatcttgagctggaacgagctgccgacgtaaagtgggaggatcaagcagagatatctggaagttcccccatcttgagcattacaatctctgaagacggcagcatgtccattaaaaacgaggaagaggagcagaccctcactatcctgatacgcacaggtctactggtgatctcaggggtcttcccagttagtattcccatcaccgccgctgcatggtacctttgggaagtgaagaagcagcgggccggagtgctctgggatgtccctagcccaccccctgtgggcaaagcggagctggaagacggcgcttatagaattaagcagagggggatcttgggatactctcaaataggtgccggcgtttataaagaggggacttttcacacaatgtggcatgtaacccgtggagcagtgttaatgcaccgcggcaagcggattgaaccgtcctgggccgatgtcaaaaaggacctgatctcatacggtgggggatggaagctcgagggcgagtggaaagaaggcgaggaagtgcaggttctggctcttgagccagggaagaatcccagagccgtgcagacgaaacctggaatcttcaagactgataccggtacaattggcgcagtcagtctggactttagcccagggacctccggatctcccatcgtggataggaaaggcaaggtagtcggtttgtacgggaacggagtggttacacgatcgggcgcttatgtgagcgccatagcgcagactgaaaagtcaattgaggacaatcctgagatcgaagatgacattttccggaaaaagcgcctaaccatcatggacctgcatccgggcgccgggaaaacgaagagatacctccccgcaatagtcagggaggctattaaacggggactgcgaacacttatcttagccccaactagagtggttgctgcagaaatggaggaagccctgcgcggtctccctatcaggtatcaaacccccgccattaaggctgagcacacaggccgtgagatcgtggatttgatgtgtcatgcgaccttcactatgcggctgctctccccagtcagagtgcctaactacaacctgattataatggacgaagcacactttaccgatcccgccagtatcgctgccagggggtatatttctacacgcgtagagatgggagaagcagccggcatcttcatgacggctactccaccgggtagccgagacccttttccccagtccaatgcgccaatcatggatgaggagagagaaattcccgagcggtcatggaactctgggcacgaatgggtgaccgacttcaagggaaaaacagtttggtttgtccctagcataaaggccggcaatgatatcgcagcttgccttaggaaaaacggcaagaaagtgattcagctgagtcgcaagaccttcgactccgagtacgtgaagactcgtgccaatgattgggactttgtcgtaacaaccgatatcagcgaaatgggggcaaacttcaaagccgagagagtgattgacccacggaggtgtatgaagcccgttatcttgacggacggagaggaacgcgtgatactagctggtcctatgccggtcactcattcttcagccgcgcaacgaagaggccggatcgggaggaatccaaaaaacgagaatgatcagtatatttacatgggagaacccctggagaacgacgaagattgcgcacactggaaggaggccaaaatgctcttagacaatatcaacacacctgagggcattatcccctccatgtttgaaccagagcgcgaaaaggtggatgctatagacggtgagtacagactgaggggggaagcccggaaaaccttcgttgatcttatgcgtcgcggcgacctgcctgtgtggctcgcttataaggtcgcagccgagggaattaattacgctgatcgaaagtggtgttttgacggcatcaaaaacaatcagattttggaggaaaacgtggaggtagaaatctggaccaaggagggggagagaaaaaagctgaaacccaggtggctcgatgcccggatatatagtgacccactggcacttaaggaattcaaggagttcgcggccggacgcaaaagcctagctctgaacttgatcactgaaatgggtagattacctacatttatgacccagaaggccaggaatgcactggataacctcgctgtgctgcatacagccgaggcaggcgggcgggcctacaatcacgctctttcggaactgccggagactctcgagacgttgctgctactgaccctccttgcgacagttactggaggcattttcctgtttttaatgtctggtaaagggatcggcaagatgaccttgggaatgtgctgcattatcacagcctccgtcctgctctggtatgcacaaatacagccccactggattgctgccagcatcatcctggaattctttcttattgtgctgctcatcccagagcctgaaaaacagcgaaccccccaggacaaccaattgacttacgtggtcatagccattctgacggttgtggcagctaccatggccaatgagatgggcttcttagaaaagacaaagaaagacctagggctgggatcaatcactacccaggagagtgagtctaacattctcgatatcgaccttagaccagcgtccgcttggacactgtatgccgtagcaaccacttttgtgacacctatgttgcgccatagcatagaaaattcaagtgtcaacgtgagcctgacggccatcgctaatcaggcaaccgttctcatgggtctgggcaaggggtggcccctttccaaaatggatattggagtgccgctcctggccatcggctgttactctcaggtcaacccaattactttgacagcggctctgttactactggtagcccactacgcaatcattggtcctgggctccaagccaaggctaccagggaggcccagaaacgggcagctgccggcatcatgaagaatcccaccgtggacggaataacagttattgatcttgaaccaatcccctatgaccctaagttcgagaaacagctgggccaggtgatgttgctgatcctctgcgtcactcaagtgctgatgatgcgtacgacctgggcgctttgtgaagccttaacactggcaactgggccgattagcaccctctgggagggaaaccccggcagattttggaatacaaccatagctgtctccatggccaacatcttcaggggttcatacttggcaggggctggactgctattttctattatgaagaatactacgaacacacgccggggcaccggtaatatcggcgagactctgggggaaaaatggaagagtcgactcaacgcccttggaaaatcggagttccagatttataagaaaagcggcatccaggaagtggatagaaccctggccaaggaggggataaagaggggagagacagaccatcacgcggtttcccgcggctctgctaaattgcggtggtttgtggaaagaaacatggtaactccagagggtaaggtggtcgatctggggtgcggacgtggcggttggtcatactattgtggcgggctcaaaaatgttagggaagtgaagggactgaccaaaggcgggcctggacatgaggaacccatccctatgagcacatacggctggaacttagtccggcttcaatccggtgtggacgtattcttcacgccacccgagaagtgcgataccctgctctgtgacattggggagagttctcctaatccaactatcgaagcaggacgcacactacgagtgctgaacttggttgagaattggctgaacaataacacccagttttgcattaaggtgctcaatccctatatgccgagcgtcatcgaaaaaatggagactcttcagagaaagtacggcggcgccctggtgaggaaccctttgtcacggaattccacacacgaaatgtactgggtcagtaacgctaccgggaatatagtgagctctgttaacatgatttcccgcatgctgatcaatagattcacgatgaaacacaagaaagccacctatgagccagatgtagacctcggatcaggtacaaggaacatcggcattgagagcgaaatacccaacttagacatcattgggaagcgaatcgagaagattaaacaggaacatgagacttcgtggcactacgatcaagaccatccttataagacctgggcataccacggatcttatgaaacaaaacagactggcagtgcctccagcatggtgaatggtgtcgtgcggctgcttaccaagccatgggatgttgtgcccatggtcacacagatggctatgaccgacactacgccgtttgggcagcaacgtgtgttcaaagagaaggtagatacaagaacccaggagcctaaggaaggaactaaaaagctgatgaaaatcaccgcggagtggctatggaaggaactcggcaaaaagaaaacaccccgcatgtgtacgagggaggagtttacccggaaggtgagatcaaacgccgcactgggcgctatattcactgacgaaaataagtggaaatccgcccgcgaggcagttgaagatgggaggttttgggagttggtcgaccgagaacggaacctgcacctcgagggaaagtgcgagacatgtgtgtacaatatgatgggtaaaagagaaaagaaacttggcgagttcgggaaggccaagggatctagggctatctggtatatgtggctgggcgcccgctttttagaattcgaggcgctgggttttttgaacgaagatcattggttcagccgtgggaatagtctctccggagtggagggcgagggcctgcaccggctagggtacattcttagagacgtcggaaaaaaggaaggtggcgcaatgtacgccgatgacaccgctgggtgggacactaggatcacactggaggatctcaaaaacgaagagatggttaccaatcatatgaagggagaacacaaaaagctggccgaggcaatttttaagttgacatatcagaacaaagtggtacgcgtgcagcgaccaactcctcggggcaccgtcatggacatcattagcagaaaggatcaaaggggttctgggcaggtgggaacgtacggcctgaataccttcacaaacatggaggctcagctcatacgccaaatggaaggcgaggggatcttcaaatcaattcagcatcttactgccaccgaagagatcgctgttcagaattggctgacaagagtgggacgggagaggttaagtcgtatggccatctccggtgacgattgcgtcgtgaagcccattgacgatcgatttgcaagcgcgctgactgccttgaacgacatgggcaaagtacgcaaggatatacagcaatgggaaccatctagagggtggaatgactggacccaggttcccttctgctcgcaccactttcatgagctcgtgatgaaggatggacgggtcctggtggtgccttgtaggaaccaggacgaactaatcggccgcgctagaatttcacagggtgccgggtggagccttaaagagacggcatgcctgggaaagtcctatgctcaaatgtggacactcatgtacttccaccggagggatctgcgattggccgcaaacgccatctgtagtgcggtcccatctcattgggttccgaccagccgtactacatggtccattcacgctaaacacgaatggatgaccactgaggacatgttagccgtgtggaatagagtatggatccaggagaacccctggatggaagacaagacccctgtggagtcatgggaagaggtcccatatctgggcaaacgcgaagatcagtggtgcggcagtctcatagggcttacatctcgggcaacgtgggccaagaatatccagaccgctattaaccaagtgaggagcctgatcggaaatgaggagtacactgactatatgccctccatgaagagatttcgccgggaagaggaagaggccggtgttctatggtga

SEQ ID NO: 14741 - RNA, 9876 nt, synthetic construct
  misc_feature 1..9876: note = derived and/or modified CDS sequence (opt3) from DENV-2__EU482608__SS-prME
  source 1..9876: mol_type = other RNA
accgccggagtgataattatgctgatacccacagctatggcattccacctcactacgagaaacggggagcctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtcctcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatctgcaagcattctatggtggatagaggctggggtaacgggtgtggactattcggcaagggcgggattgtaacctgcgccatgtttacatgcaaaaagaatatggaaggaaaagtggtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtcaaagaaattgctgagactcagcacggcaccatcgtgattagaatacagtatgagggtgacgggtctccatgcaagatccccttcgaaattacggatttggagaaaaggcatgtactcggccggctgatcaccgttaacccgatcgtgattgaaaaggactcccctgtcaacatagaggccgaacccccatttggagatagctacatcattatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtctttacatcaatagggaaggccctgcaccaggtgttcggcgctatctacggagcggcatttagtggcgttagctggactatgaaaattcttatcggggtggtaattacctggatcggaatgaactccagatctacgagcttgtcagtcagtctggtgctcgttggcgtggtcacactgtatcttggtgccatggtgcaggctgactccgggtgtgtagtgagctggaagaataaagaactgaagtgcggatctggcatattcattaccgataacgttcacacttggacagagcagtacaagtttcaacccgaatcaccaagtaaattggccagcgcaatccagaaggcccatgaggaaggtatttgtggcatcaggtccgtcacccggctcgagaatctgatgtggaaacagataactcccgagttaaaccacatcctgtctgaaaatgaggtgaagctaaccattatgacaggggacacgaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggtggaagactacggctttggtgtcttcaccacgaacatctggctcaagctgcgtgagaaacaggacgtattttgtgattctaagttaatgagcgctgccataaaagacaatcgggcagtgcacgccgatatggggtattggattgaatccgctctgaacgacacatggaagatggagaaggcctcattcatcgaggtgaaaagctgccactggcctaagtctcataccctttggtccaatggagtattggaaagtgagatgatcattcccaagaatttcgcaggccccgtcagccagcacaactaccgacctggttatcatactcaaaccgctggcccatggcacctcgggaagctggaaatggattttgacttctgtgagggaacaactgtggttgtgaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaattaggccacttaaggagaaggaagagaacttggtcaatagtctggtgaccgcgggacatggccagatagataactttagcttaggtgttctcggcatggccctgttccttgaagagatgctgcgcactcgagtggggacaaaacacgctatcttgctcgtagcagtctcgtttgtgaccctgattacgggaaatatgtccttccgggacctaggccgtgtgatggtcatggttggggccactatgaccgatgacatcggaatgggcgtgacatatctggctctcctggccgcatttaaggtaagacccaccttcgcggccggtcttttgctgaggaaattaacttctaaggagctcatgatggctacaattgggatcaccctgcttagccagtcaacaatacctgaaactatcctggagctaaccgatgccctcgcactgggaatgatggtgttgaaaattgtccgcaacatggaaaagtaccaactggctgtgacgatcatggccattagttgcgttcccaatgcagtgatcttacggaacgcctggaaggtctcctgtacaatactcgctgcggtgtctgttagcccactgcttctgacctcctcacagcagaaagccgactggattcctttggcactcactatcaagggcctgaatcccaccgctatctttctaacaactctgagcagaaccagtaaaaagaggtcttggccacttaacgaggccattatggccgtgggcatggtctccatactcgctagctcgctgttgaaaaatgacatcccgatgacggggcctctggtagcaggaggtttactcacagtgtgctatgttctgaccggccgatcagccgatcttgaactggagcgcgcggctgacgtgaagtgggaggatcaggccgaaatttctgggagttcccccatcttgagcattactatctctgaggacggaagcatgtccatcaagaacgaagaggaggaacaaacactcaccatcctgattcggactggcctactggtcatctcaggtgtgttcccagtaagtattcccatcacagcagccgcttggtacctttgggaggtgaagaagcagagagcaggggtcctctgggatgttcctagcccaccccctgtgggaaaagccgaactggaggacggcgcgtataggataaagcagcgtggcattttggggtactctcagatcggagctggtgtgtataaagaaggcacctttcacacgatgtggcatgtcactcgcggggccgtgttaatgcaccggggaaagagaatcgagccgtcctgggcagatgttaaaaaggacctgatttcatacggcggtgggtggaagctcgagggagaatggaaagagggcgaagaggtacaagtgctggcccttgaaccaggcaagaatcccagggctgtccagaccaaacctgggatcttcaagacaaacaccggaacaataggtgccgtgagtctggattttagcccaggcacttccgggtctcccattgttgaccgaaaaggaaaggtggtcggcttgtacggtaatggggtggtaacccggtcgggagcatatgtcagcgctatcgcccagacggagaagtcaattgaggataaccctgaaatcgaggacgatatattccgcaaaaagagactaacaattatggacctgcatccgggcgcgggcaaaactaagaggtacctccccgccatcgtgcgggaagcaatcaaacgagggctgagaacccttattttagctccaacacgcgttgtggccgctgagatggaagaggcactgaggggactccctatccgttatcagacccccgccattaaggccgagcacactggtcgggaaatagtcgacttgatgtgtcatgctaccttcacaatgagactgctctccccagtgagggttcctaactacaatctgatcattatggatgaggcgcactttacggaccccgcaagtatcgccgctcgcggctatatctctactcgagtggaaatgggggaggccgcaggaattttcatgaccgccacaccaccgggcagcagagatccttttccccaatccaacgctccaataatggacgaggaacgggagatccccgaaaggtcatggaactctggtcacgagtgggtcaccgatttcaaggggaaaactgtgtggtttgtacctagcattaaggcgggaaacgacatcgccgcatgccttcgcaaaaatggcaagaaagtgattcagctgagtcgtaagacattcgattccgaatacgttaagaccagagctaacgactgggattttgtcgtgacgactgacatcagcgagatgggcgccaatttcaaagcagagcgggtgatagatccaaggcgctgtatgaagcccgtcatcttgacagacggggaagaacgagtaattctagccggacctatgccggtgacccattcttcagctgcccagagacggggtaggatcggccgcaaccccaaaaatgaaaacgaccaatatatttacatgggggagcccctggaaaatgatgaggactgcgcgcactggaaggaggcaaaaatgctcttagataacatcaatacccctgaaggaataattccctccatgtttgagccagaaagagagaaggttgacgccatcgatggcgaatacaggctgcggggtgaggctcgtaaaactttcgtggaccttatgcgccgaggggatctgcctgtctggctcgcctataaggtggctgcagagggcattaactacgccgacagaaagtggtgttttgatggaatcaaaaataaccagatattggaagagaacgttgaagtggagatctggacaaaggagggcgaaaggaaaaagctgaaaccccggtggctcgacgctcgcatttatagtgatccactggcccttaaggagttcaaggagttcgcagcggggagaaaaagcctaaccctgaatttgatcacagagatgggaaggttacctacttttatgacgcagaaggcccggaacgctctggacaatctcgccgtcctgcataccgcagaagctggtggccgagcctacaaccacgcactttcggagctgccggagacactcgaaactttgctgctactgaccctccttgccacagtgaccgggggaattttcctgtttttaatgtctggcaaaggtatcgggaagatgactttgggcatgtgctgcataattacggcttccgtactgctctggtatgcgcagatccaaccccactggatcgccgcaagcattatcctggagttctttcttatagtgctgctcattccagaacctgagaaacagagaaccccacaggataatcagttgacatacgttgtcatcgctattctgactgtggtggccgccaccatggcaaacgaaatgggattcttagagaagacaaagaaagacctaggcctggggtcaatcaccactcaagagagtgaatctaatatactcgacatcgatcttcgcccagcttccgcctggacactgtatgcggtcgctacgacctttgttactcctatgttgaggcatagcattgagaactcaagtgtgaatgtaagcctgacagccatcgcaaaccaggccaccgtgctcatgggactgggtaagggctggcccctttccaaaatggacattggggtcccgctcctggctatcggatgttactctcaggtgaatccaattaccttgacagcagccctgttactactggttgcgcactacgctatcataggccctggtctccaggccaaggcaactcgggaagcccaaaaacgtgctgccgcagggattatgaagaaccccacggtggatggcatcaccgtcatcgaccttgagccaattccctatgatcctaagttcgaaaaacagctgggacaggtaatgttgctgatactctgcgtgacacaggttctgatgatgagaactacctgggctctttgtgaggccttaacactggcgaccggcccgatcagcactctctgggaggggaatcccggaaggttttggaacacgacaattgccgtgtccatggcaaatatcttccgcggctcatacttggctggtgccgggctgctattttctattatgaagaacaccactaatacccggcgaggaacaggcaacatcggtgaaactctgggcgagaaatggaagagtagactcaacgcacttgggaaatcggagttccaaatatataagaaaagcggaatccaggaggtcgacaggaccctggctaaggagggcattaagcgcggggaaacagatcatcacgccgtgtcccggggatctgccaaattgagatggtttgtcgagcgtaatatggtgacgccagaaggcaaggttgtggacctgggttgcgggaggggaggctggtcatactattgtggtggcctcaaaaacgtacgggaggtgaaggggctgaccaaaggaggccctgggcatgaagaaccaatccctatgagcacttacggatggaatttagtccgccttcagtccggcgttgatgtgttcttcacaccacccgagaagtgcgacaccctgctctgtgatattggtgaaagttctcctaacccaactatcgaggcggggcgaacactaagagtcctgaatttggtggaaaactggctgaataacaatacccaattttgcataaaggtactcaacccctatatgccgagcgtgattgagaaaatggaaacgcttcagaggaagtacggaggcgctctggttcggaatcctttgtcacgcaactccacccacgagatgtactgggtgagtaatgcaacaggcaacatcgtcagctctgtgaatatgatctccagaatgctgattaacaggttcactatgaaacacaagaaagccacctatgagccagacgtcgatctcgggtcaggaacacgaaacataggtatcgaaagcgagattcccaatttagacatcattggcaagcggatcgaaaagataaaacaggagcatgaaacttcgtggcactacgaccaggatcatccttataagacctgggcttaccacgggtcttatgagacaaaacaaaccggaagtgcctccagcatggtgaacggcgttgtacgtctgcttactaagccatgggacgtggtccccatggtgacgcagatggcaatgacagataccactccgtttggtcagcagagagttttcaaagagaaggtggacacccgcacacaagaacctaaggaggggacgaaaaggctgatgcggatcaccgccgaatggctatggaaggagctcggcaaaaagaaaactcccagaatgtgtacacgcgaggaatttaccaggaaggtccgatcaaatgctgcgctgggcgccattttcactgatgagaacaaatggaagtccgcacgggaagctgtggaggacggcagattttgggaattggtagataaggagaggaatctgcacctcgaggggaaatgcgaaacatgtgtgtacaacatgatgggaaagcgcgagaagaaacttggtgagttcggcaaagccaaagggtctcgtgcaatctggtatatgtggctgggagcccggtttttagagttcgaagctctgggctttttgaatgaggaccattggttcagcagaggtaacagtctctccggggttgagggagaaggcctgcacaggctaggctacattcttcgcgatgtcgggaagaaagagggaggtgccatgtacgcggacgataccgcaggctgggacacacgaatcactctggaagacctcaagaatgaggaaatggtgaccaaccatatgaaaggggagcacaagaaactggccgaggctatttttaagttgacgtatcagataaaggtggtccgggttcagagaccaacccctaggggaacagtgatggatatcattagccgcagagaccagcggggctctggtcaagtagggacttacggactgaataccttcacaaacatggaagcccagctcatcaggcagatggagggcgaaggcatcttcaaatcaattcaacatcttactgcaaccgaggagatagctgtgcagaattggctggcccgtgtcgggcgagaacgcttaagtagaatggctatctccggagatgactgcgtggttaagcccattgatgaccggtttgccagcgcactgacggcgttgaacgatatgggtaaagtgaggaaggacatccagcagtgggagccatctcgcggctggaatgattggacacaagtccccttctgctcgcaccactttcatgaactcgtgatgaaagacgggagagtactggttgtgccttgtcggaaccaggatgagctaattggaagggcccgaatctcacagggcgctggttggagccttaaggaaaccgcctgcctggggaagtcctatgcacagatgtggactctcatgtacttccaccgtagagacctgcgcttggctgccaacgcaatatgtagtgccgtcccatctcattgggtgccgacaagccggaccacttggtccatccacgcgaaacacgagtggatgaccacagaggatatgttagctgtgtggaatagggtctggattcaagaaaacccctggatggaggacaagacgcctgttgaatcatgggaggaagtgccatatctgggaaaaagagaggaccagtggtgcggcagtctcatcggccttacctctcgcgccacttgggcaaagaatattcagacagccatcaaccaggtacggagcctgatagggaatgaggaatacaccgattatatgccctccatgaaaaggtttcgaagagaggaagaggaagctggagtgctatggtga

SEQ ID NO: 14742 - RNA, 9876 nt, synthetic construct
  misc_feature 1..9876: note = derived and/or modified CDS sequence (opt3) from DENV-2__EU687220__SS-prME
  source 1..9876: mol_type = other RNA
accgcaggcgtgatcattatgctgatacccaccgctatggcattccacctcactacgcgaaacggggaacctcatatgatcgtcgggaggcaggaaaagggtaaaagccttctgtttaagaccgaagacggcgttaatatgtgcacattgatggcaattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagtagcgctggtgccccatgtcggtatggggcttgagaccagaacagaaacttggatgagtagcgagggagcttggaaacacgtgcagaggatcgagacctggatactgcggcatcctggcttcgccatcatggcagccattttggcttacacaatcggcaccacgcactttcagaaggcactcattttcatcctgctgactgccgttgctccatccatgacaatgcgctgcatagggatttctaacagagattttgtggaaggagtctcgggtggctcatgggtggacatcgtactcgagcacgggagctgtgttaccactatggccaagaataaacccacattagatttcgaactgattaagaccgaggcgaaacagcctgcaacgcttaggaagtattgcatcgaagccaaattgaccaacacaactaccgagagtcggtgtccaacacaaggagagccctccctgaatgaagaacaggacaagcgctttatctgcaagcattctatggtggatcgaggctggggtaacgggtgtggactattcggcaaaggcgggattgtcacttgcgctatgtttacctgcaagaaaaatatggaaggaaaggtggtgctccctgagaacctggaatacacaatagtcatcaccccacacagcggtgaggagcatgccgttggcaatgacactgggaaacacggaaaggaaattaaaatcacgccgcagtcctcaataacagaggcagaacttaccggctatggtactgtgaccatggagtgtagtcccagaacagggctggatttcaacgaaatggtattgctccagatggaggagaaggcttggctggtgcacaggcaatggtttttagacctgcctctcccatggcttcccggcgccgatacccagggaagcaattggattcagaaggaaactctggtcacattcaaaaaccctcatgcgaagaaacaggacgtggttgtgttgggctctcaagagggggccatgcacacggcactaaccggagctactgaaatccagatgtcctcaggtaatctgctctttacaggccatctgaagtgccggcttcgtatggacaaactgcagttgaaggggatgagctacagtatgtgtaccggaaagttcaaaatcgtcaaggagattgccgagacacaacacggcactatcgtgattcgcgtacagtatgaaggtgatgggtctccatgcaaaatacccttcgagatcatggacctcgaaaagagacatgttctgggcaggttaattaccgtgaacccgatcgtcacggagaaagattcccctatcaacattgaagctgagcccccatttggagacagctacataatcattggcgtggagcctgggcagctgaagctaaattggttcaagaaaggatcgtctatcggtcagatgtttgaaaccacaatgcggggcgccaagcgaatggcaattctcggggatactgcctgggacttcggatccctgggcggtgtctttacctcaatcgggaaagcacttcaccaagtgttcggcgcgatatacggagcagcctttagtggcgttagctggacaatgaagatcttgattggggtgatcattacttggatcggaatgaactcccgctctaccagcctgtcagtaagtctcgtcctggtgggcgttgtgacgctttatctgggtgctatggtccaggccgattccgggtgtgtggtaagctggaaaaataaggagttgaagtgcggatctggcatattcattacagacaacgtgcacacctggactgaacagtacaaatttcagcccgagtcaccaagtaagctcgcaagcgccatccaaaaagctcatgaagagggtatttgtggcatcagatccgttacaaggctggagaatttaatgtggaagcagataacccccgaactgaaccacatcctatctgagaatgaagtcaaactcactattatgaccggggatatcaagggaattatgcaggccggcaaacggtcgctgcgccctcagccaacagagcttaagtatagctggaagacgtgggggaaagcaaagatgttgtccaccgaatcacataaccaaactttcctgatcgacggaccggagacagcggagtgccccaataccaacagagcttggaatagtctcgaagtggaggattacggctttggtgtgttctctacaaacatatggctgaaattaagggaaaagcaggacgtcttttgtgacagcaaactgatgtccgccgcaattaaggataatcgtgccgttcacgctgacatggggtattggatcgagtcagcccttaacgatacttggaagatggagaaagccagcttcatcgaagtgaagtcttgccactggcctaaatcccataccttgtggagtaatggagtgctcgagagcgaaatgattatcccaaagaacttcgctggccccgtatctcagcacaactaccggcctggttatcatacgcagacagccggcccatggcacctggggaaactagagatggactttgatttctgtgaaggaaccactgtcgtggttaccgaggactgcggcaatcgagggccctccctgagaacaactaccgcgtcaggaaagctcattacagagtggtgctgtaggagttgcacgctgccgcctcttcgctaccggggcgaagatggttgttggtacgggatggagataagaccattgaaggaaaaagaggaaaacctggtgaatagcttagtcaccgccggacatggccaaatcgacaacttttcgctcggtgtgctgggcatggctcttttcctggaggagatgttgaggactcgcgttgggacaaagcacgcaattctcctggtggccgtatcctttgtcaccctaatcactggaaatatgtctttccgagatctgggccgggtgatggtgatggtcggggctacaatgaccgacgatattggaatgggcgttacgtatctcgccctgcttgcagcgtttaaagtgcgtcccactttcgccgctggtttgctgttaagaaagctcaccagcaaagaactgatgatggccacaatcgggatagcacttctgtcacagagtaccatccctgagactattctagaactcacagacgctctggccttgggaatgatggtactgaagatcgtgaggaacatggagaagtaccagttagcagtcaccattatggccatctcctgcgtgcccaatgctgttatactcctgaacgcgtggaaagtgtcttgtacaattcttgccgcagtcagcgtgtccccactgttgctcacttcaagccaacagaaggctgattggatccctctggccctaaccatcaaaggcctgaatcccacggccatttttcttacaaccctcagtcgcacttctaagaaacggtcctggccactgaacgaagctgttatggcagtgggcatggtcagcatattggcctcgtcactgttaaagaatgacatcccgatgaccgggcctctcgtagcgggaggtctgcttacagtgtgctatgttctgactggcagatctgctgacttggagctcgagagggccgcagatgtgaaatgggaagaccacgccgagattagtgggtccagccccatcctgtctattaccatcagcgaagatggatccatgtcaataaagaacgaggaggaagaacagacgctaacaatcctgattcgaaccggccttctcgtcatcagtggtgtgttcccagtaagcattcccatcactgctgcagcctggtacctgtgggaagtgaagaaacagcgcgcgggggtcttgtgggacgttccttctccaccccctgtgggaaaggctgagttagaagatggcgcctatcggataaaacaaagaggcattctggggtactcccagatcggagctggtgtgtataaggagggcacatttcataccatgtggcacgtcactagaggggcagtgctcatgcatcgtggaaaacgcatcgagccgtcatgggctgacgttaagaaggatctgattagttacggcggtgggtggaaacttgaaggagagtggaaggaaggcgaggaagtacaggtgctggccttggagccaggcaaaaatccccgggcagtccagacaaagcctgggctattcaaaaccaacacgggaactatcggtgctgtgagcctggacttttccccaggcacctctgggtcgcccatagttgatagaaagggaaaggtggtcggcctctacggtaatggggtggtaacaaggagcggagcctatgtctcagcgattgcccaaaccgagaaatccatcgaagacaaccctgagattgaagatgacatcttccgaaagaaacggctgacaataatggatcttcacccgggcgcaggcaagactaaacgctacttacccgctattgtgagagaggccatcaagagggggctgcggaccctcatcttggctccaacgcgagttgtggcagccgaaatggaggaggccctgagaggactccctattcgctatcagacacccgctatcagggcggaacatactggtcgtgagattgtcgacctgatgtgtcacgcaaccttcacaatgcggcttctgagtccagtgagagttcctaactacaatttgataatcatggacgaagcccactttaccgatcccgcttctattgccgcaaggggctatatcagcactcgcgtggagatgggggaggccgctggaatcttcatgaccgcgacaccaccgggctcccgagacccttttccccagtcaaacgccccaattatggatgaagagagagaaatacccgagcggtcttggaatagcggtcatgaatgggtcacggacttcaaggggaaaactgtgtggtttgtacctagtatcaaggcaggaaacgatattgctgcctgcctaaggaaaaatggcaagaaagtgatccagctgtcccgcaagaccttcgacagcgagtacgttaagacacgtgcaaacgattgggactttgtcgtgaccactgatatttctgagatgggcgccaatttcagagctgaacgggtgatcgacccaaggcgctgtatgaaacccgtcatactcacagatggggaggaacgagtaatcttagccggacctatgccggtgacccactcatccgcggcacaaagacggggtaggattggccgcaacccaaagaatgagaacgaccagtatatctacatgggggaacccctggagaatgacgaggattgcgcccattggaaagaagctaagatgcttctggacaacattaatacgcctgagggaatcatacccagtatgtttgaaccagagagagaaaaagttgatgccattgacggcgagtacaggctccggggtgaggctcgtaagactttcgtggatttgatgcgccgaggggacctgcctgtctggctcgcatatagagtggccgctgaaggcatcaactacgccgataggcggtggtgttttgacggaattaaaaataaccagatcctggaggaaaacgttgaggtggagatatggacaaaggaaggcgagcgcaagaaacttaagcccagatggctagatgcaaggatctatagcgacccactggcgttgaaagagttcaaggagttcgccgctgggcggaaatcgttaaccctgaatctcattaccgaaatgggacgactgcctacttttatgacacaaaaggccagagatgcacttgacaacctggctgtcctccacaccgccgaggccggtggacgcgcatacaatcacgctttgtctgagctgccggaaacactagagactctgctccttctgacgttattggcgaccgtgacagggggaatcttcctgtttctcatgtccggcaagggtattgggaaaatgactctgggcatgtgctgcatcataaccgccagcattcttctgtggtatgcacagatccagccccattggatcgctgcctcaattatcctcgagttctttttgatagtactgttaattccagagcctgaaaagcagaggacaccccaagataaccagctaacctacgtggttatcgccattctgactgtcgtggcagctacgatggccaatgagatgggattcctcgagaaaaccaagaaagaccttggcctggggagtatcacaactcaggaatctgagtccaacatattggacatcgatctgcggccagcgagcgcttggaccctctatgccgtggcaacaacctttgtcactcctatgctgcgtcactcaattgaaaatagtagcgttaacgtgtcccttacagccatcgctaatcaggcaacggtactcatgggactgggtaagggctggcccttgtctaagatggacattggggtgccgctgttagccatcggatgttacagccaagtcaacccaattaccctaactgcggctctgctccttctggtggcccattacgcaatcataggccctggtttgcaggccaaagctacaagagaggcccagaagagggcagctgccgggattatgaaaaatcccaccgttgatggcatcaccgtgatcgacctggaaccaattccctatgatcctaagttcgagaaacagctcggacaagtcatgctgcttatattatgcgtaacacaggtgctgatgatgcgcactacgtgggcgctctgtgaggccttgaccctggcaacaggcccgatctccactctatgggaagggaaccccggacggttttggaataccacaattgctgtttcaatggccaacatcttccgaggctcttacctggccggtgctgggctcctttttagtattatgaagaataccactaacacgagaaggggaacaggcaatatcggtgagaccctgggcgaaaagtggaaatcgcgcttgaacgccctgggaaagagcgagttccagatatataaaaagtccggaatccaggaggtggaccggactctcgccaaagaaggcattaagagaggggagaccgatcaccatgcggtctctcgtggatcagctaaactgaggtggtttgtggaacggaacatggtcacaccagagggcaaggtggttgacttaggttgcgggcgcggaggctggagctactattgtggtggccttaagaatgtgcgagaagtaaaagggctgactaagggaggccctgggcacgaggagcccatccctatgtccacctacggatggaacctcgtgagactacaaagtggcgtcgatgttttcttcacaccacccgaaaaatgcgacacgctgttgtgtgatattggtgagtctagccctaatccaaccatcgaagcagggaggactctgcgggtgctcaaccttgtcgagaattggctgaacaataacacacagttttgcataaaggtgttgaatccctatatgccgtcagtaattgagaaaatggagaccctgcagcgcaagtacggaggcgccctcgtgagaaaccctttatccaggaatagtactcacgagatgtactgggttagcaacgctacaggcaatatcgtgtcttccgtcaacatgatctcacgaatgctgattaatcggttcaccatgaagcataaaaaggccacgtatgaaccagacgtggatcttgggagcggaacccgtaacataggtatcgagtcggaaattcccaacctggacatcattggcaaaagaatcgagaagataaaacaagaacacgagacatcttggcattacgaccaggatcacccttataagacttgggcataccacgggagttatgagaccaagcagacaggatccgccagctcaatggtcaatggcgtggttcgcctactcactaaaccatgggacgtagtgcccatggtcacccagatggctatgacagataccactccgtttggtcaacagagggtgttcaaggaaaaagttgacacgcggacacaggagcctaaggaagggaccaaaaagctgatgagaatcactgcggagtggttgtggaaggagctgggcaaaaagaaaacaccccgcatgtgtacaagggaagagtttacgcgaaaggtgcggtccaacgccgcactcggcgctattttcaccgatgaaaataaatggaagtctgccagagaggcagtcgaagacagcaggttttgggagcttgtggatcgcgagcgtaacctgcatttagaaggcaaatgcgagacttgtgtatacaatatgatggggaagcgggaaaagaaactgggagagttcggtaaggccaaaggcagtagagctatctggtatatgtggttgggggccaggtttctcgagttcgaggcgctgggatttctaaacgaggaccactggttctcccgcggcaatagcctttctggtgtggaaggggagggactgcatcgactcggctacattctgcgggatgtttcaaagaaagaaggcggggcaatgtacgccgacgatacagctggatgggacaccagaatcactttggaggacctgaagaacgaagagatggtcacaaatcacatgaagggtgagcataaaaagctcgccgaagcaatttttaaacttacctatcagaacaaggtggtgagggtccaacgcccaacacctagaggcactgttatggatataatcagtcggagggaccagcgtgggtccggacaggtgggcacctacggtctgaatacgttcaccaacatggaggctcagttaattcgacaaatggaaggggagggaatcttcaaaagcatccagcacctgacagtaactgaggaaattgccgtgcagaattggttggtccgcgtgggcagagagcggctctctaggatggctatatcgggcgatgactgcgttgtgaagcccctggatgaccgctttgcctcagcactaaccgcgcttaacgatatggggaaggtcagaaaagacatccaacagtgggaaccaagccggggatggaatgattggacacaggtgcccttctgctcccaccattttcacgagctggtaatgaaggacggtagggttctcgtggtcccttgtcgaaaccaggatgaactgattggccgtgccagaatcagtcaaggggctggatggtctttgaaagagactgcctgcttaggcaagagctatgcacagatgtggaccctgatgtacttccatcgccgggacctcaggcttgctgccaacgcaatttgttccgccgtgccatcacactgggtgccgacgagtagaacaacctggtctatccacgcgaaacatgagtggatgactacagaagatatgctggctgtctggaatcgcgtttggatacaggagaacccctggatggaagacaagacccctgtggagagctgggaagaggtaccatatctaggtaagcgggaggaccagtggtgcgggtccctgatcggactcacttcaagggccacctgggccaaaaatattcaaacagccatcaaccaggtgaggagcttgattggcaatgaagagtacacggattatatgccctctatgaagagatttcggagggaagaggaagaggctggcgtcctgtggtga

SEQ ID NO: 14743 - RNA, 9876 nt, synthetic construct
  misc_feature 1..9876: note = derived and/or modified CDS sequence (opt3) from DENV-2__EU726775__SS-prME
  source 1..9876: mol_type = other RNA
accgccggagtgatcgtaatgctgattcccacggctatggcattccacctcactacgcgtaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacatcaaaggaattatgcaggctggcaagcgctcgctcagacctcaaccaaccgaactgaaatatagctggaagacttgggggaaggccaaaatgctttccacagagtcacataaccagaccttcttgatcgatggaccggaaacagcagagtgccccaatactaacagggcgtggaatagtctggaggtcgaagactacggctttggtgttttcaccacgaacatttggctcaagctgcgtgagaaacaggacgtgttttgtgattctaagttaatgagcgctgccatcaaagacaatcgggcagtgcacgccgatatggggtattggatagaatccgctctgaacgacacatggaagatggagaaggcctcattcattgaggtaaaaagctgccactggcctaagtctcataccctttggtccaatggagtcttggaaagtgagatgatcatccccaagaatttcgcaggccccgtgagccagcacaactaccgacctggttatcatactcaaaccgctggcccatggcacctcgggaagctggaaatggattttgacttctgtgagggaacaactgttgtggtcaccgaagattgcggcaatagagggccctctctaaggacaacgaccgcctccggaaaactgattactgagtggtgctgtcgctcatgcacactcccgcctctgcggtacagaggcgaggacggttgttggtacgggatggaaatcaggccacttaaggagaaggaagagaacttggtgaatagtctggttaccgcgggacatggccagattgataactttagcttaggtgtgctcggcatggccctgttccttgaagagatgctgcgcactcgagtagggacaaaacacgctatattgctcgtcgcagtgtcgtttgtgaccctgatcacgggaaatatgtccttccgggacctaggccgtgtcatggttatggtgggggccactatgaccgatgacattggaatgggcgtaacatatctggctctcctggccgcatttaaggtgagacccaccttcgcggccggtcttttgctgaggaaattaacttctaaggagctcatgatggctacaatcgggattgccctgcttagccagtcaaccatccctgaaacaatactggagctaactgatgcactcgctctgggaatgatggtcttgaaaatcgtgcgcaacatggaaaagtaccaactggccgttaccattatggcaatcagttgcgtgcccaatgccgtcattttacagaacgcttggaaggtgtcctgtacgatcctcgcggccgtttctgtgagcccactgcttctgacatcctcacagcagaaagcagactggatacctttggctctcaccattaagggcctgaatcccactgccatctttctaaccacactgagccggacaagtaaaaagagatcttggccacttaacgaggccatcatggctgtcggcatggtatccattctcgcaagctcgctgttgaaaaatgacataccgatgaccgggcctctggtggccggaggtttactcacggtttgctatgtgctgacaggcaggtcagcggatcttgaactggagcgagctgccgacgtcaagtgggaggatcaagcagaaatctctgggagttcccccattttgagcatcaccatttctgaggacggaagcatgtccatcaaaaacgaagaggaggaacagactctcacaatactgatccgcaccggcctactggtgatttcaggtgtattcccagtgagtatccccattactgccgctgcatggtacctttgggaggtcaagaagcagcgggccggggttctctgggatgtgcctagcccaccccctgtgggaaaagcggaactggaggacggcgcttatagaatcaagcagaggggcatattggggtactctcaaattggagccggtgtctataaagaaggcacatttcacaccatgtggcatgtgacgcgtggggcagttttaatgcaccgcggaaagcggatcgagccgtcctgggccgatgtcaagaaggacctgatctcatacggcggtgggtggaagctcgagggagaatggaaagagggcgaagaggtgcaggtcctggctcttgaaccaggcaagaatcccagagccgtgcagactaaacctgggattttcaggaccaacacaggaaccatcggtgcaataagtctggattttagcccaggcacatccgggtctcccattgttgaccgaaagggaaaagtggtcggcttgtacggtaatggggtggtaactcggtcgggagcttatgtcagcgccatcgcgcagaccgagaagtcaattgaggataaccctgaaatcgaggacgatatattccgcaagaaaagactaacgattatggacctgcatccgggcgccggcaagacaaaaaggtacctccccgcaatcgtgcgggaagctatcaagcgagggctgagaactcttattttagccccaacccgcgttgtggctgcagagatggaagaggccctgaggggactccctatccgttatcaaacacccgccattaaagctgagcacaccggtcgggaaatagtcgacttgatgtgtcatgcgactttcaccatgagactgctctccccagtgagggttcctaactacaatctgatcattatggatgaggcacactttacagaccccgccagtatcgctgcccgcggctatatctctacgcgagtggaaatgggggaggcagccggaattttcatgactgctaccccaccgggcagcagagatccttttccccagtccaacgcgccaataatggacgaggaacgggagatccccgaaaggtcatggaactctggtcacgagtgggtcacagatttcaaggggaagaccgtgtggtttgtacctagcattaaagccggaaacgacatcgcagcttgccttcgcaagaatggcaaaaaggtgattcagctgagtcgtaaaactttcgattccgaatacgttaagacaagagccaacgactgggattttgtcgtgaccacggacatcagcgagatgggcgcaaatttcaaggccgagcgggtgatagatccaaggcgctgtatgaaacccgtcatcttgactgacggggaagaacgagtaattctagctggacctatgccggtgacacattcttcagccgcgcaaagacggggtaggatcggccgcaacccaaagaatgaaaacgaccagtatatttacatgggggagcccctggaaaatgatgaggactgcgcacactggaaagaggccaagatgctcttagataacatcaatacccctgaaggaataattccctccatgtttgagccagaaagagagaaagttgacgctatcgatggcgaatacaggctgcggggtgaggcccgtaagaccttcgtggaccttatgcgccgaggggatctgcctgtctggctcgcttataaagtggcagccgagggcattaactacgctgacagaaagtggtgttttgatggaatcaagaataaccagatattggaagagaacgttgaagtggagatctggactaaagagggcgaaaggaagaaactgaagccccggtggctcgacgcccgcatttatagtgatccactggcacttaaagagttcaaggagttcgcggccgggagaaagagcctaacactgaatttgatcaccgagatgggaaggttacctacatttatgactcagaaagctcggaacgccctggacaatctcgcagtcctgcatacggctgaagccggtggccgagcatacaaccacgccctttcggagctgccggagaccctcgaaacattgctgctactgactctccttgctaccgtgacagggggaattttcctgtttttaatgtctggcaagggtatcgggaaaatgaccttgggcatgtgctgcataattactgcgtccatcctgctctggtatgcccaaatccagccccactggattgcagctagcatcatactggagttctttcttattgtactgctcatcccagaacctgagaagcagagaacgccccaggataatcaattgacctacgtggttattgccatcctgacagtcgtggccgcaactatggctaacgaaatgggattcttagagaaaaccaagaaggacctaggcctggggtcaataacaacccaggagagtgaatctaatatcctcgacattgatcttcgcccagcctccgcgtggactctgtatgctgtggccacaacgtttgtcacccctatgttgaggcatagcatcgagaactcaagtgttaatgtgagcctgactgcaattgccaaccaggctacagtactcatgggactgggtaaaggctggcccctttccaagatggacatcggggtgccgctcctggcaattggatgttactctcaggtcaatccaatcaccttgaccgccgcgctgttactactggtggctcactacgccataattggccctggtctccaagcaaaagccacacgggaagctcagaagcgtgccgcagctgggatcatgaaaaaccccactgttgatggcatcacggtgattgaccttgagccaataccctatgatcctaagttcgaaaagcagctgggacaggtcatgttgctgatcctctgcgtaacccaagtgctgatgatgagaacaacttgggccctttgtgaggcgttaaccctggccacaggcccgattagcaccctctgggaggggaatcccggaaggttttggaacactacgatcgcagtttccatggctaatattttccgcggctcatacttggccggtgcagggctgctattttctatcatgaaaaacacaaccaatactcggcgaggaaccggcaacataggtgaaacactgggcgagaagtggaaaagtagactcaacgctcttgggaagtcggagttccagatctataaaaagagcggcattcaggaggtggacaggactctggccaaagagggcatcaagcgcggggaaaccgatcatcacgccgtctcccggggatctgcgaagttgagatggtttgtggagcgtaatatggtcacaccagaaggcaaagtggttgacctgggttgcgggaggggaggctggtcatactattgtggtggcctcaagaacgtgcgggaggtaaaagggctgacgaagggaggccctgggcatgaagaaccaattcctatgagcacctacggatggaatttagtgcgccttcaatccggcgtcgatgttttcttcactccacccgagaaatgcgacacactgctctgtgatatcggtgaaagttctcctaacccaaccatagaggctgggcgaactctaagagtgctgaatttggtcgaaaactggctgaataacaatacacagttttgcattaaggtgctcaacccctatatgccgagcgtaatcgagaagatggaaacccttcagaggaaatacggaggcgcactggtgcggaatcctttgtcacgcaactccacgcacgagatgtactgggttagtaatgccaccggcaacatcgtgagctctgtcaatatgatttccagaatgctgataaacaggttcacaatgaagcacaaaaaggctacttatgagccagacgtggatctcgggtcaggaacccgaaacatcggtattgaaagcgagatccccaatttagacattatcggcaaacggatagaaaagatcaagcaggagcatgaaacatcgtggcactacgaccaagatcatccttataaaacttgggcctaccacgggtcttatgagaccaagcagacaggaagtgcatccagcatggtcaacggcgtggttcgtctgcttaccaaaccatgggacgtagtgcccatggtcactcagatggccatgacggatacaaccccgtttggtcagcaaagagtgttcaaggagaaagttgacactcgcacccaggaacctaaggaggggacaaagaaactgatgaagattacggctgaatggctatggaaagagctcggaaagaaaaagacccccaggatgtgtactcgggaggaatttacaagaaaagtgcgctcaaatgcggccctgggcgcaatcttcaccgatgagaacaagtggaagtccgctagggaagccgtcgaggacggccgattttgggaattggtggatcgggagagaaatctgcacctcgaggggaaatgcgaaacttgtgtatacaacatgatgggaaagagggagaagaaacttggtgagttcggcaaagcaaaagggtctcgcgccatttggtatatgtggctgggagctagatttttagagttcgaagccctgggctttttgaatgaggaccattggttcagccggggtaacagtctctccggggtggagggagaaggcctgcacagactaggctacatccttagggatgttgggaagaaagagggaggtgcgatgtacgcagacgatacagccggctgggacacccgcattacactggaagacctcaagaatgaggaaatggtcactaaccatatgaaaggggagcacaagaaactggctgaggccatatttaagttgacctatcagaataaggtggtgcgagtccagcggccaacgcctagaggaaccgttatggatatcattagcaggcgcgaccaaagaggctctggtcaggtggggacatacggactgaacactttcaccaatatggaagcacagctcatccggcaaatggagggcgaaggcatcttcaggtcaattcagcatcttacagctactgaggagatagccgtacagaactggctggctcgtgtggggcgagaacgcttaagtagaatggccatctccggagatgactgcgtcgtgaaacccattgatgaccggtttgcaagcgcgctgaccgccttgaatgatatgggtaaggttaggaaagacatccagcaatgggagccatctcgcggctggaacgattggacacaggtgcccttctgctcgcaccactttcatgaactcgtcatgaaggacgggagagtgctggtagttccttgtcggaaccaggatgagctaattggaagggctcgaatctcacagggcgccggttggagccttaaagaaacagcatgcctggggaagtcctatgctcaaatgtggaccctcatgtacttccaccgtagagacctgcgcttggccgcaaatgccatatgtagtgcggtgccatctcattgggtcccgactagccggacaacctggtccatccacgctaagcacgagtggatgactaccgaggatatgttagccgtgtggaacagggtgtggattcaggaaaatccctggatggaggacaaaacacctgtcgaatcatgggaggaagttccatatctgggaaagagagaggaccagtggtgcggcagtctcatcggccttacgtctcgcgcaacctgggccaaaaacattcagactgctatcaatcaagtgcggagcctgatagggaacgaggaatacacagattatatgccctccatgaagaggtttcgaagagaggaagaggaagccggagtactatggtga

SEQ ID NO: 14744 - RNA, 9876 nt, synthetic construct
  misc_feature 1..9876: note = derived and/or modified CDS sequence (opt3) from DENV-2__FJ639732__SS-prME
  source 1..9876: mol_type = other RNA
accgccggagtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgatcgaaaaggactcccctgtcaacatcgaggccgaacccccatttggagatagctacattataatcggcgtggagcctgggcagttaaaactgaattggttcaagaagggatcgtctattggtcaaatgtttgagacaactatgcgaggcgctaaacgcatggccatcctaggggacaccgcatgggatttcggatccctcggcggtgtttttacatcaattgggaaggccctgcaccaggtgttcggcgctatctacggagcggcatttagtggcgtaagctggactatgaaaatacttatcggggtcgtgattacctggatcggaatgaactccagatctacgagcttgtcagttagtctggtgctcgtcggcgtggtaacactgtatcttggtgccatggtgcaggctgactccgggtgtgttgtcagctggaagaataaagaactgaagtgcggatctggcattttcatcaccgataacgtgcacacttggacagagcagtacaagtttcaacccgaatcaccaagtaaattggccagcgcaatacagaaggcccatgaggaaggtatttgtggcatcaggtccgtgacccggctcgagaatctgatgtggaaacagattactcccgagttaaaccacatcctgtctgaaaatgaggtcaagctaaccataatgacaggggacacgaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggttgaagactacggctttggtgtgttcaccacgaacatctggctcaagctgcgtgagaaacaggacgtgttttgtgattctaagttaatgagcgctgccgtaaaagacaatcgggcagtccacgccgatatggggtattggattgaatccgctctgaacgacacatggaagatggagaaggcctcattcatcgaggtgaaaagctgccactggcctaagtctcataccctttggtccaatggagttttggaaagtgagatgataattcccaagaatttcgcaggccccgtgagccagcacaactaccgacctggttatcatactcaaaccgctggcccatggcacctcgggaagctggaaatggattttgacttctgtgagggaacaactgtcgtggttaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaatcaggccacttaaggagaaggaagagaacttggtgaatagtctggtaaccgcgggacatggccagattgataactttagcttaggtgtcctcggcatggccctgttccttgaagagatgctgcgcactcgagtggggacaaaacacgctatcttgctcgtggcagtctcgtttgttaccctgattacgggaaatatgtccttccgggacctaggccgtgtgatggtaatggtgggggccactatgaccgatgacataggaatgggcgtcacatatctggctctcctggccgcatttaaggtgagacccaccttcgcggccggtcttttgctgaggaaattaacttctaaggagctcatgatggctacaatcgggattaccctgcttagccagtcaacaatccctgaaactattctggagctaaccgatgccctcgcactgggaatgatggttttgaaaatcgtgcgcaacatggaaaagtaccaactggctgtcacgataatggccatcagttgcgtgcccaatgcagttattttacggaacgcctggaaggtgtcctgtacaatcctcgctgcggtctctgtaagcccactgcttctgacctcctcacagcagaaagccgactggattcctttggcactcactatcaagggcctgaatcccaccgctatatttctaacaactctgagcagaaccagtaaaaagaggtcttggccacttaacgaggccattatggccgtgggcatggtttccatcctcgctagctcgctgttgaaaaatgacatcccgatgacggggcctctggtggcaggaggtttactcacagtctgctatgtgctgaccggccgatcagccgatcttgaactggagcgcgcggctgacgtaaagtgggaggatcaggccgaaatttctgggagttcccccatattgagcatcactatttctgaggacggaagcatgtccatcaaaaacgaagaggaggaacaaacactcaccattctgatccggactggcctactggtgatatcaggtgtcttcccagttagtatccccattacagcagccgcttggtacctttgggaggtgaagaagcagagagcaggggtgctctgggatgtccctagcccaccccctgtgggaaaagccgaactggaggacggcgcgtataggatcaagcagcgtggcattttggggtactctcagatcggagctggtgtttataaagaaggcacctttcacacgatgtggcatgtaactcgcggggccgtgttaatgcaccggggaaagagaatagagccgtcctgggcagatgtcaaaaaggacctgatttcatacggcggtgggtggaagctcgagggagaatggaaagagggcgaagaggtgcaagttctggcccttgaaccaggcaagaatcccagggctgtgcagaccaaacctgggatcttcaagacaaacaccggaacaatcggtgccgtcagtctggattttagcccaggcacttccgggtctcccattgtggaccgaaaaggaaaggtagtcggcttgtacggtaatggggtggttacccggtcgggagcatatgtgagcgctatcgcccagacggagaagtcaatagaggataaccctgaaattgaggacgatatcttccgcaaaaagagactaacaattatggacctgcatccgggcgcgggcaaaactaagaggtacctccccgccatcgtccgggaagcaataaaacgagggctgagaacccttattttagctccaacacgcgtggttgccgctgagatggaagaggcactgaggggactccctatccgttatcagacccccgccatcaaggccgagcacactggtcgggaaattgtggacttgatgtgtcatgctaccttcacaatgagactgctctccccagtcagggtgcctaactacaatctgatcattatggatgaggcgcactttacggaccccgcaagtatagccgctcgcggctatatctctactcgagtagaaatgggggaggccgcaggaattttcatgaccgccacaccaccgggcagcagagatccttttccccaatccaacgctccaatcatggacgaggaacgggagatccccgaaaggtcatggaactctggtcacgagtgggtgaccgatttcaaggggaaaactgtttggtttgtccctagcattaaggcgggaaacgacatagccgcatgccttcgcaaaaatggcaagaaagtgatccagctgagtcgtaagacattcgattccgaatacgtgaagaccagagctaacgactgggattttgtcgtaacgactgacattagcgagatgggcgccaatttcaaagcagagcgggtgatcgatccaaggcgctgtatgaagcccgttattttgacagacggggaagaacgagtgatcctagccggacctatgccggtcacccattcttcagctgcccagagacggggtaggataggccgcaaccccaagaatgaaaacgaccaatatatctacatgggggagcccctggaaaatgatgaggactgcgcgcactggaaggaggcaaaaatgctcttagataacattaatacccctgaaggaatcattccctccatgtttgagccagaaagagagaaggtggacgccatcgatggcgaatacaggctgcggggtgaggctcgtaaaactttcgttgaccttatgcgccgaggggatctgcctgtgtggctcgcctataaggtcgctgcagagggcataaactacgccgacagaaagtggtgttttgatggaattaaaaataaccagatcttggaagagaacgtggaagtagagatttggacaaaggagggcgaaaggaaaaagctgaaaccccggtggctcgacgctcgcatctatagtgatccactggcccttaaggagttcaaggagttcgcagcggggagaaaaagcctaaccctgaatttgataacagagatgggaaggttacctacttttatgacgcagaaggcccggaacgctctggacaatctcgccgtgctgcataccgcagaagctggtggccgagcctacaaccacgcactttcggagctgccggagacactcgaaactttgctgctactgaccctccttgccacagttaccgggggaatcttcctgtttttaatgtctggcaaaggtattgggaagatgactttgggcatgtgctgcatcattacggcttccgtcctgctctggtatgcgcagatccaaccccactggatagccgcaagcattatcctggagttctttcttatcgtgctgctcattccagaacctgagaaacagagaaccccacaggataatcagttgacatacgtggtcatcgctatactgactgttgtggccgccaccatggcaaacgaaatgggattcttagagaagacaaagaaagacctaggcctggggtcaattaccactcaagagagtgaatctaatatcctcgacattgatcttcgcccagcttccgcctggacactgtatgcggtagctacgacctttgtgactcctatgttgaggcatagcatcgagaactcaagtgtcaatgtgagcctgacagccatagcaaaccaggccaccgttctcatgggactgggtaagggctggcccctttccaaaatggacatcggggtgccgctcctggctattggatgttactctcaggtcaatccaatcaccttgacagcagccctgttactactggtagcgcactacgctattatcggccctggtctccaggccaaggcaactcgggaagcccaaaaacgtgctgccgcagggattatgaagaaccccacggtggatggcatcaccgttatagaccttgagccaattccctatgatcctaagttcgaaaaacagctgggacaggtgatgttgctgatcctctgcgtcacacaggtgctgatgatgagaactacctgggctctttgtgaggccttaacactggcgaccggcccgatcagcactctctgggaggggaatcccggaaggttttggaacacgacaattgccgtctccatggcaaatatattccgcggctcatacttggctggtgccgggctgctattttctatcatgaagaacaccactaatacccggcgaggaacaggcaacattggtgaaactctgggcgagaaatggaagagtagactcaacgcacttgggaaatcggagttccaaatctataagaaaagcggcattcaggaggtggacaggaccctggctaaggagggcatcaagcgcggggaaacagatcatcacgccgtttcccggggatctgccaaattgagatggtttgtggagcgtaatatggtaacgccagaaggcaaggtggtcgacctgggttgcgggaggggaggctggtcatactattgtggtggcctcaaaaacgttcgggaggtgaaggggctgaccaaaggaggccctgggcatgaagaaccaatacctatgagcacttacggatggaatttagtccgccttcagtccggcgtggatgtattcttcacaccacccgagaagtgcgacaccctgctctgtgatatcggtgaaagttctcctaacccaactattgaggcggggcgaacactaagagtgctgaatttggttgaaaactggctgaataacaatacccaattttgcatcaaggtgctcaacccctatatgccgagcgtcattgagaaaatggaaacgcttcagaggaagtacggaggcgctctggtgcggaatcctttgtcacgcaactccacccacgagatgtactgggtcagtaatgcaacaggcaacatcgtgagctctgttaatatgatatccagaatgctgattaacaggttcactatgaaacacaagaaagccacctatgagccagacgtagatctcgggtcaggaacacgaaacatcggtatcgaaagcgagattcccaatttagacataatcggcaagcggattgaaaagatcaaacaggagcatgaaacttcgtggcactacgaccaggatcatccttataagacctgggcttaccacgggtcttatgagacaaaacaaaccggaagtgcctccagcatggtgaacggcgtcgtgcgtctgcttactaagccatgggacgttgtgcccatggtcacgcagatggcaatgacagataccactccgtttggtcagcagagagtgttcaaagagaaggtagacacccgcacacaagaacctaaggaggggacgaaaaagctgatgaggattaccgccgaatggctatggaaagagctcggaaagaaaaagactccccggatgtgtacaagagaggaatttacccgcaaagtgaggtcaaatgctgcgctgggcgccatcttcactgatgagaacaagtggaagtccgcacgagaagctgttgaggacggccggttttgggaattggtcgatagagagaggaatctgcacctcgaggggaaatgcgaaacatgtgtgtacaacatgatgggaaagcgcgagaagaaacttggtgagttcggcaaagccaaagggtctcgtgcaatatggtatatgtggctgggagcccggtttttagagttcgaagctctgggctttttgaatgaggaccattggttcagcagaggtaacagtctctccggggtggagggagaaggcctgcacaggctaggctacatccttcgcgatgtcgggaagaaagagggaggtgccatgtacgcggacgataccgcaggctgggacacacgaattactctggaagacctcaagaatgaggaaatggttaccaaccatatgaaaggggagcacaagaaactggccgaggctatctttaagttgacgtatcagaataaggtggtacgggtgcagagaccaacccctaggggaacagtcatggatattatcagccgcagagaccagcggggctctggtcaagtggggacttacggactgaacaccttcacaaatatggaagcccagctcattaggcagatggagggcgaaggcatattcaaatcaatccaacatcttactgcaaccgaggagattgctgttcagaactggctggcccgtgtggggcgagaacgcttaagtagaatggctatctccggagatgactgcgtcgtgaagcccatcgatgaccggtttgccagcgcactgacggcgttgaatgatatgggtaaagtaaggaaggacattcagcagtgggagccatctcgcggctggaacgattggacacaagttcccttctgctcgcaccactttcatgaactcgtgatgaaagacgggagagtcctggtggtgccttgtcggaaccaggatgagctaataggaagggcccgaatctcacagggcgctggttggagccttaaggaaaccgcctgcctggggaagtcctatgcacagatgtggactctcatgtacttccaccgtagagacctgcgcttggctgccaatgcaatttgtagtgccgtcccatctcattgggttccgacaagccggaccacttggtccatccacgcgaaacacgagtggatgaccacagaggatatgttagctgtgtggaacagggtatggattcaagaaaatccctggatggaggacaagacgcctgtggaatcatgggaggaagtcccatatctgggaaaaagagaggaccagtggtgcggcagtctcatcggccttacctctcgcgccacttgggcaaagaacatacagacagccatcaatcaggtgcggagcctgattgggaacgaggaatacaccgattatatgccctccatgaaaaggtttcgaagagaggaagaggaagctggagttctatggtga

SEQ ID NO: 14745 - RNA, 9876 nt, synthetic construct
  misc_feature 1..9876: note = derived and/or modified CDS sequence (opt3) from DENV-2__FJ639733__SS-prME
  source 1..9876: mol_type = other RNA
accgcaggcgtgatcattatgctgatacccactgctatggcattccacctcactacgcgtaacggggaacctcatatgatcgtcggaaggcaggaaaagggtaaaagccttctgtttaagaccgaggacggcgttaatatgtgcaccttgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtcctcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttatctgcaagcattctatggtggatagaggctggggtaacgggtgtggactattcggcaagggcgggattgtaacctgcgccatgtttacatgcaaaaagaatatggaaggaaaagtggtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtcaaagaaattgctgagactcagcacggcaccatcgtgattagagtacagtatgagggtgacgggtctccatgcaagatacccttcgaaatcacggatttggagaaaaggcatgttctcggccggctgattaccgtgaacccgatcgtcatcgaaaaggactcccctgtgaacattgaggccgaacccccatttggagatagctacataatcattggcgtcgagcctgggcagttaaaactgaattggttcaagaagggatcgtctatcggtcaaatgtttgaggctacaatgcgaggcgccaaacgcatggcaattctaggggacactgcctgggatttcggatccctcggcggtgcttttacctcaatcgggaaggcgctgcaccaggtgttcggcgcaatatacggagccgcttttagtggcgttagctggacaatgaaaatccttattggggtggtaatcacttggattggaatgaactccagatctaccagcttgtcagtcagtctggtgctcgttggcgtggtcacgctgtatcttggtgccatggtgcaggcagactccgggtgtgtagtgagctggaagaataaagaactgaagtgcggatctggcatcttcataacagataacgttcacacctggactgagcagtacaagtttcaacccgaatcaccaagtaaattggccagcgctattcagaaggcccatgaggaaggtatctgtggcattaggtccgtcacacggctcgagaatctgatgtggaaacagatcacccccgagttaaaccacatactgtctgaaaatgaggtgaagctaactatcatgaccggggacacaaaaggaattatgcaggcaggcaagcgctcgctcagacctcaaccaacggaactgaaatatagctggaagacctgggggaaggcgaaaatgctttccactgagtcacataaccagacattcttgatcgatggaccggaaaccgctgagtgccccaatacaaacagggcctggaatagtctggaggtggaagactacggctttggtgtcttcactaccaacatttggctcaagctgcgtgagaaacaggacgtattttgtgattctaagttaatgagcgcagccatcaaagacaatcgggctgtgcacgccgatatggggtattggatagaatccgcactgaacgacacgtggaagatggagaaggcttcattcattgaggtgaaaagctgccactggcctaagtctcatacactttggtccaatggagtattggaaagtgagatgatcatccccaagaacttcgccggccccgtcagccagcacaactaccgacctggttatcatacccaaactgcgggcccatggcacctcgggaagctggaaatggattttgacttctgtgagggaaccacagtggttgtgactgaagattgcggcaatagagggccctctctaaggaccacaacggcctccggaaaactgattaccgagtggtgctgtcgctcatgcactctcccgcctctgcggtacagaggcgaggacggttgttggtacgggatggaaatcaggccacttaaggagaaggaagagaacttggtcaatagtctggtgacagctggacatggccagattgataactttagcttaggtgttctcggcatggcactgttccttgaagagatgctgcgcacccgagtggggactaaacacgccatattgctcgtagctgtctcgtttgtgacactgatcaccggaaatatgtccttccgggacctaggccgtgtgatggtcatggttggggccacgatgactgatgacattggaatgggcgtgacctatctggcactcctggcggcctttaaggtaagacccacattcgctgccggtcttttgctgaggaaattaacctctaaggagctcatgatggcaactatcgggattacactgcttagccagtcaaccatccctgaaacaatactggagctaactgatgctctcgccctgggaatgatggtgttgaaaatcgtccgcaagatggaaaagtaccaactggcagtgaccattatggccatcagttgcgttcccaacgctgtgattttacggaatgcgtggaaagtctcctgtacgatcctcgccgcagtgtctgttagcccactgcttctgacatcctcacagcagaaggctgactggatacctttggccctcaccattaaaggcctgaaccccactgccatctttctaaccacactgagcagaacaagtaagaaaaggtcttggccacttaatgaggctatcatggcagtgggcatggtctccattctcgccagctcgctgttgaagaacgacataccgatgaccgggcctctggtagcgggaggtttactcacggtgtgctatgttctgacaggccgatcagctgatcttgaactggagcgcgccgcagacgtgaaatgggaggatcaggccgaaatctctgggagttcccccattttgagcatcaccatttctgaggacggaagcatgtccatcaagaatgaagaggaggaacaaactctcacaatactgatccggaccggcctactggtcatttcaggtgtgttcccagtaagtatccccattactgctgcagcctggtacctttgggaggtgaagaaacagagagcgggggtcctctgggatgttcctagcccaccccctgtgggaaaggctgaactggaggacggcgcctataggatcaaacagcgtggcatattggggtactctcagattggagccggtgtgtataaggaaggcacatttcacaccatgtggcatgtcacgcgcggggcagtgttaatgcaccggggaaaaagaatcgagccgtcctgggctgatgttaagaaggacctgatctcatacggcggtgggtggaaactcgagggagaatggaaggagggcgaagaggtacaagtgctggcccttgaaccaggcaaaaaccccagggcagtccagactaagcctgggattttcaaaaccaatacaggaaccatcggtgctgtgagtctggattttagcccaggcacatccgggtctcccatagttgaccgaaagggaaaggtggtcggcttgtacggtaacggggtggtaactcggtcgggagcctatgtcagcgcgattgcccagaccgagaaatcaatcgaggataatcctgaaattgaggacgatatcttccgcaagaaaagactaacgataatggacctgcatccgggcgcaggcaagacaaaaaggtacctccccgctattgtgcgggaagccatcaagcgagggctgagaactcttatcttagctccaacccgcgttgtggcagccgagatggaagaggccctgaggggactccctattcgttatcagacacccgctatcaaggcggagcacaccggtcgggaaattgtcgacttgatgtgtcatgcaactttcaccatgagactgctctccccagtgagggttcctaactacaacctgataatcatggatgaggcccactttacagaccccgctagtattgccgcacgcggctatatctctacgcgagtggaaatgggggaggccgctggaatcttcatgactgcgaccccaccgggcagcagagatccttttccccaatccaatgccccaattatggacgaggaacgggagatacccgaaaggtcatggaactctggtcacgagtgggtcacagatttcaaagggaagaccgtgtggtttgtacctagcatcaaagcaggaaatgacattgctgcctgccttcgcaagaacggcaaaaaggtgatccagctgagtcgtaagactttcgattccgaatacgttaaaacaagagcaaatgactgggattttgtcgtgaccacggacattagcgagatgggcgccaacttcaaggctgagcgggtgatcgatccaaggcgctgtatgaaacccgtcatattgactgacggggaagaacgagtaatcctagccggacctatgccggtgacacattcttcagcggcacagagacggggtaggattggccgcaatccaaagaacgaaaatgaccaatatatctacatgggggagcccctggaaaacgatgaggactgcgcccactggaaagaggctaagatgctcttagataatattaacacccctgaaggaatcataccctccatgtttgagccagaaagagagaaagttgacgccattgatggcgaatacaggctgcggggtgaggctcgtaagaccttcgtggaccttatgcgccgaggggatctgcctgtctggctcgcatataaggtggccgctgagggcatcaattacgccgacagaaaatggtgttttgatggaattaagaacaatcagatcttggaagagaacgttgaagtggagatatggactaaagagggcgaaaggaagaaactgaagccccggtggctcgacgcacgcatctatagtgatccactggcgcttaaggagttcaaagagttcgccgctgggagaaagagcctaacactgaacttgattaccgagatgggaaggttacctacatttatgactcagaaagcccggaatgcactggacaacctcgctgtcctgcatacggccgaagccggtggacgagcatacaatcacgctctttcggagctgccggagaccctcgaaacattgctgctactgactctccttgcgaccgtgacagggggaatcttcctgtttttaatgtctggcaagggtattgggaaaatgaccttgggcatgtgctgcatcataactgcctccgtactgctctggtatgcacagattcaaccccactggatcgctgccagcatcattctggagttctttcttatcgtgctgctcataccagaacctgagaagcagagaacgccccaggataaccagttgacctacgttgtcattgccatcctgacagtggtggcagctactatggccaatgaaatgggattcttagagaagaccaaaaaggacctaggcctggggtcaattacaacccaagagagtgaatctaacatcctcgacatagatcttcgcccagcgtccgcttggactctgtatgccgtcgcaacaacgtttgttacccctatgttgaggcatagcatcgaaaattcaagtgtgaacgtaagcctgactgccattgctaatcaggcaacagtgctcatgggactgggtaaaggctggcccctttccaagatggacatcggggtcccgctcctggccattggatgttactctcaggtgaacccaatcaccttgaccgcggctctgttactactggttgcccactacgcaattatcggccctggtctccaggccaaagctacacgggaagcccaaaagcgtgcagctgccgggataatgaagaatcccactgtggatggcattacggtcatcgaccttgagccaatcccctatgatcctaaattcgaaaagcagctgggacaggtaatgttgctgattctctgcgtgacccaggttctgatgatgagaacaacttgggcgctttgtgaggccttaaccctggcaacaggcccgataagcaccctctgggaggggaaccccggaaggttttggaatactacgatcgctgtgtccatggccaacattttccgcggctcatacttggccggtgctgggctgctattttctatcatgaaaaatacaaccaacactcggcgaggaaccggcaatattggtgaaacactgggcgagaagtggaaaagtagactcaacgcccttgggaagtcggagttccaaatctataaaaagagcggaatacaggaggtcgacaggactctggccaaggagggcatcaaacgcggggaaaccgatcatcacgcggtgtcccggggatctgctaagttgagatggtttgtcgagcgtaacatggtgacaccagaaggcaaagttgtggacctgggttgcgggaggggaggctggtcatactattgtggtggcctcaagaatgtacgggaggtgaaagggctgacgaagggaggccctgggcatgaagaaccaattcctatgagcacctacggatggaacttagtccgccttcagtccggcgttgatgtgttcttcactccacccgagaagtgcgacacactgctctgtgatatcggtgaaagttctcctaatccaaccattgaggcagggcgaactctaagagtcctgaacttggtggaaaattggctgaacaataacacacaattttgcatcaaagtactcaatccctatatgccgagcgtgatagagaagatggaaacccttcagaggaaatacggaggcgccctggttcggaaccctttgtcacgcaattccacgcacgagatgtactgggtgagtaacgctaccggcaatattgtcagctctgtgaacatgatctccagaatgctgatcaataggttcacaatgaagcacaaaaaggccacttatgagccagacgtcgatctcgggtcaggaacccgaaacattggtatagaaagcgagatccccaacttagacattatcggcaagcggattgagaagatcaagcaggagcatgaaacatcgtggcactacgaccaggatcatccttataaaacttgggcataccacgggtcttatgagaccaagcaaacaggaagtgcctccagcatggtgaatggcgttgtacgtctgcttaccaaaccatgggacgtggtccccatggtgactcagatggctatgacggatacaaccccgtttggtcagcagagagttttcaaggagaaggtggacactcgcacccaagaacctaaagaggggacaaagaaactgatgaggataacggcggaatggctatggaaggagctcggcaaaaagaaaacaccccggatgtgtactagagaggaatttacacgcaaggtcaggtcaaacgccgcactgggcgctatcttcaccgatgagaataagtggaaatccgcccgagaagcagtggaggacggccggttttgggaattggtagataaggagagaaacctgcacctcgaggggaaatgcgaaacttgtgtgtacaatatgatgggaaagagggagaagaaacttggtgagttcggcaaagccaaagggtctcgcgctatttggtatatgtggctgggagccagatttttagagttcgaagcgctgggctttttgaacgaggaccattggttcagccggggtaatagtctctccggggttgagggagaaggcctgcacagactaggctacatccttagggatgtcgggaagaaagagggaggtgcaatgtacgccgacgatacagctggctgggacacccgcattacactggaagacctcaagaacgaggaaatggtgactaatcatatgaaaggggagcacaagaagctggccgaggcaatctttaaattgacctatcagaacaaggtggtccgagttcagcggccaacgcctagaggaaccgtgatggatattataagcaggcgcgaccagagaggctctggtcaagtagggacatacggactgaatactttcaccaacatggaagctcagctcatccggcagatggagggcgaaggcattttcaaatcaatccaacatcttacagccactgaggagatcgctgtgcagaattggctggccagggtcgggcgtgaacgattaagtcgcatggcaatttccggagatgactgcgtggttaagcccatagatgacagatttgcgagcgccctgaccgctttgaacgatatgggtaaagtgcggaaggacatccagcagtgggagccatctaggggctggaatgattggacgcaagtccccttctgctcgcaccactttcatgaactcgtgatgaaggacgggcgcgtactggttgtgccttgtagaaaccaggatgagctaattggacgggccaggatctcacagggcgcaggttggagccttaaagaaacagcttgcctggggaagtcctatgcccagatgtggaccctcatgtacttccaccgacgtgacctgagattggcagccaacgcgatttgtagtgctgtcccatctcattgggtgccgactagccgcacaacctggtccatccacgccaaacacgagtggatgactaccgaggatatgttagcagtgtggaatcgggtctggatacaagaaaacccctggatggaggacaagacacctgttgaatcatgggaggaagtgccatatctgggaaaaagggaggaccagtggtgcggcagtctcatcggccttacgtctagagccacctgggctaagaatattcagactgccatcaaccaggtacgcagcctgattgggaatgaggaatacacagattatatgccctccatgaagcggtttaggcgagaggaagaggaagcaggagtgctatggtga

SEQ ID NO: 14746 - RNA, 9876 nt, synthetic construct
  misc_feature 1..9876: note = derived and/or modified CDS sequence (opt3) from DENV-2__FJ639734__SS-prME
  source 1..9876: mol_type = other RNA
accgccggcgtgatcgtcatgctgattcccacagctatagcattccacctcactacgagaaacggggagcctcatatgatcgttggaaggcaggaaaagggtaaaagccttctgtttaagaccgaggacggcgtgaatatgtgcacattgatggccattgatttaggggaactgtgtgaggacactatcacctacaaatgcccactactccggcaaaacgaaccggaggatattgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggatcgagacctggatactgcggcatcctggcttcacaatcatggccgcaattttggcctacaccatcggcacgactcactttcagcgcgctctcattttcatcctgctgacagcagtggccccatccatgaccatgagatgcatagggatttctaacagggattttgtcgaaggagtgtcgggtggctcatgggtagacatcgttctcgagcacgggagctgtgtgactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatctgcaagcattctatggtcgatagaggctggggtaacgggtgtggactattcggcaagggcgggattgtgacctgcgccatgtttacatgcaaaaagaatatggaaggaaaagtggtccagcctgagaacctcgaatacaccatagttatcactccacacagcggtgaggagcatgctgtgggcaatgacacggggaagcacggaaaagaaattaagatcacaccgcagtcctcaataaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggattcagaaggagacacttgtgacgttcaagaaccctcatgccaaaaagcaagacgttgtggtcctgggctctcaggaaggggcgatgcacaccgccttgactggagcaacagagatccagatgtcctcaggtaatctactgtttaccggccatctcaaatgccgtctgcgcatggataagcttcaactgaaagggatgagctacagtatgtgtacaggaaagttcaagatcgtgaaagaaattgctgagactcagcacggcaccatcgtaattagagttcagtatgagggtgacgggtctccatgcaagatacccttcgaaatcacggatttggagaaaaggcatgtgctcggccggctgattaccgtcaacccgatcgtgacagaaaaggactcccctgtcaacatcgaggccgaacccccatttggagatagctacattataatcggcgtggagcctgggcagttaaaactgaattggttcaagaagggatcgtctattggtcaaatgtttgagactaccatgcgaggcgctaaacgcatggccatcctaggggacacagcatgggatttcggatccctcggcggtgtttttacttcaattgggaaggccctgcaccaggtgttcggcgctatctacggagcggcatttagtggcgtaagctggaccatgaaaatacttatcggggtcgtgattacgtggatcggaatgaactccagatctacaagcttgtcagttagtctggtgctcgtcggcgtggtaaccctgtatcttggtgccatggtgcaggctgactccgggtgtgttgtcagctggaagaataaagaactgaagtgcggatctggcattttcatcactgataacgtgcacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtcaagctaacaataatgacgggggacaccaaaggaatcatgcaggctggcaagcgctcgctcagacctcaaccaactgaactgaaatatagctggaagacatgggggaaggccaaaatgctttccaccgagtcacataaccagacattcttgattgatggaccggaaactgcagagtgccccaataccaacagggcgtggaatagtctggaggttgaagactacggctttggtgtgttcacgacaaacatctggctcaagctgcgtgagaaacaggacgtgttttgtgattctaagttaatgagcgctgccattaaagacaatcgggcagtacacgccgatatggggtattggatcgaatccgctctgaacgacacctggaagatggagaaggcctcattcatagaggtcaaaagctgccactggcctaagtctcatactctttggtccaatggagtgttggaaagtgagatgattatcccaaaaaacttcgcaggccccgttagccagcacaactaccgacctggttatcatacccaaacagctggcccatggcacctcgggaagctggaaatggattttgacctatgtgagggaactaccgtggtcgtgacagaagattgcggcaatagagggccctctctgaggacgaccactgcctccggaaaactcatcacagagtggtgctgtcgctcatgcaccctgccgcctcttcggtacagaggcgaggacggttgttggtacgggatggaaattaggccattgaaggagaaggaagagaacctggttaatagtttagtgactgcgggacatggccagatcgataacttcagcctcggtgtactgggcatggccctttttctggaagagatgttgcgcacacgagtcgggaccaaacacgctattctcctggtggcagtgtcgttcgtcacgctaataactggaaatatgtcctttcgggacctgggccgtgttatggtgatggtaggggccaccatgacagatgacatcggaatgggcgtgacctatctcgctctgcttgccgcattcaaggtcagacccacttttgcggccggtttgctgttaaggaaactcacatctaaggagctgatgatggctaccattgggatcgcccttctgagccagtcaacaattcctgaaactatcctagagctcaccgatgcactggctttgggaatgatggtgctgaaaatagttcgcaacatggaaaagtaccaattagccgtgacgatcatggcaattagttgcgtccccaatgccgtgatcctccggaacgcttggaaggtttcctgtacaattctggcggccgtgtctgtcagcccacttctgttgacctcctcacagcagaaagcagactggatccctctcgctctgactataaagggcctaaatcccaccgccattttcctgacaactcttagcagaaccagtaaaaagaggtcttggccactcaacgaggccatcatggctgtaggcatggtgtccatcctggcaagctcgttgctgaaaaatgacattccgatgacggggcctttagttgccggaggtctcctgacagtgtgctatgtccttaccggccgatcagcggatctggaattggagcgcgctgccgaggtgaagtgggaagaccaggcagagatatctgggagttcccccatcctcagcattactatctctgaagatggaagcatgtccattaaaaacgaggaggaagagcaaacactgaccatcctaatacggactggcctgcttgtaatctcaggtgtgtttccagtcagtattcccatcacagccgctgcatggtacctctgggaagttaagaagcagagagccggggtgctgtgggacgtgcctagcccaccccctgtcggaaaagcggagttggaagatggcgcttataggattaagcagcgtggcatcttagggtactctcagataggagccggtgtgtataaagagggcaccttccacacgatgtggcatgttactcgcggggcagtactgatgcaccggggaaagagaattgagccgtcctgggccgacgtgaaaaaggatctcatctcatacggcggtgggtggaagctggaaggagagtggaaagaaggcgaggaagtccaagtgcttgctctggagccaggcaagaatcccagggccgttcagaccaaacctgggatctttaagacaaacaccggaacaattggtgcagtgagtttggacttcagcccaggcacttccgggtctcccatcgtcgatcgaaaaggaaaggtggtaggcctatacggtaatggggtcgtgacccggtcgggagcttatgttagcgccatagcgcagacggagaagtcaattgaagacaaccctgagatcgaagatgacatttttcgcaaaaagagactgacaatcatggatctccatccgggcgccggcaaaactaagaggtacctgcccgcaatagtgcgggaggctattaaacgagggcttagaaccttaatcctggccccaacacgcgtcgtggctgcagaaatggaggaggccctcaggggattgcctatccgttatcagacccccgccattaaggctgaacacactggtcgggagatcgttgacctgatgtgtcatgcgaccttcacaatgagactcctgtccccagtgagggtccctaactacaatcttattataatggacgaagcacacttcacggatcccgccagtatcgctgcccgcggctatatttctactcgagtggagatgggggaggcagccggaatctttatgaccgctacaccaccgggcagcagagaccctttcccccaatccaacgcgccaatcatggatgaagagcgggaaattcccgagaggtcatggaattctggtcacgaatgggtaaccgactttaaggggaaaactgtgtggttcgttcctagcataaaggccggaaacgatatcgcagcttgcctgcgcaaaaatggcaagaaagtcattcagttgagtcgtaagacatttgactccgagtacgtgaagaccagagccaacgattgggacttcgtggtcacgactgatatcagcgagatgggcgcaaattttaaagccgaacgggtaattgacccaaggcgctgtatgaagcccgtgatcctaacagatggggaggaacgagttatactggctggacctatgccggtgacccattcttcagccgcgcagagacggggtaggatcggccgcaacccaaaaaatgagaacgaccaatatatttacatgggggaacccctcgagaatgacgaggattgcgcacactggaaggaagccaaaatgttactggacaacatcaatacccctgagggaattatcccctccatgttcgaaccagagagagaaaaggtcgatgctatagacggcgagtacaggcttcggggtgaggcccgtaaaacttttgtggatctgatgcgccgaggggacctccctgtttggttggcttataaggtggcagccgaaggcattaactacgctgatagaaagtggtgtttcgacggaatcaaaaataaccagattctggaggaaaacgtcgaggtggagatctggacaaaggaaggcgagaggaaaaagctcaaaccccggtggctggatgcccgcatatatagtgacccacttgcactaaaggaatttaaggagttcgcggccgggagaaaaagcctgaccttgaatttaatcacagaaatgggaaggctgcctactttcatgacgcagaaggctcggaacgccctcgataatctggcagtacttcataccgctgaggccggtggccgagcatacaaccacgccctgtcggagctcccggaaacattggagactctgctactgctcacccttctggctacagtgaccgggggaatttttttattcttgatgtctggcaaaggtatcgggaagatgactctgggcatgtgctgcattatcacggcgtccgttctcctgtggtatgcccagatacaaccccactggattgcagctagcatcatccttgaatttttcctgattgtcctcttgatcccagagcctgaaaaacagagaaccccccaggacaatcagctgacatacgtggtgatagccattttaactgtcgttgccgcaaccatggctaacgagatgggatttctagagaagacaaagaaagatctgggcctcgggtcaatcaccactcaagaaagtgagtctaatattcttgacatcgacctgcgcccagcctccgcgtggacattgtatgctgtggccacgaccttcgtaactcctatgctgaggcatagcatagaaaactcaagtgtgaatgtcagcctcacagcaatcgccaaccaggctaccgtgctgatgggacttggtaagggctggcccctctccaaaatggatattggggttccgctgttggcaatcggatgttactctcaggtgaatccaattaccctgacagccgcgttactactgctcgtcgctcactacgccatcattggccctggtcttcaggcaaaggccactcgggaggctcaaaaacgtgccgcagctgggatcatgaagaaccccacggtagacggcataaccgtgattgatctggaaccaatcccctatgaccctaagtttgagaaacagttgggacaggttatgctgctcatcctgtgcgtgacacaggtccttatgatgagaactacctgggccttatgtgaggcgctgacactcgccaccggcccgattagcactttgtgggaagggaatcccggaaggttctggaacacgacaatagcagtgtccatggctaatatctttcgcggctcatacctggccggtgcagggctactgttctctattatgaagaacaccactaatacccggcgaggaacaggcaacatcggtgagactctcggcgaaaaatggaagagtagacttaacgctctggggaaatcggagtttcaaatttataagaaaagcggaatccaggaggtcgataggaccttggccaaggaaggcataaagcgcggggagacagaccatcacgccgtgtcccggggatctgcgaaactgagatggttcgttgaacgtaatatggtgacgccagagggcaaggtagtggatctcggttgcgggaggggaggctggtcatactattgtggtggcctgaaaaacgtccgggaagttaaggggttaaccaaaggaggccctgggcatgaggagcccatccctatgagcacttacggatggaatcttgtgcgcctgcagtccggcgtcgacgtgtttttcacaccacccgaaaagtgcgataccctcctatgtgacattggtgagagttctcctaacccaactatcgaagctgggcgaacactgagagtattgaatctggtggagaactggctcaataacaatacccaattctgcattaaggttcttaacccctatatgccgagcgtgatcgaaaaaatggagacgctgcagaggaagtacggaggcgcattggtccggaatcctctgtcacgcaactccacccacgagatgtactgggtgagtaatgccacaggcaacatagtcagctctgtgaatatgatttccagaatgctcatcaacaggtttactatgaaacacaagaaagctacctatgaaccagatgttgacttagggtcaggaacacgaaacatcggtattgagagcgaaatacccaatctggatatcattggcaagcggatcgagaagattaaacaggaacatgagacttcgtggcactacgaccaggaccatccttataagacctgggcctaccacgggtcttatgagacaaaacaaaccggaagtgcatccagcatggtaaacggcgtggtccgtcttctgactaagccatgggatgtggttcccatggtgacgcagatggccatgacagacaccactccgttcggtcagcagagagtctttaaagaaaaggtggatacccgcacacaagagcctaaggaagggacgaaaaagctaatgaaaatcaccgctgagtggctctggaaggagctgggaaaaaagaaaactcccaggatgtgtacacgggaagagttcaccagaaaggtacgctcaaatgcggccttgggcgcaatatttactgacgaaaacaagtggaaatccgctagggaggccgtggaagatggccgattctgggagctggttgaccgggagagaaatctccaccttgaagggaagtgcgagacatgtgtctacaacatgatgggaaaaagggaaaagaaactgggtgagtttggcaaggcaaaggggtctcgcgccatctggtatatgtggttaggagctcgtttcctggaatttgaggccttgggcttcctcaatgaggatcattggtttagccggggtaacagtctgtccggggtggaaggagagggcctacacagacttggctacattctgagggacgtgagcaaaaaggaagggggagcgatgtacgcagatgacaccgccggttgggatacacgcatcactctcgaggacctgaaaaatgaagagatggtcaccaaccatatgaagggcgagcacaaaaagttggctgaagccattttcaagctgacgtatcagaataaagttgtgcgagtacagcggccaacccctagagggacagtgatggacatcatttctaggcgcgatcagagaggatcaggccaagtcggtacttacgggctcaacacctttacaaatatggaggcacagcttatacggcagatggaaggagagggcatcttcaagagtattcaacatctgactgctaccgaggaaatcgccgtgcagaactggttagctagggttggccgtgagcgactgtcccgcatggccatcagcggggacgattgcgtggtcaaacccattgacgatagattcgcatctgcgttgacggccctcaatgacatgggaaaggtgcggaaagatatacagcagtgggaaccatcgaggggttggaacgactggacacaagtacccttttgctcacaccacttccatgagctggttatgaaggatggccgcgctctagtggtcccttgtagaaaccaggacgaacttatcgggcgggccaggaccagccagggagcaggctggtccctgaaggagactgcttgcctcggtaaaagttatgcccagatgtggacactgatgtactttcaccgacgtgatttgagattagcagccaatgcgatttgttctgctgtgccaagccattgggtgccgacctcccgcactacctggtcaatccacgccaagcacgagtggatgacaacggaagacatgctggcagtctggaaccgggtttggattcaagagaatccctggatggaagataaaacccctgtggagagttgggaagaggtaccatatctcgggaagagggaggaccagtggtgcggatctcttatcggcctgactagcagagccacatgggctaaaaacatacagaccgccatcaatcaggtgcgctccctaattggcaacgaagagtacactgactatatgccctcaatgaagcggttcaggcgagaagaggaagaggcaggggtcctgtggtga

SEQ ID NO: 14747 - RNA, 9876 nt, synthetic construct
  misc_feature 1..9876: note = derived and/or modified CDS sequence (opt3) from DENV-2__JN819408__SS-prME
  source 1..9876: mol_type = other RNA
accgcaggcgtgatcgtcatgctgattcccacagctatggcattccacctcactacgagaaacggggagcctcatatgattgttgggaggcaggaaaagggtaaaagccttctgtttaagaccgaggacggcgtgaatatgtgcacattgatggcaatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcgggatatctaacagggattttgtcgaaggagtgtcgggtggctcatgggtagacattgttctcgagcacgggagctgtgtgactacaatggctaagaataagcccaccttagatttcgaactgatcaaaacggaggccaagcagcctgcgacccttcggaaatattgcattgaagcaaagttgacaaacactaccacagagagtcgctgtccaactcaaggagagccctccctgaatgaagaacaggacaaacgatttatctgcaagcattctatggtcgatagaggctggggtaacgggtgtggactattcggcaagggcgggatcgtgacctgcgccatgtttacatgcaaaaagaatatggaaggaaaagtggtccagcctgagaacctcgaatacaccattgttataactccacacagcggtgaggagcatgctgtgggcaatgacacggggaagcacggaaaagaaatcaagattacaccgcagtcctcaatcaccgaggccgaactgactggctatggtaccgtaacaatggagtgtagtcccaggaccgggcttgatttcaacgaaatggtgctgttgcaaatggaggacaaagcatggctcgtccaccggcagtggtttctggatttacctctgccatggctccccggcgctgacactcagggaagcaattggatacagaaggagacacttgtgacgttcaagaaccctcatgccaaaaagcaagacgttgtggtcctgggctctcaggaaggggcgatgcacaccgccttgactggagcaacagagattcagatgtcctcaggtaatctactgtttaccggccatctcaaatgccgtctgcgcatggataaacttcaactgaaagggatgagctacagtatgtgtacaggaaagttcaagatcgtgaaagaaatcgctgagactcagcacggcaccattgtaatcagagttcagtatgagggtgacgggtctccatgcaagattcccttcgaaataacggatttggagaaaaggcatgtgctcggccggctgatcaccgtcaacccgattgtgacagaaaaggactcccctgtcaacatcgaggccgaacccccatttggagatagctacatcattataggcgtggagcctgggcagttaaaactgaattggttcaagaagggatcgtctatcggtcaaatgtttgagactaccatgcgaggcgctaaacgcatggccattctaggggacacagcatgggatttcggatccctcggcggtgtttttacttcaatcgggaaggccctgcaccaggtgttcggcgctatttacggagcggcatttagtggcgtaagctggaccatgaaaatccttataggggtcatcattacgtggatcggaatgaactccagatctactagcttgtcagtgagtctggttctcgtgggcgtcgtgaccctgtatcttggtgccatggtacaggctgactccgggtgtgtggttagctggaagaataaagaactgaagtgcggatctggcattttcatcactgataacgtccacacatggaccgagcagtacaagtttcaacccgaatcaccaagtaaattggccagcgcaatacagaaggcccatgaggaaggtatttgtggcatcaggtccgtgactcggctcgagaatctgatgtggaaacagattacccccgagttaaaccacatcctgtctgaaaatgaggtgaagctaacaataatgacgggggacaccaaaggaatcatgcaggctggcaagcgctcgctcagacctcaaccaactgaactgaaatatagctggaagacatgggggaaggccaaaatgctttccaccgagtcacataaccagacattcttgattgatggaccggaaactgcagagtgccccaataccaacagggcgtggaatagtctggaggtcgaagactacggctttggtgttttcacgacaaacatctggctcaagctgcgtgagaaacaggacatattttgtgattctaagttaatgagcgctgccatcaaagacaatcgggcagtgcacgccgatatggggtattggatagaatccgctctgaacgacacctggaagatggagaaggcctcattcattgaggtgaaaagctgccactggcctaagtctcatactctttggtccaatggagtattggaaagtgagatgatcatccccaagaatttcgcaggccccgtcagccagcacaactaccgacctggttatcatacccaaacagctggcccatggcacctcgggaagctggaaatggattttgacttctgtgagggaactaccgtggttgtgacagaagattgcggcaatagagggccctctctaaggacgaccactgcctccggaaaactgattacagagtggtgctgtcgctcatgcaccctcccgcctctgcggtacagaggcgaggacggttgttggtacgggatggaaatcaggccacttaaggagaaggaagagaacttggtcaatagtctggtgactgcgggacatggccagattgataactttagcttaggtgttctcggcatggccctgttccttgaagagatgctgcgcacacgagtggggaccaaacacgctatattgctcgtagcagtctcgtttgtgacgctgatcactggaaatatgtccttccgggacctaggccgtgtgatggtcatggttggggccaccatgacagatgacattggaatgggcgtgacctatctggctctcctggccgcatttaaggtaagacccactttcgcggccggtcttttgctgaggaaattaacatctaaggagctcatgatggctaccatcgggattgccctgcttagccagtcaacaatccctgaaactatactggagctaaccgatgcactcgctctgggaatgatggccttgaaaatcgtgcgcaacatggaaaagtaccaactggcagtcacgattatggccatcagttgcgtgcccaatgctgttattttacagaacgcgtggaaggtgtcctgtacaatcctcgccgcagtctctgtgagcccactgcttctgacctcctcacagcagaaagctgactggatacctttggccctcactattaagggcctgaatcccaccgccatctttctaacaactctgagccggaccagtaaaaagagatcttggccacttaacgaggctatcatggcagttggcatggtgtccattctcgccagctcgctgttgaaaaatgacataccgatgacggggcctctggtcgcgggaggtttactcacagtatgctatgtgctgaccggcaggtcagctgatcttgaactggagcgagccgcagacgttaagtgggaggatcaagccgaaatctctgggagttcccccattttgagcatcactatttctgaggacggaagcatgtccatcaaaaacgaagaggaggaacagacactcaccatactgatccgcactggcctactggtgatttcaggtgtcttcccagtgagtatccccattacagctgcagcctggtacctttgggaggtaaagaagcagcgggcgggggtgctctgggatgtccctagcccaccccctgttggaaaagctgaactggaggacggcgcctatagaatcaagcagaggggcatattggggtactctcaaattggagccggtgtgtataaagaaggcacctttcacacgatgtggcatgtgactcgtggggcagtcttaatgcaccgcggaaagcggatcgagccgtcctgggctgatgtgaaaaaggacctgatctcatacggcggtgggtggaagctcgagggagaatggaaagagggcgaagaggttcaggtactggcccttgaaccaggcaagaatcccagagcagtgcagaccaaacctgggattttcaggacaaacaccggaacaatcggtgctgtcagtctggattttagcccaggcacttccgggtctcccatagtggaccgaaagggaaaagttgtgggcttgtacggtaatggggtcgtgacccggtcgggagcctatgtaagcgcgattgcccagacggagaagtcaatcgaggataaccctgaaattgaggacgatatcttccgcaagaaaagactaacaataatggacctgcatccgggcgcaggcaagactaaaaggtacctccccgctattgtccgggaagccatcaagcgagggctgagaacccttatcttagctccaacacgcgtggttgcagccgagatggaagaggccctgaggggactccctattcgttatcaaacccccgctatcaaagcggagcacactggtcgggaaattgtggacttgatgtgtcatgcaaccttcacaatgagactgctctccccagtcagggtgcctaactacaatctgataatcatggatgaggcccactttacggaccccgctagtattgccgcacgcggctatatctctactcgagttgaaatgggggaggccgctggaatcttcatgaccgcgacaccaccgggcagcagagatccttttccccagtccaacgccccaattatggacgaggaacgggagatacccgaaaggtcatggaactctggtcacgagtgggtgaccgatttcaaggggaagactgtctggtttgtgcctagcatcaaagcaggaaacgacattgctgcctgccttcgcaagaatggcaaaaaggtaatccagctgagtcgtaaaacattcgattccgaatacgtgaagaccagagcaaacgactgggattttgttgtcacgactgacattagcgagatgggcgccaatttcaaggctgagcgggtgatcgatccaaggcgctgtatgaaacccgtgatattgacagacggggaagaacgagtcatcctagccggacctatgccggtaacccattcttcagcggcacaaagacggggtaggattggccgcaacccaaagaatgaaaacgaccagtatatctacatgggggagcccctggaaaatgatgaggactgcgcccactggaaagaggctaagatgctcttagataacattaatacccctgaaggaatcataccctccatgtttgagccagaaagagagaaagtggacgccattgatggcgaatacaggctgcggggtgaggctcgtaagactttcgttgaccttatgcgccgaggggatctgcctgtgtggctcgcatataaagtcgccgctgagggcatcaactacgccgacagaaagtggtgttttgatggaattaagaataaccagatcttggaagagaacgtggaagttgagatatggacaaaagagggcgaaaggaagaaactgaagccccggtggctcgacgcacgcatctatagtgatccactggcgcttaaagagttcaaggagttcgccgctgggagaaagagcctaaccctgaatttgattacagagatgggaaggttacctacttttatgacgcagaaagcccggaacgcactggacaatctcgctgtgctgcataccgccgaagccggtggacgagcatacaaccacgctctttcggagctgccggagacactcgaaactttgctgctactgaccctccttgcgacagtcaccgggggaatcttcctgtttttaatgtctggcaagggtattgggaaaatgactttgggcatgtgctgcatcataacggcctccattctgctctggtatgcacaaatccagccccactggatcgctgccagcattatcctggagttctttcttatagtgctgctcattccagaacctgagaagcagagaacaccacaggataatcaattgacatacgtagtgatcgccattctgactgttgtcgcagctaccatggccaacgaaatgggattcttagagaaaacaaagaaggacctaggcctggggtcaatcataacccaggagagtgaaaataacatcctcgacattgatcttcgcccagcgtctgcttggactctgtatgccgtggcaacaacgtttgtgacccctatgttgaggcattccatcgagaatagctcagtcaacgttagtctgactgccattgctaatcaggcaacagtgctcatgggactgggtaaaggctggccccttagcaagatggacatcggggtaccgctcctggccattggatgttactcccaggtgaacccaatcaccttgaccgcggctctgttactactggtcgcccactacgcaataattggccctggtctccaagccaaagctacacgggaagcccagaagcgtgcagctgccgggatcatgaaaaatcccactgtggatggcatcacggttattgaccttgagccaataccctatgatcctaagttcgaaaagcagctgggacaggtgatgttgctgatcctctgcgtcacccaagtactgatgatgagaacaacttgggcgctttgtgaggccttaaccctggcaacaggcccgatttctaccctctgggaggggaaccccggaaggttttggaatactacgatcgctgtgagcatggccaacattttccgcggctcctacttggccggtgctgggctgctattttcaatcatgaaaaatacaaccaacactcggcgaggaaccggcaacataggtgaaacactgggcgagaagtggaaatctagactcaatgcccttgggaagagtgagttccagatctataaaaagtcgggtattcaggaggttgacaggactctggccaaagagggcatcaagcgcggggaaaccgatcatcacgcggtgagccggggatccgctaagttgagatggtttgtcgagcgtaacatggtgacaccagaaggcaaagtcgtggacctgggttgcgggaggggaggctggtcttactattgtggtggcctcaagaatgttcgggaggtgaaagggctgacgaagggaggccctgggcatgaagaacccattcctatgtcaacctacggatggaacttagtacgccttcaaagcggcgtggatgtcttcttcactccacccgagaaatgcgacacactgctctgtgatatcggtgaatccagtcctaatccaaccatagaggcagggcgaactctaagagttctgaacttggtggaaaattggctgaacaataacacacagttttgcattaaggtcctcaatccctatatgccgtctgtgatcgagaagatggaaacccttcagaggaaatacggaggcgccctggtacggaaccctttgagccgcaattcaacgcacgagatgtactgggtgtccaacgctaccggcaatatcgttagtagcgtgaacatgatttctagaatgctgataaacaggttcacaatgaagcacaaaaaggccacttatgagccagacgtcgatctcgggtccggaacccgaaatatcggtattgaaggcgagatccccaacttagacattatcgggaaacggatagaaaagatcaagcaggagcatgaaacatcatggcactacgaccaagatcatccttataaaacttgggcataccacggaagctatgagaccaagcagacaggctcggcctctagtatggtgaatggtgtcgtgcgtctgcttaccaaaccatgggacgttgtacccatggtgactcagatggctatgacggatacaaccccgtttgggcagcaaagagtcttcaaggagaaagtggacactcgcacccaggaacctaaggagggaacaaagaaactgatgaagattacggcggaatggctatggaaagagctcggcaagaaaaagacccccaggatgtgtactcgggaggaatttaccaaaaaggttagatccaacgccgcactgggcgctatcttcaccgatgagaataagtggaaaagcgcccgcgaagcagtggaggacgggaggttttgggaattggtcgatcgagagcggaacctgcacctcgagggaaagtgcgaaacttgtgtgtacaatatgatgggtaaaagagagaagaaacttggcgagttcgggaaggccaagggatcaagggctatttggtatatgtggctgggcgcccgctttttagagttcgaagcgctgggatttttgaacgaggaccattggttctcccgtggaaattctctcagcggagtagagggcgaaggcctgcaccggctagggtacatccttagagatgtgggcaaaaaggagggtggcgcaatgtacgccgacgatacagctgggtgggacaccaggattacactggaagacctcaaaaacgaggaaatggttactaatcatatgaagggagagcacaaaaagctggccgaggcaatatttaagttgacctatcagaacaaagtcgtgcgcgtgcagcgaccaacgcctcggggcaccgtcatggatatcattagtagaagggaccaacgcggttccgggcaggttggaacatacggcctgaatactttcaccaacatggaagctcagctcatcagacaaatggagggcgaagggatcttcaagagcattcagcatcttacagccactgaggagatagctgtgcagaattggctggcccgggtaggaagggaacgtttatctcgaatggcaatctcaggtgatgactgcgtggtcaaacccattgatgaccgctttgcgagtgccctgaccgctttgaacgatatgggcaaggtgagaaaagacatccagcaatgggagccatcccgggggtggaacgattggacgcaggttcccttctgcagccaccactttcatgaactcgtgatgaaggacggaagggtcctggtggtaccttgtcgcaatcaggatgagctaattggcagagcccggatctctcagggtgcagggtggtcgcttaaggaaacagcttgcctgggaaaatcatatgcccaaatgtggaccctcatgtacttccacaggcgagacctgcgtttggcagccaacgcgatatgtagcgctgttccatcccattgggtgccgacaagtagaacaacctggtctatccacgccaagcacgagtggatgactaccgaggatatgttagcagtctggaatcgcgtgtggattcaggaaaacccctggatggaggacaaaacacctgtggaaagctgggaggaagtcccatatctgggcaagcgggaggaccagtggtgcggctccctcatcgggcttacgtcaagggccacctgggctaaaaatattcagactgccatcaaccaagttagaagtctgataggaaatgaggaatacacagattatatgccctctatgaagcgctttcggagggaggaagaggaagccggtgtgctatggtga

SEQ ID NO: 14748 - RNA, 9876 nt, synthetic construct
  misc_feature 1..9876: note = derived and/or modified CDS sequence (opt3) from DENV-2__FJ639783__SS-prME
  source 1..9876: mol_type = other RNA
accgccggagtgatcgtcatgctgattcccacagctatggcattccacctcactacgagaaacggggagcctcatatgatagttggaaggcaggaaaagggtaaaagccttctgtttaagaccgaggacggagtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcggggtctctaacagggattttgtggaaggagtatcgggtggctcatgggttgacatagtgctcgagcacgggagctgtgtcactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagaacaggacaaacgatttatttgcaagcattctatggtggatagaggctggggtaacgggtgtggactattcggcaagggcgggatcgtgacctgcgccatgtttacatgcaaaaagaatatggaaggaaaagtcgttcagcctgagaacctcgaatacaccatcgtgattactccacacagcggtgaggagcatgctgtaggcaatgacacggggaagcacggaaaagaaataaagatcacaccgcagtcctcaattaccgaggccgaactgactggctatggtaccgtgacaatggagtgtagtcccaggaccgggcttgatttcaacgaaatggtcctgttgcaaatggaggacaaagcatggctcgtgcaccggcagtggtttctggatttacctctgccatggctccccggcgctgacactcagggaagcaattggatccagaaggagacacttgttacgttcaagaaccctcatgccaaaaagcaagacgtggtcgtgctgggctctcaggaaggggcgatgcacaccgccttgactggagcaacagagatacagatgtcctcaggtaatctactgtttaccggccatctcaaatgccgtctgcgcatggataaacttcaactgaaagggatgagctacagtatgtgtacaggaaagttcaagattgtaaaagaaatcgctgagactcagcacggcaccatcgttattagagtgcagtatgagggtgacgggtctccatgcaagatccccttcgaaattacggatttggagaaaaggcatgtcctcggccggctgataaccgtgaacccgatcgtcacagaaaaggactcccctgtgaacattgaggccgaacccccatttggagatagctacatcatcattggcgttgagcctgggcagttaaaactgaattggttcaagaagggatcgtctataggtcaaatgtttgagactaccatgcgaggcgctaaacgcatggccatcctaggggacacagcatgggatttcggatccctcggcggtgtgtttacttcaattgggaaggccctgcaccaggtattcggcgctatctacggagcggcatttagtggcgtcagctggaccatgaaaattcttatcggggtgataatcacgtggattggaatgaactccagatctactagcttgtcagttagtctggtgctcgtcggcgtggtaaccctgtatcttggtgccatggtgcaggctgactccgggtgtgttgtcagctggaagaataaagaactgaagtgcggatctggcatcttcattactgataacgtgcacacatggaccgagcagtacaagtttcaacccgaatcaccaagtaaattggccagcgcaatccagaaggcccatgaggaaggtatatgtggcattaggtccgtgactcggctcgagaatctgatgtggaaacagatcacccccgagttaaaccacattctgtctgaaaatgaggtcaagctaacaatcatgacgggggacataaaaggaatcatgcaggctggcaagcgctcgctcagacctcaaccaaccgaactgaaatatagctggaagacttgggggaaggccaaaatgctttccacagagtcacataaccagaccttcttgattgatggaccggaaacagcagagtgccccaatactaacagggcgtggaatagtctggaggttgaagactacggctttggtgtgttcaccacgaacatctggctcaagctgcgtgagaaacaggacgtgttttgtgattctaagttaatgagcgctgccattaaagacaatcgggcagtacacgccgatatggggtattggatcgaatccgctctgaacgacacatggaagatggagaaggcctcattcatagaggtcaaaagctgccactggcctaagtctcataccctttggtccaatggagtgttggaaagtgagatgattatccccaagaatttcgcaggccccgttagccagcacaactaccgacctggttatcatactcaaaccgctggcccatggcacctcgggaagctggaaatggattttgacttctgtgagggaacaactgtggtcgtgaccgaagattgcggcaatagagggccctctctaaggacaacgaccgcctccggaaaactgatcactgagtggtgctgtcgctcatgcacactcccgcctctgcggtacagaggcgaggacggttgttggtacgggatggaaattaggccacttaaggagaaggaagagaacttggttaatagtctggtgaccgcgggacatggccagatcgataactttagcttaggtgtactcggcatggccctgttccttgaagagatgctgcgcactcgagtcgggacaaaacacgctattttgctcgtggcagtgtcgtttgtcaccctgataacgggaaatatgtccttccgggacctaggccgtgttatggtgatggtaggggccactatgaccgatgacatcggaatgggcgtgacatatctggctctcctggccgcatttaaggtcagacccaccttcgcggccggtcttttgctgaggaaattaacttctaaggagctcatgatggctacaattgggatcgccctgcttagccagtcaaccattcctgaaacaatcctggagctaactgatgcactcgctctgggaatgatggtgttgaaaatagttcgcaacatggaaaagtaccaactggccgtgaccgtcatggcaatcagttgcgtgcccaatgccgttattttacagaacgcttggaaggtgtcctgtacgatcctcgcggccgtctctgtaagcccactgcttctgacatcctcacagcagaaagcagactggattcctttggctctcaccatcaagggcctgaatcccactgccatatttctaaccacactgagccggacaagtaaaaagagatcttggccacttaacgaggccattatggctgtgggcatggtttccatcctcgcaagctcgctgttgaaaaatgacatcccgatgaccgggcctctggtggccggaggtttactcacggtctgctatgtgctgacaggcaggtcagcggatcttgaactggagcgagctgccgacgtaaagtgggaggatcaagcagaaatttctgggagttcccccatattgagcatcaccatttctgaggacggaagcatgtccatcaaaaacgaagaggaggaacagactctcacaattctgatccgcaccggcctactggtgatatcaggtgtcttcccagttagtatccccattactgccgctgcatggtacctttgggaggtgaagaagcagcgggccggggtgctctgggatgtccctagcccaccccctgtgggaaaagcggaactggaggacggcgcttatagaatcaagcagaggggcattttggggtactctcaaatcggagccggtgtttataaagaaggcacatttcacaccatgtggcatgtaacgcgtggggcagtgttaatgcaccgcggaaagcggatagagccgtcctgggccgatgtcaaaaaggacctgatttcatacggcggtgggtggaagctcgagggagaatggaaagagggcgaagaggtgcaggttctggctcttgaaccaggcaagaatcccagagccgtgcagactaaacctgggatcttcaagaccaacacaggaaccatcggtgcagtcagtctggattttagcccaggcacatccgggtctcccattgtggacaggaaaggaaaggtagtcggcttgtacggtaatggggtggttactcgatcgggagcttatgtgagcgccatcgcgcagaccgagaagtcaatagaggataaccctgaaattgaggacgatatcttccggaaaaagcgcctaacgattatggacctgcatccgggcgccggcaaaacaaagagatacctccccgcaatcgtcagggaagctataaaacgggggctgcgaactcttattttagccccaaccagagtggttgctgcagagatggaagaggccctgcgcggactccctatcaggtatcaaacacccgccatcaaggctgagcacaccggtcgtgaaattgtggacttgatgtgtcatgcgactttcaccatgcggctgctctccccagtcagagtgcctaactacaatctgatcattatggatgaggcacactttacagaccccgccagtatagctgccaggggctatatctctacgcgcgtagaaatgggggaggcagccggaattttcatgactgctaccccaccgggcagccgagatccttttccccagtccaacgcgccaatcatggacgaggaaagagagatccccgaacggtcatggaactctggtcacgagtgggtgacagatttcaaggggaaaaccgtttggtttgtccctagcattaaggccggaaacgacatagcagcttgccttaggaaaaatggcaagaaagtgatccagctgagtcgcaagactttcgattccgaatacgtgaagacacgtgccaacgactgggattttgtcgtaaccacggacattagcgagatgggcgcaaatttcaaagccgagagagtgatcgatccacggaggtgtatgaagcccgttattttgactgacggggaagaacgcgtgatcctagctggacctatgccggtcacacattcttcagccgcgcaacgaagaggtcggataggcaggaaccccaaaaatgaaaacgaccagtatatctacatgggggagcccctggaaaatgatgaggactgcgcacactggaaggaggccaaaatgctcttagataacattaatacccctgaaggaatcattccctccatgtttgagccagaacgcgagaaggtggacgctatcgatggcgaatacagactgaggggtgaggcccggaaaaccttcgttgaccttatgcgtcgcggggatctgcctgtgtggctcgcttataaggtcgcagccgagggcataaactacgctgaccgaaagtggtgttttgatggaattaaaaataaccagatcttggaagagaacgtggaagtagagatttggactaaggagggcgaaaggaaaaagctgaaacccagatggctcgacgcccggatctatagtgatccactggcacttaaggagttcaaggagttcgcggccgggcgcaaaagcctaacactgaatttgataaccgagatgggaagattacctacatttatgactcagaaggctaggaacgccctggacaatctcgcagtgctgcatacggctgaagccggtggccgggcatacaaccacgccctttcggagctgccggagaccctcgaaacattgctgctactgactctccttgctaccgttacagggggaatcttcctgtttttaatgtctggcaaaggtattgggaagatgaccttgggcatgtgctgcatcattactgcgtccgtcctgctctggtatgcccaaatccagccccactggatagcagctagcattatcctggagttctttcttatcgtgctgctcattccagaacctgagaaacagcgaacgccccaggataatcaattgacctacgtggtcatcgccatactgacagttgtggccgcaactatggctaacgaaatgggattcttagagaagaccaagaaagacctaggcctggggtcaattacaacccaggagagtgaatctaatatcctcgacattgatcttagaccagcctccgcgtggactctgtatgctgtagccacaacgtttgtgacccctatgttgcgccatagcatcgagaactcaagtgtcaatgtgagcctgactgcaatagccaaccaggctacagttctcatgggactgggtaagggctggcccctttccaaaatggacatcggggtgccgctcctggcaattggatgttactctcaggtcaatccaatcaccttgaccgccgcgctgttactactggtagctcactacgccattatcggccctggtctccaagcaaaggccacaagggaagctcagaaacgggccgcagctgggattatgaagaaccccactgtggatggcatcacggttatagaccttgagccaattccctatgatcctaagttcgaaaaacagctgggacaggtgatgttgctgatcctctgcgtcacccaagtgctgatgatgcgtacaacttgggccctttgtgaggcgttaaccctggccacaggcccgatcagcaccctctgggaggggaatcccggaagattttggaacactacgattgcagtctccatggctaatatattcaggggctcatacttggccggtgcagggctgctattttctatcatgaagaacacaaccaatactcgccggggaaccggcaacattggtgaaacactgggcgagaaatggaagagtcgactcaacgctcttgggaaatcggagttccagatctataagaaaagcggcattcaggaggtggacagaactctggccaaggagggcatcaagagaggggaaaccgatcatcacgccgtttcccgcggatctgcgaaattgcggtggtttgtggagagaaatatggtaacaccagaaggcaaggtggtcgacctgggttgcgggcgtggaggctggtcatactattgtggtggcctcaaaaacgttagggaggtgaaggggctgacgaaaggaggccctgggcatgaagaaccaatacctatgagcacctacggatggaatttagtccggcttcaatccggcgtggatgtattcttcactccacccgagaagtgcgacacactgctctgtgatatcggtgaaagttctcctaacccaaccattgaggctgggcgcactctacgagtgctgaatttggttgaaaactggctgaataacaatacacagttttgcatcaaggtgctcaacccctatatgccgagcgtcattgagaaaatggaaacccttcagagaaagtacggaggcgcactggtgaggaatcctttgtcacggaactccacgcacgagatgtactgggtcagtaatgccaccggcaacatcgtgagctctgttaatatgatatcccgcatgctgattaacagattcacaatgaaacacaagaaagctacttatgagccagacgtagatctcgggtcaggaaccaggaacatcggtatcgaaagcgagattcccaatttagacataatcggcaagcgaattgaaaagatcaaacaggagcatgaaacatcgtggcactacgaccaagatcatccttataagacttgggcctaccacgggtcttatgagaccaaacagacaggaagtgcatccagcatggtgaacggcgtcgtgcggctgcttaccaagccatgggacgttgtgcccatggtcactcagatggccatgacggatacaaccccgtttggtcagcaacgtgtgttcaaagagaaggtagacactagaacccaggaacctaaggaggggacgaaaaagctgatgaaaattacagctgaatggctatggaaggagctcggcaaaaagaaaaccccacgcatgtgtactagggaggaatttacacggaaggtgagatcaaatgcggccctgggcgcaatcttcaccgatgagaacaagtggaaatccgctcgcgaagccgttgaggacggcaggttttgggaattggtcgatcgagagcggaatctgcacctcgaggggaagtgcgaaacttgtgtgtacaacatgatgggaaaaagagagaagaaacttggtgagttcggcaaggcaaaggggtctagggccatatggtatatgtggctgggagctcgctttttagagttcgaagccctgggctttttgaatgaggaccattggttcagccgtggtaacagtctctccggggtggagggagaaggcctgcaccggctaggctacatccttagagatgtcgggaaaaaggagggaggtgcgatgtacgcagacgatacagccggctgggacaccaggattacactggaagacctcaaaaatgaggaaatggttactaaccatatgaagggggagcacaaaaagctggctgaggccatctttaagttgacctatcagaataaagtggtacgcgtgcagcgaccaacgcctcggggaaccgtcatggatattatcagcagaagggaccaacgcggctctggtcaggtggggacatacggactgaacactttcaccaatatggaagcacagctcattagacaaatggagggcgaaggcatattcaagtcaatccagcatcttacagctactgaggagattgccgttcagaactggctggctcgggtggggagggaacgtttaagtcgaatggccatctccggagatgactgcgtcgtgaaacccatcgatgaccgctttgcaagcgcgctgaccgccttgaatgatatgggtaaggtaagaaaagacattcagcaatgggagccatctcggggctggaacgattggacgcaggttcccttctgctcgcaccactttcatgaactcgtgatgaaggacgggagggtcctggtggtgccttgtcgcaaccaggatgagctaataggaagggctcggatctcacagggcgccggttggagccttaaggaaacagcatgcctggggaaatcctatgctcaaatgtggaccctcatgtacttccacaggcgagacctgcgtttggccgcaaatgccatttgtagtgcggtcccatctcattgggttccgactagcagaacaacctggtccatccacgctaagcacgagtggatgactaccgaggatatgttagccgtgtggaaccgcgtatggattcaggaaaatccctggatggaggacaaaacacctgtggaatcatgggaggaagtcccatatctgggaaagcgggaggaccagtggtgcggcagtctcatcggccttacgtctagggcaacctgggccaaaaacatacagactgctatcaatcaagtgagaagcctgattgggaacgaggaatacacagattatatgccctccatgaagcgctttcggagggaggaagaggaagccggagttctatggtga

SEQ ID NO: 14749 - RNA, 9876 nt, synthetic construct
  misc_feature 1..9876: note = derived and/or modified CDS sequence (opt3) from DENV-2__FJ639788__SS-prME
  source 1..9876: mol_type = other RNA
accgccggagtgatcgtcatgctgattccaacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacggcgggcgagcaccgccgagaaaagcgttcagtggctctggtcccccatgtgggtatggggcttgagactagaaccgaaacatggatgagtagcgagggagcctggaaacacgttcagaggattgagacttggatcctgcggcatcctggcttcaccataatggcagccatcttggcttacacaattggcaccacgcactttcagcgcgcactcatcttcattctgctgactgccgtggctccatccatgacaatgagatgcatcggggtctctaacagggattttgtggaaggagtatcgggtggctcatgggttgacatagtgctcgagcacgggagctgtgtcaccactatggccaagaataagcccacattagatttcgaactgattaaaaccgaggcgaagcagcctgcaacgcttcggaaatattgcatcgaagccaagttgaccaacacaactaccgagagtcgctgtccaacacaaggagagccctccctgaatgaagaacaggacaaacgatttatttgcaagcattctatggtggatagaggctggggtaacgggtgtggactattcggcaagggcgggatcgtgacttgcgctatgtttacctgcaaaaagaatatggaaggaaaagtcgttcagcctgagaacctcgaatacacaatcgtgattaccccacacagcggtgaggagcatgccgtaggcaatgacactgggaagcacggaaaagaaataaagatcacgccgcagtcctcaattacagaggcagaactgaccggctatggtactgtgaccatggagtgtagtcccaggacagggcttgatttcaacgaaatggtcctgttgcaaatggaggacaaggcttggctcgtgcaccggcagtggtttctggatttacctctgccatggctccccggcgccgacacccagggaagcaattggatccagaaggagactcttgttacattcaagaaccctcatgcgaaaaagcaagacgtggtcgtgctgggctctcaggaaggggccatgcacacggcattgaccggagctactgagatacagatgtcctcaggtaatctactgtttacaggccatctcaaatgccgtctgcgcatggataaacttcaactgaaagggatgagctacagtatgtgtaccggaaagttcaagattgtaaaagaaatcgccgagacacagcacggcactatcgttattagagtgcagtatgagggtgacgggtctccatgcaagatccccttcgaaattaccgatttggagaaaaggcatgtcctcggccggctgataacggtgaacccgatcgtcaccgaaaaggactcccctgtgaacattgaggctgaacccccatttggagatagctacatcatcattggcgttgagcctgggcagttaaaactgaattggttcaagaagggatcgtctataggtcaaatgtttgagacaactatgcgaggcgccaaacgcatggcaatcctaggggacaccgcctgggatttcggatccctcggcggtgtgtttacatcaattgggaaggctctgcaccaggtattcggcgcgatctacggagcagcctttagtggcgtcagctggactatgaaaattcttatcggggtgataatcacctggattggaatgaactccagatctacgagcttgtcagttagtctggtgctcgtcggcgtggtaacactgtatcttggtgctatggtgcaggccgactccgggtgtgttgtcagctggaagaataaagaactgaagtgcggatctggcatcttcattaccgataacgtgcacacttggacagagcagtacaagtttcaacccgaatcaccaagtaaattggcaagcgccatccagaaggctcatgaggaaggtatatgtggcattaggtccgtgacccggctcgagaatctgatgtggaaacagatcactcccgagttaaaccacattctgtctgaaaatgaggtcaagctaaccatcatgacaggggacataaaaggaatcatgcaggccggcaagcgctcgctcagacctcaaccaacggaactgaaatatagctggaagacctgggggaaggcaaaaatgctttccactgagtcacataaccagacattcttgattgatggaccggaaaccgcggagtgccccaatacaaacagggcttggaatagtctggaggttgaagactacggctttggtgtgttcactaccaacatctggctcaagctgcgtgagaaacaggacgtgttttgtgattctaagttaatgagcgccgcaattaaagacaatcgggccgtacacgctgatatggggtattggatcgaatccgccctgaacgacacgtggaagatggagaaggcatcattcatagaggtcaaaagctgccactggcctaagtctcatacactttggtccaatggagtgttggaaagtgagatgattatccccaaaaatttcgctggccccgttagccagcacaactaccgacctggttatcatacccaaactgccggcccatggcacctcgggaagctggaaatggattttgacttctgtgagggaaccacagtggtcgtgactgaagattgcggcaatagagggccctctctaaggaccacaacggcgtccggaaaactgatcaccgagtggtgctgtcgctcatgcactctcccgcctctgcggtacagaggcgaggacggttgttggtacgggatggaaattaggccacttaaggagaaggaagagaacttggttaatagtctggtgacagccggacatggccagatcgataactttagcttaggtgtactcggcatggctctgttccttgaagagatgctgcgcacccgagtcgggactaaacacgcaattttgctcgtggccgtgtcgtttgtcacactgataaccggaaatatgtccttccgggacctaggccgtgttatggtgatggtaggggctacgatgactgatgacatcggaatgggcgtgacctatctggccctcctggcagcgtttaaggtcagacccacattcgccgctggtcttttgctgaggaaattaacctctaaggagctcatgatggccactattgggatcgcactgcttagccagtcaacaattcctgaaaccatcctggagctaacagatgctctcgccctgggaatgatggtgttgaaaatagttcgcaacatggaaaagtaccaactggcagtgactgtcatggccatcagttgcgtgcccaatgctgttattttacagaacgcgtggaaggtgtcctgtaccatcctcgccgcagtctctgtaagcccactgcttctgacgtcctcacagcagaaagctgactggattcctttggccctcacaatcaagggcctgaatcccaccgccatatttctaactaccctgagccggacaagtaaaaagagatcttggccacttaacgaggctattatggcagtgggcatggtttccatcctcgccagctcgctgttgaaaaatgacatcccgatgactgggcctctggtggcgggaggtttactcaccgtctgctatgtgctgacgggcaggtcagctgatcttgaactggagcgagccgcagacgtaaagtgggaggatcaagccgaaatttctgggagttcccccatattgagcatcacaatttctgaggacggaagcatgtccatcaaaaacgaagaggaggaacagaccctcactattctgatccgcacaggcctactggtgatatcaggtgtcttcccagttagtatccccattaccgctgcagcctggtacctttgggaggtgaagaagcagcgggcgggggtgctctgggatgtccctagcccaccccctgtgggaaaagctgaactggaggacggcgcctatagaatcaagcagaggggcattttggggtactctcaaatcggagccggtgtttataaagaaggcacttttcacacaatgtggcatgtaacccgtggggcagtgttaatgcaccgcggaaagcggatagagccgtcctgggctgatgtcaaaaaggacctgatttcatacggcggtgggtggaagctcgagggagaatggaaagagggcgaagaggtgcaggttctggcccttgaaccaggcaagaatcccagagcagtgcagacgaaacctgggatcttcaagactaacaccggaacaatcggtgctgtcagtctggattttagcccaggcacctccgggtctcccattgtggacaggaaaggaaaggtagtcggcttgtacggtaatggggtggttacacgatcgggagcctatgtgagcgcgatcgcccagactgagaagtcaatagaggataaccctgaaattgaggacgatatcttccggaaaaagcgcctaaccattatggacctgcatccgggcgcaggcaaaacgaagagatacctccccgctatcgtcagggaagccataaaacgggggctgcgaacacttattttagctccaactagagtggttgcagccgagatggaagaggccctgcgcggactccctatcaggtatcaaacccccgctatcaaggcggagcacacaggtcgtgaaattgtggacttgatgtgtcatgcaaccttcactatgcggctgctctccccagtcagagtgcctaactacaatctgatcattatggatgaggcccactttaccgaccccgctagtatagccgcaaggggctatatctctacacgcgtagaaatgggggaggccgctggaattttcatgacggcgactccaccgggcagccgagatccttttccccagtccaacgccccaatcatggacgaggaaagagagatccccgaacggtcatggaactctggtcacgagtgggtgaccgatttcaaggggaaaacagtttggtttgtccctagcattaaggcaggaaacgacatagctgcctgccttaggaaaaatggcaagaaagtgatccagctgagtcgcaagaccttcgattccgaatacgtgaagactcgtgcaaacgactgggattttgtcgtaacaaccgacattagcgagatgggcgccaatttcaaagctgagagagtgatcgatccacggaggtgtatgaagcccgttattttgacggacggggaagaacgcgtgatcctagccggacctatgccggtcactcattcttcagcggcacaacgaagaggtcggataggcaggaaccccaaaaatgaaaacgaccagtatatctacatgggggagcccctggaaaatgatgaggactgcgcccactggaaggaggctaaaatgctcttagataacattaatacacctgaaggaatcattccctccatgtttgagccagaacgcgagaaggtggacgccatcgatggcgaatacagactgaggggtgaggctcggaaaaccttcgttgaccttatgcgtcgcggggatctgcctgtgtggctcgcatataaggtcgccgctgagggcataaactacgccgaccgaaagtggtgttttgatggaattaaaaataaccagatcttggaagagaacgtggaagtagagatttggaccaaggagggcgaaaggaaaaagctgaaacccaggtggctcgacgcacggatctatagtgatccactggcgcttaaggagttcaaggagttcgccgctgggcgcaaaagcctaactctgaatttgataacagagatgggaagattacctacctttatgacacagaaggccaggaacgcactggacaatctcgctgtgctgcatactgccgaagccggtggacgggcatacaaccacgctctttcggagctgccggagacgctcgaaaccttgctgctactgacactccttgcgactgttaccgggggaatcttcctgtttttaatgtctggcaaaggtattgggaagatgacattgggcatgtgctgcatcattaccgcctccgtcctgctctggtatgcacaaatccagccccactggatagctgccagcattatcctggagttctttcttatcgtgctgctcattccagaacctgagaaacagcgaactccccaggataatcaattgacgtacgtggtcatcgccatactgaccgttgtggcagctacaatggccaacgaaatgggattcttagagaagactaagaaagacctaggcctggggtcaattaccacacaggagagtgaatctaatatcctcgacattgatcttagaccagcgtccgcttggaccctgtatgccgtagcaactacatttgtgacgcctatgttgcgccatagcatcgagaactcaagtgtcaatgtgagcctgaccgccatagctaaccaggcaactgttctcatgggactgggtaagggctggcccctttccaaaatggacatcggggtgccgctcctggccattggatgttactctcaggtcaatccaatcacattgaccgcggctctgttactactggtagcccactacgcaattatcggccctggtctccaagccaaggctaccagggaagcccagaaacgggcagctgccgggattatgaagaaccccacagtggatggcatcactgttatagaccttgagccaattccctatgatcctaagttcgaaaaacagctgggacaggtgatgttgctgatcctctgcgtcacgcaagtgctgatgatgcgtaccacatgggcgctttgtgaggccttaactctggcaaccggcccgatcagcacactctgggaggggaatcccggaagattttggaacaccactattgctgtctccatggccaatatattcaggggctcatacttggccggtgctgggctgctattttctatcatgaagaacacgacaaatacccgccggggaactggcaacattggtgaaaccctgggcgagaaatggaagagtcgactcaacgcccttgggaaatcggagttccagatctataagaaaagcggcattcaggaggtggacagaacactggccaaggagggcatcaagagaggggaaactgatcatcacgcggtttcccgcggatctgctaaattgcggtggtttgtggagagaaatatggtaaccccagaaggcaaggtggtcgacctgggttgcgggcgtggaggctggtcatactattgtggtggcctcaaaaacgttagggaggtgaaggggctgacaaaaggaggccctgggcatgaagaaccaatacctatgagcacgtacggatggaatttagtccggcttcaatccggcgtggatgtattcttcaccccacccgagaagtgcgacactctgctctgtgatatcggtgaaagttctcctaacccaacaattgaggcagggcgcaccctacgagtgctgaatttggttgaaaactggctgaattataacactcagttttgcatcaaggtgctcaatccctacatgccgagcgtcattgagaaaatggaaacacttcagagaaagtacggaggcgccctggtgaggaaccctttgtcaagaaattccacccacgagatgtattgggtcagtaacgctacgggcaatatcgtgagctctgttaacatgatatcccgcatgctgattaatagattcaccatgaaacacaagaaagccacatacgagccagacgtagatctcgggtcaggaactaggaacatcggtatcgaaagcgagattcccaacttagacataatcggcaagcgaattgaaaagatcaaacaggagcatgaaacctcgtggcactatgaccaagatcatccttacaagacatgggcatatcacgggtcttacgagactaaacagaccggaagtgcctccagcatggtgaatggcgtcgtgcggctgcttacaaagccatgggacgttgtgcccatggtcacccagatggctatgactgatacgacaccgtttggtcagcaacgtgtgttcaaagagaaggtagacaccagaactcaggaacctaaggaggggaccaaaaagctgatgaaaattacagcggaatggctatggaaggagctcggcaaaaagaaaacgccccgcatgtgtaccagggaggaatttactcggaaggtgagatcaaacgccgcactgggcgctatcttcacagatgagaataagtggaaatccgcccgcgaagcagttgaggacggcaggttttgggaattggtcgatcgagagcggaacctgcacctcgaggggaagtgcgaaacctgtgtgtataatatgatgggaaaaagagagaagaaacttggtgagttcggcaaggccaaggggtctagggctatatggtacatgtggctgggagcccgctttttagagttcgaagcgctgggctttttgaacgaggaccattggttcagccgtggtaatagtctctccggggtggagggagaaggcctgcaccggctaggctacatccttagagatgtcgggaaaaaggagggaggtgcaatgtatgccgacgatactgctggctgggacacaaggattaccctggaagacctcaaaaacgaggaaatggttacaaatcatatgaagggggagcacaaaaagctggccgaggcaatctttaagttgacttaccagaacaaagtggtacgcgtgcagcgaccaacccctcggggaacggtcatggatattatcagcagaagggaccaacgcggctctggtcaggtggggacctatggactgaatacattcactaacatggaagctcagctcattagacaaatggagggcgaaggcatattcaagtcaatccagcatcttaccgccacagaggagattgctgttcagaattggctggcccgggtggggagggaacgtttaagtcgaatggcaatctccggagatgactgcgtcgtgaaacccatcgatgaccgctttgcgagcgccctgactgctttgaacgatatgggtaaggtaagaaaagacattcagcaatgggagccatctcggggctggaatgattggacccaggttcccttctgctcgcaccactttcatgaactcgtgatgaaggacgggagggtcctggtggtgccttgtcgcaaccaggatgagctaataggacgggcacggatctcacagggcgcaggttggagccttaaggaaacggcttgcctggggaaatcctacgcccaaatgtggacactcatgtatttccacaggcgagacctgcgtttggcagccaacgcgatttgtagtgctgtcccatctcattgggttccgaccagcagaactacatggtccatccacgccaagcacgagtggatgaccactgaggatatgttagcagtgtggaatcgcgtatggattcaggaaaacccctggatggaggacaaaacccctgtggaatcatgggaggaagtcccatacctgggaaagcgggaggaccagtggtgcggcagtctcatcggccttacatctagggccacgtgggctaaaaatatacagaccgccatcaaccaagtgagaagcctgattgggaatgaggaatatactgattacatgccctccatgaagcgctttcggagggaggaagaggaagcaggagttctatggtga

SEQ ID NO: 14750 - RNA, 9876 nt, synthetic construct
  misc_feature 1..9876: note = derived and/or modified CDS sequence (opt3) from DENV-2__FJ639822__SS-prME
  source 1..9876: mol_type = other RNA
accgccggcgtgatcgtcatgctgattcccacagctatggcattccacctcactacgagaaacggggagcctcatatgatagttggaaggcaggaaaagggtaaaagccttctgtttaagaccgaggacggcgtgaatatgtgcacattgatggccatcgatttaggggaactgtgtgaggacactattacctacaaatgcccactactccggcaaaacgaaccggaggatatcgactgttggtgcaattccacatctacctgggtaacttatggaacatgtaccacgactggcgagcaccgccgagaaaagcgttcagtggcgctggtcccccatgtgggtatggggcttgagaccagaacagaaacttggatgagtagcgagggagcttggaaacacgttcagaggattgagacctggatcctgcggcatcctggcttcacaataatggccgcaatcttggcctacaccattggcacgactcactttcagcgcgctctcatcttcattctgctgacagcagtggccccatccatgaccatgagatgcatcggggtctctaacagggattttgtggaaggagtatcgggtggctcatgggttgacatagtgctcgagcacgggagctgtgtcactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaagagcaggacaaacgatttatttgcaagcattctatggtggatagaggctggggtaacgggtgtggactattcggcaagggcgggatcgtgacctgcgccatgtttacatgcaaaaagaatatggaaggaaaagtcgttcagcctgagaacctcgaatacaccatcgtgattactccacacagcggtgaggagcatgctgtaggcaatgacacggggaagcacggaaaagaaataaagatcacaccgcagtcctcaattatcgaggccgaactgaccggctatggtactgtgaccatggagtgtagtcccaggacagggcttgatttcaacgaaatggtcctgttgcaaatggaggacaaagcatggctcgtgcaccggcagtggtttctggatttacctctgccatggctccccggcgctgacacccagggaagcaattggatacagaaggagactcttgttacattcaagaaccctcatgccaaaaagcaagacgtggtcgtgctgggctctcaggaaggggcgatgcacacggccttgaccggagcaactgagattcagatgtcctcaggtaatctactgtttacaggccatctcaaatgccgtctgcgcatggataagcttcaactgaaagggatgagctacagtatgtgtaccggaaagttcaagatcgtaaaagaaatcgctgagacacagcacggcactattgttatcagagtgcagtatgagggtgacgggtctccatgcaagattcccttcgaaataaccgatttggagaaaaggcatgtcctcggccggctgatcacggtgaacccgattgtcaccggaaaggactcccctgtgaacatcgaagccgagcccccatttggcgatagctacatcattataggggttgaacctggacagttaaaactgaattggttcaagaagggttcgtctatcggccaaatgtttgagacaactatgcgaggggctaaacgcatggccattctaggagacaccgcatgggatttcggctccctcggtggggtgtttacatcaatcggcaaggccctgcaccaggtattcggagctatttacggcgcggcatttagtggggtcagctggactatgaaaatccttataggagtgatcattacctggatcggcatgaactccagatctacgagcttgtcagttagtctggtgctcgtcggtgtggtaacactgtatcttggggccatggtgcaggctgactccggatgtgttgtcagctggaagaataaagagctgaagtgcggctctggtattttcatcaccgataacgtgcacacttggacagaacagtacaagtttcaacccgagtcaccaagtaaattggccagcgcaatacagaaggcccatgaagagggcatttgtgggatcaggtccgtgacccggctcgaaaatctgatgtggaaacagattactcccgagttaaaccacatcctgtctgagaatgaagtcaagctaaccataatgacaggagacatcaaaggcattatgcaggctgggaagcgctcgctcagacctcaaccaacggagctgaaatatagctggaagacctggggaaaggccaaaatgctttccactgaatcacataaccagacattcttgatcgatggcccggagaccgcagaatgccccaatacaaacagggcgtggaatagtctggaggttgaggactacggttttggggtgttcactaccaacatttggctcaagctgcgtgaaaaacaggacgtgttttgtgattctaagttaatgagcgctgccatcaaagacaatcgggcagtacacgccgatatgggatattggatagagtccgctctgaacgacacgtggaagatggaaaaggcctcattcattgaggtcaaaagctgccactggcctaagtctcatacactttggtccaatggcgtgttggagagtgaaatgatcatcccaaaaaacttcgcaggtcccgttagccagcacaactaccgacctggctatcatacccaaactgctgggccatggcacctcggaaagctggagatggattttgacttctgtgaaggcaccacagtggtcgtgactgaggattgcgggaatagaggaccctctctaaggaccacaacggcctccggcaaactgattaccgaatggtgctgtcgctcatgcactctcccgcctctgcggtacagaggtgaggacgggtgttggtacggaatggagatcaggccacttaaggaaaaggaggaaaacttggttaatagtctggtgacagcgggccatggtcagattgataactttagcttaggcgtactcgggatggccctgttccttgaggaaatgctgcgcacccgagtcggaactaaacacgctatattgctcgtggcagtgtcgtttgtcacactgatcaccggcaatatgtccttccgggacctagggcgtgttatggtgatggtaggagccacgatgactgatgacattggcatgggtgtgacctatctggctctcctggccgcatttaaggtcagacccacattcgcggccgggcttttgctgaggaaattaacctctaaggagctcatgatggctactatcggaattgccctgcttagccagtcaacaatccctgagaccatactggaactaacagatgcactcgctctgggcatgatggtgttgaaaatcgttcgcaacatggagaagtaccaactggccgtgactgtcatggcaattagttgcgtgcccaatgccgttatcttacagaacgcttggaaggtgtcctgtaccattctcgcggccgtctctgtaagcccactgcttctgacgtcctcacagcagaaagcagactggatccctttggctctcacaataaagggcctgaatcccaccgccatttttctaactaccctgagccggacaagtaaaaagagatcttggccacttaacgaagccatcatggctgtggggatggtttccatcctcgcaagctcgctgttgaaaaatgacattccgatgactggacctctggtggccggtggcttactcaccgtctgctatgtgctgacggggaggtcagcggatcttgagctggaacgagctgccgacgtaaagtgggaggatcaagcagagatatctggaagttcccccatcttgagcattacaatctctgaagacggcagcatgtccattaaaaacgaggaagaggagcagaccctcactatcctgatacgcacaggtctactggtgatctcaggggtcttcccagttagtattcccatcaccgccgctgcatggtacctttgggaagtgaagaagcagcgggccggagtgctctgggatgtccctagcccaccccctgtgggcaaagcggagctggaagacggcgcttatagaattaagcagagggggatcttgggatactctcaaataggtgccggcgtttataaagaggggacttttcacacaatgtggcatgtaacccgtggagcagtgttaatgcaccgcggcaagcggattgaaccgtcctgggccgatgtcaaaaaggacctgatctcatacggtgggggatggaagctcgagggcgagtggaaagaaggcgaggaagtgcaggttctggctcttgagccagggaagaatcccagagccgtgcagacgaaacctggaatcttcaagactaacaccggtacaattggcgcagtcagtctggattttagcccagggacctccggatctcccatcgtggacaggaaaggcaaggtagtcggtttgtacgggaatggagtggttacacgatcgggcgcttatgtgagcgccatagcgcagactgaaaagtcaattgaggataaccctgagatcgaagacgatattttccggaaaaagcgcctaaccatcatggacctgcatccgggcgccgggaaaacgaagagatacctccccgcaatagtcagggaggctattaaacggggactgcgaacacttatcttagccccaactagagtggttgctgcagaaatggaggaagccctgcgcggtctccctatcaggtatcaaacccccgccattaaggctgagcacacaggccgtgagatcgtggacttgatgtgtcatgcgaccttcactatgcggctgctctccccagtcagagtgcctaactacaatctgattataatggatgaagcacactttaccgaccccgccagtatcgctgccagggggtatatttctacacgcgtagagatgggagaagcagccggcatcttcatgacggctactccaccgggtagccgagatccttttccccagtccaacgcgccaatcatggacgaggagagagaaattcccgagcggtcatggaattctgggcacgaatgggtgaccgatttcaagggaaaaacagtttggtttgtccctagcataaaggccggcaacgacatcgcagcttgccttaggaaaaatggcaagaaagtgattcagctgagtcgcaagaccttcgattccgagtacgtgaagactcgtgccaacgactgggattttgtcgtaacaaccgacatcagcgaaatgggggcaaatttcaaagccgagagagtgattgatccacggaggtgtatgaagcccgttatcttgacggacggagaggaacgcgtgatactagctggtcctatgccggtcactcattcttcagccgcgcaacgaagaggccggatcgggaggaacccaaaaaatgagaacgaccagtatatttacatgggagaacccctggagaatgatgaagactgcgcacactggaaggaggccaaaatgctcttagataacatcaatacacctgagggcattatcccctccatgtttgaaccagagcgcgaaaaggtggacgctatagatggtgagtacagactgaggggggaagcccggaaaaccttcgttgaccttatgcgtcgcggcgatctgcctgtgtggctcgcttataaggtcgcagccgagggaattaactacgctgaccgaaagtggtgttttgatggcatcaaaaataaccagattttggaggaaaacgtggaggtagaaatctggaccaaggagggggagagaaaaaagctgaaacccaggtggctcgacgcccggatatatagtgatccactggcacttaaggaattcaaggagttcgcggccggacgcaaaagcctagctctgaatttgatcactgaaatgggtagattacctacatttatgacccagaaggccaggaacgcactggacaatctcgctgtgctgcatacagccgaggcaggcgggcgggcctacaaccacgctctttcggaactgccggagactctcgagacgttgctgctactgaccctccttgcgacagttactggaggcattttcctgtttttaatgtctggtaaagggatcggcaagatgaccttgggaatgtgctgcattatcacagcctccgtcctgctctggtatgcacaaatacagccccactggattgctgccagcatcatcctggaattctttcttattgtgctgctcatcccagagcctgaaaaacagcgaaccccccaggataatcaattgacttacgtggtcatagccattctgacggttgtggcagctaccatggccaacgagatgggcttcttagaaaagacaaagaaagacctagggctgggatcaatcactacccaggagagtgagtctaatattctcgacatcgatcttagaccagcgtccgcttggacactgtatgccgtagcaaccacttttgtgacacctatgttgcgccatagcatagaaaactcaagtgtcaatgtgagcctgacggccatcgctaaccaggcaaccgttctcatgggtctgggcaaggggtggcccctttccaaaatggacattggagtgccgctcctggccatcggctgttactctcaggtcaatccaattactttgacagcggctctgttactactggtagcccactacgcaatcattggtcctgggctccaagccaaggctaccagggaggcccagaaacgggcagctgccggcatcatgaagaaccccaccgtggatggaataacagttattgaccttgaaccaatcccctatgatcctaagttcgagaaacagctgggccaggtgatgttgctgatcctctgcgtcactcaagtgctgatgatgcgtacgacctgggcgctttgtgaagccttaacactggcaactgggccgattagcaccctctgggagggaaatcccggcagattttggaacacaaccatagctgtctccatggccaatatcttcaggggttcatacttggcaggggctggactgctattttctattatgaagaacactacgaatacacgccggggcaccggtaacatcggcgagactctgggggaaaaatggaagagtcgactcaacgcccttggaaaatcggagttccagatttataagaaaagcggcatccaggaagtggacagaaccctggccaaggaggggataaagaggggagagacagatcatcacgcggtttcccgcggctctgctaaattgcggtggtttgtggaaagaaatatggtaactccagagggtaaggtggtcgacctggggtgcggacgtggcggttggtcatactattgtggcgggctcaaaaacgttagggaagtgaagggactgaccaaaggcgggcctggacatgaggaacccatccctatgagcacatacggctggaatttagtccggcttcaatccggtgtggatgtattcttcacgccacccgagaagtgcgacaccctgctctgtgatattggggagagttctcctaacccaactatcgaagcaggacgcacactacgagtgctgaatttggttgagaactggctgaataacaatacccagttttgcattaaggtgctcaacccctatatgccgagcgtcatcgaaaaaatggagactcttcagagaaagtacggcggcgccctggtgaggaatcctttgtcacggaactccacacacgaaatgtactgggtcagtaatgctaccgggaacatagtgagctctgttaatatgatttcccgcatgctgatcaacagattcacgatgaaacacaagaaagccacctatgagccagacgtagatctcggatcaggtacaaggaacatcggcattgagagcgaaatacccaatttagacatcattgggaagcgaatcgagaagattaaacaggaacatgagacttcgtggcactacgaccaagatcatccttataagacctgggcataccacggatcttatgaaacaaaacagactggcagtgcctccagcatggtgaacggtgtcgtgcggctgcttaccaagccatgggacgttgtgcccatggtcacacagatggctatgaccgatactacgccgtttgggcagcaacgtgtgttcaaagagaaggtagacacaagaacccaggagcctaaggaaggaactaaaaagctgatgaaaatcaccgcggagtggctatggaaggaactcggcaaaaagaaaacaccccgcatgtgtacgagggaggagtttacccggaaggtgagatcaaatgccgcactgggcgctatattcactgatgaaaacaagtggaaatccgcccgcgaggcagttgaagacgggaggttttgggagttggtcgatcgagaacggaatctgcacctcgagggaaagtgcgagacatgtgtgtacaacatgatgggtaaaagagaaaagaaacttggcgagttcgggaaggccaagggatctagggctatctggtatatgtggctgggcgcccgctttttagaattcgaggcgctgggttttttgaatgaagaccattggttcagccgtgggaacagtctctccggagtggagggcgagggcctgcaccggctagggtacattcttagagatgtcggaaaaaaggaaggtggcgcaatgtacgccgacgataccgctgggtgggacactaggatcacactggaggacctcaaaaatgaagagatggttaccaaccatatgaagggagaacacaaaaagctggccgaggcaatttttaagttgacatatcagaataaagtggtacgcgtgcagcgaccaactcctcggggcaccgtcatggatatcattagcagaaaggaccaaaggggttctgggcaggtgggaacgtacggcctgaacaccttcacaaatatggaggctcagctcatacgccaaatggaaggcgaggggatcttcaaatcaattcagcatcttactgccaccgaagagatcgctgttcagaactggctgacaagagtgggacgggagaggttaagtcgtatggccatctccggtgatgactgcgtcgtgaagcccattgatgaccgatttgcaagcgcgctgactgccttgaatgatatgggcaaagtacgcaaggacatacagcaatgggaaccatctagagggtggaacgattggacccaggttcccttctgctcgcaccactttcatgagctcgtgatgaaggacggacgggtcctggtggtgccttgtaggaaccaggatgaactaatcggccgcgctagaatttcacagggtgccgggtggagccttaaagagacggcatgcctgggaaagtcctatgctcaaatgtggacactcatgtacttccaccggagggacctgcgattggccgcaaatgccatctgtagtgcggtcccatctcattgggttccgaccagccgtactacatggtccattcacgctaaacacgaatggatgaccactgaggatatgttagccgtgtggaacagagtatggatccaggagaatccctggatggaagacaagacccctgtggagtcatgggaagaggtcccatatctgggcaaacgcgaagaccagtggtgcggcagtctcatagggcttacatctcgggcaacgtgggccaagaacatccagaccgctattaatcaagtgaggagcctgatcggaaacgaggagtacactgattatatgccctccatgaagagatttcgccgggaagaggaagaggccggtgttctatggtga

SEQ ID NO: 14751 - RNA, 9876 nt, synthetic construct
  misc_feature 1..9876: note = derived and/or modified CDS sequence (opt3) from DENV-2__FJ850112__SS-prME
  source 1..9876: mol_type = other RNA
accgccggagtgatcattatgctgatacccacagctatggcattccacctcactacgcgtaacggggaacctcatatgatcgtcggaaggcaggaaaagggtaaaagccttctgtttaagaccgaggacggcgttaatatgtgcacattgatggccattgatttaggggaactgtgtgaggacactatcacctacaaatgcccactactccggcaaaacgaaccggaggatattgactgttggtgcaattccacatctacctgggtgacttatggaacatgtaccacgactggcgagcaccgccgagaaaagcgttcagttgcgctggtgccccatgtcggtatggggcttgagaccagaacagaaacttggatgagtagcgagggagcttggaaacacgtgcagaggatcgagacctggatactgcggcatcctggcttcacaatcatggccgcaattttggcctacaccatcggcacgactcactttcagcgcgctctcattttcatcctgctgacagcagttgccccatccatgaccatgagatgcatagggatttctaacagggattttgtggaaggagtctcgggtggctcatgggtggacatcgtactcgagcacgggagctgtgttactacaatggctaagaataagcccaccttagatttcgaactgattaaaacggaggccaagcagcctgcgacccttcggaaatattgcatcgaagcaaagttgacaaacactaccacagagagtcgctgtccaactcaaggagagccctccctgaatgaggaacaggacaaacgatttatctgcaagcattctatggtggatagaggctggggtaacgggtgtggactattcggcaagggcgggattgtcacatgcgccatgtttacatgcaaaaagaatatggaaggaaaagtggtgcagcctgagaacctcgaatacaccatagtcatcactccacacagcggtgaggagcatgctgttggcaatgacacggggaagcacggaaaagaaattaagatcacaccgcagtcctcaataaccgaggccgaactgactggctatggtaccgtgacaatggagtgtagtcccaggaccgggcttgatttcaacgaaatggtactgttgcaaatggaggacaaagcatggctcgtgcaccggcagtggtttctggatttacctctgccatggctccccggcgctgacactcagggaagcaattggattcagaaggagacacttgtcacgttcaagaaccctcatgccaaaaagcaagacgtggttgtgctgggctctcaggaaggggcgatgcacaccgccttgactggagcaacagagatccagatgtcctcaggtaatctactgtttaccggccatctcaaatgccgtctgcgcatggataaacttcaactgaaagggatgagctacagtatgtgtacaggaaagttcaagatcgtcaaagaaattgctgagactcagcacggcaccatcgtgattagagtacagtatgagggtgacgggtctccatgcaagatacccttcgaaatcacggatttggagaaaaggcatgttctcggccggctgattaccgtgaacccgatcgtcatcgaaaaggactcccctgtgaacattgaggccgaacccccatttggagatagctacataatcattggcgtcgagcctgggcagttaaaactgaattggttcaagaagggatcgtctatcggtcaaatgtttgagacaactatgcgaggcgctaaacgcatggccattctaggggacaccgcatgggatttcggatccctcggcggtgcctttacatcaatcgggaaggctctgcaccaggtgttcggcgcgatatacggagcagcctttagtggcgttagctggactatgaaaatccttattggggtggtaatcacctggattggaatgaactccagatctacgagcttgtcagtcagtctggtgctcgttggcgtggtcacactgtatcttggtgctatggtgcaggccgactccgggtgtgtagtgagctggaagaataaagaactgaagtgcggatctggcatcttcataaccgataacgttcacacttggacagagcagtacaagtttcaacccgaatcaccaagtaaattggcaagcgccattcagaaggctcatgaggaaggtatctgtggcattaggtccgtcacccggctcgagaatctgatgtggaaacagatcactcccgagttaaaccacatactgtctgaaaatgaggtgaagctaaccatcatgacaggggacacgaaaggaattatgcaggccggcaagcgctcgctcagacctcaaccaaccgaactgaaatatagctggaagacttgggggaaggcaaaaatgctttccacagagtcacataaccagaccttcttgatcgatggaccggaaacagcggagtgccccaatactaacagggcttggaatagtctggaggtggaagactacggctttggtgtcttcaccacgaacatttggctcaagctgcgtgagaaacaggacgtattttgtgattctaagttaatgagcgccgcaatcaaagacaatcgggccgtgcacgctgatatggggtattggatagaatccgccctgaacgacacatggaagatggagaaggcatcattcattgaggtgaaaagctgccactggcctaagtctcataccctttggtccaatggagtattggaaagtgagatgatcatccccaagaacttcgctggccccgtcagccagcacaactaccgacctggttatcatactcaaaccgccggcccatggcacctcgggaagctggaaatggattttgacttctgtgagggaacaactgtggttgtgaccgaagattgcggcaatagagggccctctctaaggacaacgaccgcgtccggaaaactgattactgagtggtgctgtcgctcatgcacactcccgcctctgcggtacagaggcgaggacggttgttggtacgggatggaaatcaggccacttaaggagaaggaagagaacttggtcaatagtctggtgaccgccggacatggccagattgataactttagcttaggtgttctcggcatggctctgttccttgaagagatgctgcgcactcgagtggggacaaaacacgcaatattgctcgtagccgtctcgtttgtgaccctgatcacgggaaatatgtccttccgggacctaggccgtgtgatggtcatggttggggctactatgaccgatgacattggaatgggcgtgacatatctggccctcctggcagcgtttaaggtaagacccaccttcgccgctggtcttttgctgaggaaattaacttctaaggagctcatgatggccacaatcgggattaccctgcttagccagtcaacaatccctgaaactatactggagctaaccgatgcactcgctctgggaatgatggtgttgaaaatcgtccgcaagatggaaaagtaccaactggccgtgacgattatggcaatcagttgcgttcccaacgccgtgattttacggaatgcttggaaagtctcctgtacaatcctcgcggccgtgtctgttagcccactgcttctgacctcctcacagcagaaggcagactggatacctttggctctcactattaaaggcctgaaccccaccgccatctttctaacaactctgagcagaaccagtaagaaaaggtcttggccacttaatgaggccatcatggctgtgggcatggtctccattctcgcaagctcgctgttgaagaacgacataccgatgacggggcctctggtagccggaggtttactcacagtgtgctatgttctgaccggccgatcagcggatcttgaactggagcgcgctgccgacgtgaaatgggaggatcaggcagaaatctctgggagttcccccattttgagcatcactatttctgaggacggaagcatgtccatcaagaatgaagaggaggaacaaacactcaccatactgatccggactggcctactggtcatttcaggtgtgttcccagtaagtatccccattacagccgctgcatggtacctttgggaggtgaagaaacagagagccggggtcctctgggatgttcctagcccaccccctgtgggaaaggcggaactggaggacggcgcttataggatcaaacagcgtggcatattggggtactctcagattggagccggtgtgtataaggaaggcacctttcacacgatgtggcatgtcactcgcggggcagtgttaatgcaccggggaaaaagaatcgagccgtcctgggccgatgttaagaaggacctgatctcatacggcggtgggtggaaactcgagggagaatggaaggagggcgaagaggtacaagtgctggctcttgaaccaggcaaaaaccccagggccgtccagaccaagcctgggattttcaaaacaaataccggaacaatcggtgcagtgagtctggattttagcccaggcacttccgggtctcccatagttgaccgaaagggaaaggtggtcggcttgtacggtaacggggtggtaacccggtcgggagcttatgtcagcgccattgcgcagacggagaaatcaatcgaggataatcctgaaattgaggacgatatcttccgcaagaaaagactaacaataatggacctgcatccgggcgccggcaagactaaaaggtacctccccgcaattgtgcgggaagctatcaagcgagggctgagaacccttatcttagccccaacacgcgttgtggctgcagagatggaagaggccctgaggggactccctattcgttatcagacccccgccatcaaggctgagcacactggtcgggaaattgtcgacttgatgtgtcatgcgaccttcacaatgagactgctctccccagtgagggttcctaactacaacctgataatcatggatgaggcacactttacggaccccgccagtattgctgcccgcggctatatctctactcgagtggaaatgggggaggcagccggaatcttcatgaccgctacaccaccgggcagcagagatccttttccccaatccaatgcgccaattatggacgaggaacgggagatacccgaaaggtcatggaactctggtcacgagtgggtcaccgatttcaaagggaagactgtgtggtttgtacctagcatcaaagccggaaatgacattgcagcttgccttcgcaagaacggcaaaaaggtgatccagctgagtcgtaagacattcgattccgaatacgttaaaaccagagccaatgactgggattttgtcgtgacgactgacattagcgagatgggcgcaaacttcaaggccgagcgggtgatcgatccaaggcgctgtatgaaacccgtcatattgacagacggggaagaacgagtaatcctagctggacctatgccggtgacccattcttcagccgcgcagagacggggtaggattggccgcaatccaaagaacgaaaatgaccaatatatctacatgggggagcccctggaaaacgatgaggactgcgcacactggaaagaggccaagatgctcttagataatattaacacccctgaaggaatcataccctccatgtttgagccagaaagagagaaagttgacgctattgatggcgaatacaggctgcggggtgaggcccgtaagactttcgtggaccttatgcgccgaggggatctgcctgtctggctcgcttataaggtggcagccgagggcatcaattacgctgacagaaaatggtgttttgatggaattaagaacaatcagatcttggaagagaacgttgaagtggagatatggacaaaagagggcgaaaggaagaaactgaagccccggtggctcgacgcccgcatctatagtgatccactggcacttaaggagttcaaagagttcgcggccgggagaaagagcctaaccctgaacttgattacagagatgggaaggttacctacttttatgacgcagaaagctcggaatgccctggacaacctcgcagtcctgcataccgctgaagccggtggccgagcatacaatcacgccctttcggagctgccggagacactcgaaactttgctgctactgaccctccttgctacagtgaccgggggaatcttcctgtttttaatgtctggcaagggtattgggaaaatgactttgggcatgtgctgcatcataacggcgtccgtactgctctggtatgcccagattcaaccccactggatcgcagctagcatcattctggagttctttcttatcgtgctgctcataccagaacctgagaagcagagaaccccacaggataaccagttgacatacgttgtcattgccatcctgactgtggtggccgcaaccatggctaatgaaatgggattcttagagaagaccaagaaggacctaggcctggggtcaattaccactcaagagagtgaatctaacatcctcgacatagatcttcgcccagcctccgcgtggacactgtatgctgtcgccacgacctttgttactcctatgttgaggcatagcatcgaaaattcaagtgtgaacgtaagcctgacagcaattgccaatcaggctaccgtgctcatgggactgggtaaaggctggcccctttccaagatggacatcggggtcccgctcctggcaattggatgttactctcaggtgaacccaatcaccttgacagccgcgctgttactactggttgctcactacgccattatcggccctggtctccaggcaaaagccactcgggaagctcaaaagcgtgccgcagctgggataatgaagaatcccacggtggatggcattaccgtcatcgaccttgagccaatcccctatgatcctaaattcgaaaagcagctgggacaggtaatgttgctgattctctgcgtgacacaggttctgatgatgagaactacctgggccctttgtgaggcgttaacactggccaccggcccgataagcactctctgggaggggaaccccggaaggttttggaatacgacaatcgcagtgtccatggctaacattttccgcggctcatacttggccggtgcagggctgctattttctatcatgaaaaataccactaacacccggcgaggaacaggcaatattggtgaaactctgggcgagaagtggaaaagtagactcaacgctcttgggaagtcggagttccaaatctataaaaagagcggaatacaggaggtcgacaggaccctggccaaggagggcatcaaacgcggggaaacagatcatcacgccgtgtcccggggatctgcgaagttgagatggtttgtcgagcgtaacatggtgacgccagaaggcaaagttgtggacctgggttgcgggaggggaggctggtcatactattgtggtggcctcaagaatgtacgggaggtgaaagggctgaccaagggaggccctgggcatgaagaacccattcctatgagcacttacggatggaacttagtccgccttcagtccggcgttgatgtgttcttcacaccacccgagaagtgcgacaccctgctctgtgatatcggtgaaagttctcctaatccaactattgaggctgggcgaacactaagagtcctgaacttggtggaaaattggctgaacaataacacccaattttgcatcaaagtactcaatccctatatgccgagcgtgatagagaagatggaaacgcttcagaggaaatacggaggcgcactggttcggaaccctttgtcacgcaattccacccacgagatgtactgggtgagtaacgccacaggcaatattgtcagctctgtgaacatgatctccagaatgctgatcaataggttcactatgaagcacaaaaaggctacctatgagccagacgtcgatctcgggtcaggaacacgaaacattggtatagaaagcgagatccccaacttagacattatcggcaagcggattgagaaaatcaagcaggagcatgaaacttcgtggcactacgaccaggatcatccttataaaacctgggcctaccacgggtcttatgagacaaagcaaaccggaagtgcatccagcatggtgaatggcgttgtacgtctgcttactaaaccatgggacgtggtccccatggtgacgcagatggccatgacagataccactccgtttggtcagcagagagttttcaaggagaaggtggacacccgcacacaagaacctaaagaggggacgaagaaactgatgaggataaccgctgaatggctatggaaggagctcggcaaaaagaaaactccccggatgtgtacaagagaggaatttacccgcaaggtcaggtcaaacgcggccctgggcgcaatcttcactgatgagaataagtggaaatccgctcgagaagccgtggaggacggccggttttgggaattggtagataaggagagaaacctgcacctcgaggggaaatgcgaaacatgtgtgtacaatatgatgggaaagagggagaagaaacttggtgagttcggcaaagcaaaagggtctcgcgccatttggtatatgtggctgggagctagatttttagagttcgaagccctgggctttttgaacgaggaccattggttcagccggggtaatagtctctccggggttgagggagaaggcctgcacagactaggctacatccttagggatgtcgggaagaaagagggaggtgcgatgtacgcagacgataccgccggctgggacacacgcattactctggaagacctcaagaacgaggaaatggtgaccaatcatatgaaaggggagcacaagaagctggctgaggccatctttaaattgacgtatcagaacaaggtggtccgagttcagcggccaacccctagaggaacagtgatggatattataagcaggcgcgaccagagaggctctggtcaagtagggacttacggactgaataccttcacaaacatggaagcacagctcatccggcagatggagggcgaaggcattttcaaatcaatccaacatcttactgctaccgaggagatcgccgtgcagaattggctggctagggtcgggcgtgaacgattaagtcgcatggccatttccggagatgactgcgtggttaagcccatagatgacagatttgcaagcgcgctgacggccttgaacgatatgggtaaagtgcggaaggacatccagcagtgggagccatctaggggctggaatgattggacacaagtccccttctgctcgcaccactttcatgaactcgtgatgaaggacgggcgcgtactggttgtgccttgtagaaaccaggatgagctaattggacgggctaggatctcacagggcgccggttggagccttaaagaaaccgcatgcctggggaagtcctatgctcagatgtggactctcatgtacttccaccgacgtgacctgagattggccgcaaacgccatttgtagtgcggtcccatctcattgggtgccgacaagccgcaccacttggtccatccacgctaaacacgagtggatgaccacagaggatatgttagccgtgtggaatcgggtctggatacaagaaaacccctggatggaggacaagacgcctgttgaatcatgggaggaagtgccatatctgggaaaaagggaggaccagtggtgcggcagtctcatcggccttacctctagagcaacttgggccaagaatattcagacagctatcaaccaggtacgcagcctgattgggaatgaggaatacaccgattatatgccctccatgaagcggtttaggcgagaggaagaggaagccggagtgctatggtga
